United States Patent
Weinstock et al.

(10) Patent No.: US 6,747,137 B1
(45) Date of Patent: Jun. 8, 2004

(54) **NUCLEIC ACID SEQUENCES RELATING TO *CANDIDA ALBICANS* FOR DIAGNOSTICS AND THERAPEUTICS**

(75) Inventors: Keith G. Weinstock, Westborough, MA (US); David Bush, Somerville, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/248,796

(22) Filed: Feb. 12, 1999

Related U.S. Application Data

(60) Provisional application No. 60/096,409, filed on Aug. 13, 1998, now abandoned, and provisional application No. 60/074,725, filed on Feb. 13, 1998, now abandoned.

(51) Int. Cl.[7] .......................... C07H 21/00; C12Q 1/68
(52) U.S. Cl. .................. 536/23.1; 435/6; 536/24.3; 536/24.31; 536/24.32; 536/24.33
(58) Field of Search .................. 435/6, 69.1; 536/23.1, 536/24.1, 24.3–24.33; 436/501

(56) References Cited

PUBLICATIONS

Gaur et al., Infection and Immunity, vol. 65, No. 12, pp. 5289–5294, 1997.*
Hoyer et al., Current Genetics, vol. 33, pp. 451–459, 1998.*
Hoyer et al., Molecular Microbiology, vol. 15, No. 1, pp. 39–54, 1995.*
Gerhold et al., Bio–Essays, vol. 18, No. 12, pp. 973–981, 1996.*
Wells et al., Journal of Leukocyte Biology, vol. 61, No. 5, pp 545–550, 1997.*
Russell et al., Journal of Molecular Biology, vol. 244, pp. 332–350, 1994.*
1990 Sigma Chemical Company Catalog [Publ. by Sigma Chemical Company, P.O. Box 14508, St. Louis, Missouri] pp. 776–778, 1990.*
Gillum et al., *Isolation of the Candida albicans gene for orotidine–5'–phosphate decarboxylase by Complementation of S. cerevisiae ura3 and E. coli pyrF Mutations,* Mol. Gen. Genet., 198:179–182, 1984.

* cited by examiner

*Primary Examiner*—Ardin H. Marschel
(74) *Attorney, Agent, or Firm*—Genome Therapeutics Corporation

(57) ABSTRACT

The invention provides isolated polypeptide and nucleic acid sequences derived from *Candida albicans* that are useful in diagnosis and therapy of pathological conditions; antibodies against the polypeptides; and methods for the production of the polypeptides. The invention also provides methods for the detection, prevention and treatment of pathological conditions resulting from fungal infection.

12 Claims, No Drawings

NUCLEIC ACID SEQUENCES RELATING TO *CANDIDA ALBICANS* FOR DIAGNOSTICS AND THERAPEUTICS

CROSS-REFERENCE TO RELATED APPLICATIONS

This application is converted from U.S. provisional application Serial No. 60/074,725, filed Feb. 13, 1998 now abandoned and U.S. provisional application Serial No. 60/096,409 filed Aug. 13, 1998 now abandoned.

FIELD OF THE INVENTION

The invention relates to isolated nucleic acids and polypeptides derived from *Candida albicans* that are useful as molecular targets for diagnostics, prophylaxis and treatment of pathological conditions, as well as materials and methods for the diagnosis, prevention, and amelioration of pathological conditions resulting from fungal infection.

BRIEF DESCRIPTION OF THE SEQUENCE LISTING

Incorporated herein by reference in its entirety is a Sequence Listing comprising SEQ ID No. 1 to SEQ ID NO:28208. The Sequence Listing is contained on a CD-ROM, three copies of which are filed, the Sequence Listing being in a computer-readable ASCII file named "cand09.2001.txt", created on Sep. 14, 2001 and of 38,660 bytes in size, in IBM-PC Windows®NT v4.0 format.

BACKGROUND OF THE INVENTION

*Candida albicans* is a dimorphic fungus which has both a yeast-like growth habit and a filamentous form consisting of both hyphae and pseudohypae. The fungus is a member of the normal surface flora of most individuals. Although no sexual state has been described for *C. albicans*, the genome is diploid in most strains (Whelan, W L et al. (1980) *Mol. Gen. Genet.* 180: 107–113; Whelan, W L and Magee, P T (1981) *J. Bacteriol.* 145: 896–903; Poulter, R. (1982) *J. Bacteriol.* 152: 969–975) and rearranges relatively frequently (Rustchenko-Bulgac E P, et al (1990) *J Bacteriol.* 172: 1276–1283; Barton, R C and Scherer, S (1994)*J. Bacteriol* . 176: 756–763). In addition, one non-universal decoding is known in which a leucine codon (CUG) is translated as a serine (Leuker et al. (1994), *Mol. Gen. Genet.* 245: 212–217; Santos et al., (1993) *EMBO Journal* 12:607–616). This creates difficulties in the application of the powerful genetic and molecular methods used in Saccharomyces and Schizosaccharomyces.

*C. albicans* exists as part of the normal microbial flora in humans, but can produce opportunistic infections ranging from topical infections such as oral thrush to life-threatening disseminated mycoses (Ampel, N M (1996) *Emerg. Infect. Dis.* 2: 109–116). Candida is a major cause of nosocomial infections and was found to account for more than 75% of all fungal nosocomial infections reported by NNIS (National Nosocomial Infections Surveillance) hospitals from 1980–1990 in which fungi alone accounted for 7.9% of all nosocomial infections (Beck-Sagu, C M and Jarvis, W R (1993) *J. Infect. Dis.* 167: 1247–1251). Although the source of Candida in infections is frequently traced to endogenous sources on the patient, it has also been traced to exogenous sources in the hospital environment including contaminated solutions and equipment (Shetertz, R J et al. (1992) *J. Pediatr.* 120: 455–461; Weems, J J et al. (1987) *J. Clin. Microbiol.* 1925: 1029–1032), and health care workers (Hunter, P R et al (1990) *J. Med Vet Mycol.* 28: 317–325; Burnie, J P (1986) *J. Hosp. Infect.* 8: 1–4; Doebbeling, B N et al. (1991) *J. Clin. Microbiol.* 29: 1268–1270). Numerous investigations into the molecular basis of pathogenicity have been made implicating the hyphal form (Lo, H J et al. (1997) *Cell* 90:939–949), surface molecules including adhesins (Fukazawa Y and Kagaya K (1997)*J Med Vet Mycol* 35:87–99), and ATP-binding cassette-containing multi-drug resistance proteins (Prasad, R et al.(1995) *Curr. Genet.* 27: 320–329).

The antimicrobials currently in use against Candida are generally of three types: azoles, such as iluconazole, itraconazole, and clotrimazole; polyenes, such as amphotericin B and nystatin; and 5-fluorocytosine. However, invasive infections are treated primarily with fluconazole, amphotericin B, and 5-fluorocytosine, although the latter two compounds have significant toxic side effects. The development of resistance to iluconazole by *C. albicans* has been noted by a number of researchers (Redding, S (1994) *Clin. Infect. Dis.* 18: 339–346; Sargeorzan, J A (1994) *Am. J. Med.* 97: 339–346; Revankar, S G et al. (1996) *J. Infect. Dis.* 174: 821–827; Marr, K A et al. (1997) *Clin. Infect. Dis* 25: 908–910). Relatively short treatments seem to result in few if any resistant isolates, but extended treatments including prophylactic treatments such as are required among immunocompromised and AIDS patients, result in the appearance of fluconazole-resistant strains (Johnson, E M (1995) *J. Antimicrob. Chemother.* 35: 103–114). Development of fluconazole-resistance has been observed to be associated with the development of amphotericin-resistance (Vazquez, J A (1996) *Antimicrob. Agents Chemother.* 40: 2511–2516; Nolte, F S et al. (1997) *Antimicrob. Agents Chemother.* 41: 196–199; White, T C (1997) *ASM News* 63: 427–433) consistent with the action of both drugs on ergosterol in the membrane.

The difficulty in diagnosing *C. albicans* infections, the limited spectrum of current therapeutic drugs and the development of drug resistant strains of *C. albicans* provide the rationale for the identification of targets for more rapid and effective methods of identification, prevention, and treatment of candidiasis. The elucidation of the genome of *C. albicans* would enhance the understanding of how *C. albicans*, as well as other fungi, causes invasive disease and how best to combat fungal infection.

SUMMARY OF THE INVENTION

The present invention fulfills the need for diagnostic tools and therapeutics by providing fungal-specific compositions and methods for detecting, treating, and preventing fungal infection, in particular *C. albicans* infection. They also have use as biocontrol agents for plants.

The present invention encompasses isolated nucleic acids and polypeptides derived from *C. albicans* that are useful as reagents for diagnosis of fungal disease, components of effective antifungal vaccines, and/or as targets for antifungal drugs including anti-*C. albicans* drugs. They can also be used to detect the presence of *C. albicans* and other Candida species in a sample; and in screening compounds for the ability to interfere with the *C. albicans* life cycle or to inhibit *C. albicans* infection.

More specifically, this invention features compositions of nucleic acids corresponding to entire coding sequences of *C. albicans* proteins, including surface or secreted proteins or parts thereof, nucleic acids capable of binding mRNA from *C. albicans* proteins to block protein translation, and methods for producing *C. albicans* proteins or parts thereof using peptide synthesis and recombinant DNA techniques. This invention also features antibodies and nucleic acids useful as probes to detect *C. albicans* infection. In addition, vaccine compositions and methods for the protection or treatment of infection by *C. albicans* are within the scope of this invention.

The nucleotide sequences provided in SEQ ID NO: 1–SEQ ID NO: 14103, a fragment thereof, or a nucleotide sequence at least about 99.5% identical to a sequence contained within SEQ ID NO: 1–SEQ ID NO: 14103 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 14103, a fragment thereof, or a nucleotide sequence at least about 99.5% identical to a sequence contained within SEQ ID NO: 1–SEQ ID NO: 14103. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 14103, a fragment thereof, or a nucleotide sequence at least about 99.5% identical to SEQ ID NO: 1–SEQ ID NO: 14103 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *C. albicans* open reading frames (ORFs) within SEQ ID NO: 1–SEQ ID NO: 14103 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *C. albicans* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *C. albicans* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *C. albicans* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software include, but are not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art will readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *C. albicans* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There is a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *C. albicans* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *C. albicans* genome. In the present examples, implementing software which implement the BLASTP2 and bic_SW algorithms (Altschul et al., J Mol. Biol. 215:403–410 (1990); Compugen Biocellerator) was used to identify open reading frames within the *C. albicans* genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *C. albicans* polypeptides, preferably a substantially pure preparation of an *C. albicans* polypeptide, or a recombinant *C. albicans* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, more preferably at least about 50, 100, or 150 contiguous amino acid residues of the invention contained in the Sequence Listing. In yet another preferred embodiment, the amino acid sequence which differs in sequence identity by about 7% to about 8% from the *C. albicans* amino acid sequences of the invention contained in the Sequence Listing is also encompassed by the invention.

In preferred embodiments: the *C. albicans* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *C. albicans* polypeptide differs in amino acid sequence at about 1, 2, 3, 5, 10 or more residues from a sequence of the invention contained in the Sequence Listing. The differences, however, are such that the *C. albicans* polypeptide exhibits an *C. albicans* biological activity, e.g., the *C. albicans* polypeptide retains a biological activity of a naturally occurring *C. albicans* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *C. albicans* polypeptide is a recombinant fusion protein having a first *C. albicans* polypeptide portion and a second polypeptide portion, e.g., a second polypeptide portion having an amino acid sequence unrelated to *C. albicans*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *C. albicans* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *C. albicans* encoded polypeptide exhibits a *C. albicans* biological activity, e.g., the encoded *C. albicans* enzyme retains a biological activity of a naturally occurring *C. albicans*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *C. albicans* strain from which the nucleotide sequences have been sequenced is strain SC5314, a clinical isolate which was originally obtained from a patient with disseminated candidiasis.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *C. albicans* polypeptides, especially by antisera to an active site or binding domain of *C. albicans* polypeptide. The invention also includes fragments, preferably biologically active fragments. These and other polypeptides are also referred to herein as *C. albicans* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *C. albicans* nucleic acid will include a transcriptional regulatory sequence, e.g. at least one of a transcriptional promoter or transcriptional enhancer sequence, operably linked to the *C. albicans* gene sequence, e.g., to render the *C. albicans* gene sequence suitable for expression in a recombinant host cell.

In yet a further preferred embodiment, the nucleic acid which encodes an *C. albicans* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; more preferably to at least about 20 consecutive nucleotides of the invention contained in the Sequence Listing; more preferably to at least about 40 consecutive nucleotides of the invention contained in the Sequence Listing.

In another aspect, the invention provides a substantially pure nucleic acid having a nucleotide sequence which encodes an *C. albicans* polypeptide. In preferred embodiments: the encoded polypeptide has biological activity; the encoded polypeptide has an amino acid sequence at least about 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, more preferably at least about 50, 100, or 150 contiguous amino acids of the invention contained in the Sequence Listing.

In another aspect, the invention encompasses: a vector including a nucleic acid which encodes an *C. albicans* polypeptide or an *C. albicans* polypeptide variant as described herein; a host cell transfected with the vector; and a method of producing a recombinant *C. albicans* polypeptide or *C. albicans* polypeptide variant; including culturing the cell, e.g., in a cell culture medium, and isolating an *C. albicans* or *C. albicans* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 14103 or complements thereof. Alternatively, the nucleic acids comprise sequences contained within any ORF (open reading frame), including a complete protein-coding sequence, of which any of SEQ ID NO: 1–SEQ ID NO: 14103 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least about 50%, 60%, 70%, 80%, 90%, 95%, 98%, or 99% homology with a sequence of the invention contained in the Sequence Listing.

The invention also encompasses recombinant DNA (including DNA cloning and expression vectors) comprising these *C. albicans*-derived sequences; host cells comprising such DNA, including fungal, bacterial, yeast, plant, insect, and mammalian host cells; and methods for producing expression products comprising RNA and polypeptides encoded by the *C. albicans* sequences. These methods are carried out by incubating a host cell comprising a *C. albicans*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *C. albicans* polypeptide from the cell fraction, the medium fraction, or both. The polypeptides can also be made by in vitro translation.

In another aspect, the invention features nucleic acids capable of binding mRNA of *C. albicans*. Such nucleic acid is capable of acting as antisense nucleic acid to control the translation of mRNA of *C. albicans*. A further aspect features a nucleic acid which is capable of binding specifically to a *C. albicans* nucleic acid. These nucleic acids are also referred to herein as complements and have utility as probes and as capture reagents.

In another aspect, the invention features an expression system comprising an open reading frame corresponding to *C. albicans* nucleic acid. The nucleic acid further comprises a control sequence compatible with an intended host. The expression system is useful for making polypeptides corresponding to *C. albicans* nucleic acid.

In another aspect, the invention encompasses: a vector including a nucleic acid which encodes a *C. albicans* polypeptide or a *C. albicans* polypeptide variant as described herein; a host cell transfected with the vector; and a method of producing a recombinant *C. albicans* polypeptide or *C. albicans* polypeptide variant; including culturing the cell, e.g., in a cell culture medium, and isolating the *C. albicans* or *C. albicans* polypeptide variant, e.g., from the cell or from the cell culture medium.

In yet another embodiment of the invention encompasses reagents for detecting fungal infection, including *C. albicans* infection, which comprise at least one *C. albicans*-derived nucleic acid defined by any one of SEQ ID NO: 1–SEQ ID NO: 14103, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1–SEQ ID NO: 14103, or polypeptide sequences contained within any of SEQ ID NO: 14104–SEQ ID NO: 28206, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one C. albicans-derived immunogenic component, wherein the immunogenic component comprises one or more of the polypeptides encoded by any one of SEQ ID NO: 1–SEQ ID NO: 14103 or sequence-conservative or function-conservative variants thereof; or polypeptides that are contained within any ORFs, including complete protein-coding sequences, of which any of SEQ ID NO: 1–SEQ ID NO: 14103 forms a part; or polypeptide sequences contained within any of SEQ ID NO: 14104–SEQ ID NO: 28206; or polypeptides of which any of SEQ ID NO: 14104–SEQ ID NO: 28206 forms a part. Host animals include any warm blooded animal, including without limitation mammals and birds. Such antibodies have utility as reagents for immunoassays to evaluate the abundance and distribution of C. albicans-specific antigens.

In yet another aspect, the invention provides diagnostic methods for detecting C. albicans antigenic components or anti-C. albicans antibodies in a sample. C. albicans antigenic components are detected by a process comprising: (i) contacting a sample suspected to contain a fungal antigenic component with a fungal-specific antibody, under conditions in which a stable antigen-antibody complex can form between the antibody and fungal antigenic components in the sample; and (ii) detecting any antigen-antibody complex formed in step (i), wherein detection of an antigen-antibody complex indicates the presence of at least one fungal antigenic component in the sample. In different embodiments of this method, the antibodies used are directed against a sequence encoded by any of SEQ ID NO: 1–SEQ ID NO: 14103 or sequence-conservative or function-conservative variants thereof, or against a polypeptide sequence contained in any of SEQ ID NO: 14104–SEQ ID NO: 28206 or function-conservative variants thereof.

In yet another aspect, the invention provides a method for detecting antifungal-specific antibodies in a sample, which comprises: (i) contacting a sample suspected to contain antifungal-specific antibodies with a C. albicans antigenic component, under conditions in which a stable antigen-antibody complex can form between the C. albicans antigenic component and antifungal antibodies in the sample; and (ii) detecting any antigen-antibody complex formed in step (i), wherein detection of an antigen-antibody complex indicates the presence of antifungal antibodies in the sample. In different embodiments of this method, the antigenic component is encoded by a sequence contained in any of SEQ ID NO: 1–SEQ ID NO: 14103 or sequence-conservative and function-conservative variants thereof, or is a polypeptide sequence contained in any of SEQ ID NO: 14104–SEQ ID NO: 28206 or function-conservative variants thereof.

In another aspect, the invention features a method of generating vaccines for immunizing an individual against C. albicans. The method includes: immunizing a subject with a C. albicans polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind a C. albicans polypeptide. The method includes: contacting the candidate compound with a C. albicans polypeptide and determining if the compound binds or otherwise interacts with an C. albicans polypeptide. Compounds which bind C. albicans are candidates as activators or inhibitors of the fungal life cycle. These assays can be performed in vitro or in vivo.

In another aspect, the invention features a method of evaluating a compound, e.g. a polypeptide, e.g., a fragment of a host cell polypeptide, for the ability to bind an C. albicans nucleic acid, e.g., DNA or RNA. The method includes: contacting the candidate compound with a C. albicans nucleic acid and determining if the compound binds or otherwise interacts with a C. albicans polypeptide. Compounds which bind C. albicans are candidates as activators or inhibitors of the fungal life cycle. These assays can be performed in vitro or in vivo.

A particularly preferred embodiment of the invention is directed to a method of screening test compounds for anti-fungal activity, which method comprises: selecting as a target a fungal specific sequence, which sequence is essential to the viability of a fungal species; contacting a test compound with said target sequence; and selecting those test compounds which bind to said target sequence as potential anti-fungal candidates. In one embodiment, the target sequence selected is specific to a single species, or even a single strain, i.e., the C. albicans strain SC5314. In a second embodiment, the target sequence is common to at least two species of fungi. In a third embodiment, the target sequence is common to a family of fungi. The target sequence may be a nucleic acid sequence or a polypeptide sequence. Methods employing sequences common to more than one species of microorganism may be used to screen candidates for broad spectrum anti-fungal activity.

The invention also provides methods for preventing or treating disease caused by certain fungi, including C. albicans, which are carried out by administering to an animal in need of such treatment, in particular a warm-blooded vertebrate, including but not limited to birds and mammals, a compound that specifically inhibits or interferes with the function of a fungal polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 28206. Use of the terms "SEQ ID NO: 1–SEQ ID NO: 14103", "SEQ ID NO: 14104–SEQ ID NO: 28206 "the sequences depicted in Table 2", and like terms, is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "C. albicans-derived" nucleic acid or polypeptide sequence may or may not be present in other fungal species, and may or may not be present in all C. albicans strains. This term is intended to refer to the source from which the sequence was originally isolated. Thus, a C. albicans-derived polypeptide, as used herein, may be used, e.g., as a target to screen for a broad spectrum antifungal agent, to search for homologous proteins in other species of fungi or in eukaryotic organisms such as humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing, which is preferably at least about 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least about 10% and more preferably at least about 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional C. albicans DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions comparedx 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.), require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *C. albicans* biological activity if it has one, two and preferably more of the following properties: (1) if when expressed in the course of a *C. albicans* infection, it can promote, or mediate the attachment of *C. albicans* to a cell; (2) it has an enzymatic activity, structural or regulatory function characteristic of a *C. albicans* protein; (3) or the gene which encodes it can rescue a lethal mutation in a *C. albicans* gene. A polypeptide has biological activity if it is an antagonist, agonist, or super-agonist of a polypeptide having one of the above-listed properties.

A biologically active fragment or analog is one having an in vivo or in vitro activity which is characteristic of the *C. albicans* polypeptides of the invention contained in the Sequence Listing, or of other naturally occurring *C. albicans* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *C. albicans* polypeptides often exhibit a range of physiological properties and because such properties may be attributable to different portions of the molecule, a useful *C. albicans* fragment or *C. albicans* analog is one which exhibits a biological activity in any biological assay for *C. albicans* activity. Most preferably the fragment or analog possesses 10%, preferably 40%, more preferably 60%, 70%, 80% or 90% or greater or the activity of *C. albicans*, in any in vivo or in vitro assay.

Analogs can differ from naturally occurring *C. albicans* polypeptides in amino acid sequence or in ways that do not involve sequence, or both. Non-sequence modifications include changes in acetylation, methylation, phosphorylation, carboxylation, or glycosylation. Preferred analogs include *C. albicans* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *C. albicans* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ilc, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, |
| Methionine | M | D-Met, S-Me-Cys, Ilc, D-Ile, Leu, D-Leu, Val, D- |
| Phenylalanine | F | D-Phe, Tyr, D-Thr, L-Dopa, His, D-His, Trp, D- |
| Proline | P | D-Pro, L-I-thioazolidine-4-carboxylic acid, D-or L- |
| Serine | S | D-Ser, Thr, D-Thr, allo-Thr, Met, D-Met, Met(O), |
| Threonine | T | D-Thr, Ser, D-Ser, allo-Thr, Met, D-Met, Met(O), |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to a *C. albicans* analog, will ordinarily be at least about 20 residues, more typically at least about 40 residues, preferably at least about 60 residues in length. Fragments of *C. albicans* polypeptides can be generated by methods known to those skilled in the art. The ability of a candidate fragment to exhibit a biological activity of *C. albicans* polypeptide can be assessed by methods known to those skilled in the art as described herein. Also included are *C. albicans* polypeptides containing residues that are not required for biological activity of the peptide or that result from alternative mRNA splicing or alternative protein processing events.

An "immunogenic component" as used herein is a moiety, such as a *C. albicans* polypeptide, analog or fragment thereof, that is capable of eliciting a humoral and/or cellular immune response in a host animal.

An "antigenic component" as used herein is a moiety, such as a *C. albicans* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *C. albicans* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably inked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N. Glover ed. 1985); *Oligonticleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR—A Practical Approach* (McPherson, Quirke, and Taylor, eds., 1991); *Immunology,* 2d Edition, 1989, Roitt et al., C. V. Mosby Company, and New York; *Advanced Immunology,* 2d Edition, 1991, Male et al., Grower Medical Publishing, New York.; *DNA Cloning: A Practical Approach*, Volumes I and II, 1985 (D. N. Glover ed.); *Oligonucleotide Synthesis,* 1984, (M. L. Gait ed); *Transcription and Translation,* 1984 (Hames and Higgins eds.); *Animal Cell Culture,* 1986 (R. I. Freshney ed.); *Immobilized Cells and Enzymes,* 1986 (IRL Press); Perbal, 1984, *A Practical Guide to Molecular Cloning; Gene Transfer Vectors for Mammalian Cells,* 1987 (J. H. Miller and M. P. Calos eds., Cold Spring Harbor Laboratory); Martin J. Bishop, ed., *Guide to Human Genome Computing,* 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

C. albicans Genomic Sequence

This invention provides nucleotide sequences of the genome of *C. albicans*, strain SC5314, which thus comprises a DNA sequence library of *C. albicans* genomic DNA. The detailed description that follows provides nucleotide sequences of *C. albicans*, and also describes how the sequences were obtained and how ORFs and protein-coding sequences can be identified. Also described are methods of using the disclosed *C. albicans* sequences in methods including diagnostic and therapeutic applications. Furthermore, the library can be used as a database for identification and comparison of medically important sequences in this and other strains of *C. albicans*.

To determine the genomic sequence of *C. albicans*, DNA from strain SC5314 of *C. albicans* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *C. albicans*, In *Microbial Genome Methods*, K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library.

DNA sequencing was achieved using established ABI sequencing methods on AB1377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p.157). The average contig length was about 3–4 kb.

All subsequent steps were based on sequencing by ABI377 automated DNA sequencing methods. The cloning and sequencing procedures are described in more detail in the Exemplification.

A variety of approaches is used to order the contigs so as to obtain a continuous sequence representing the entire C. albicans genome. Synthetic oligonucleotides are designed that are complementary to sequences at the end of each contig. These oligonucleotides may be hybridized to libaries of C. albicans genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The C. albicans sequences were analyzed for the presence of open reading frames (ORFs) comprising at least about 180 nucleotides. As a result of the analysis of ORFs based on stop-to-stop codon reads, it should be understood that these ORFs may not correspond to the ORF of a naturally-occurring C. albicans polypeptide. These ORFs may contain start codons which indicate the initiation of protein synthesis of a naturally-occurring C. albicans polypeptide. Such start codons within the ORFs provided herein can be identified by those of ordinary skill in the relevant art, and the resulting ORF and the encoded C. albicans polypeptide is within the scope of this invention. For example, within the ORFs a codon such as AUG or GUG (encoding methionine or valine) which is part of the initiation signal for protein synthesis can be identified and the portion of an ORF to corresponding to a naturally-occurring C. albicans polypeptide can be recognized. The predicted coding regions were defined by evaluating the coding potential of such sequences with the program GENEMARK™ (Borodovsky and McIninch, 1993, Comp. . 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than 10–5 by chance) but have good codon usage were identified. Both homologous, sequences and non-homologous sequences with good codon usage, are likely to encode proteins and are encompassed by the invention.

It is to be understood that non-protein-coding sequences contained within SEQ ID NO: 1–SEQ ID NO: 14103 are also within the scope of the invention. Such sequences include, without limitation, sequences important for replication, recombination, transcription and translation. Non-limiting examples include promoters and regulatory binding sites involved in regulation of gene expression, and 5'- and 3'-untranslated sequences (e.g., ribosome-binding sites) that form part of mRNA molecules.

Preferred sequences are those that are useful in diagnostic and/or therapeutic applications. Diagnostic applications include without limitation nucleic-acid-based and antibody-based methods for detecting C. albicans infection. Therapeutic applications include without limitation vaccines, passive immunotherapy, and drug treatments directed against gene products that are essential for growth and/or replication. In a particularly preferred aspect of the invention, the nucleic acids encode protein-coding sequences which share homology to other fungal sequences, lack homology to all eukaryotic sequences, and which are essential to the viability of fungi. Such sequences comprise a library of valuable target sequences for drug discovery, in particular, targets which may be used to identify broad spectrum antifungal agents.

C. albicans Nucleic Acids

The present invention provides a library of C. albicans-derived nucleic acid sequences. The libraries provide probes, primers, and markers which can be used as markers in epidemiological studies. The present invention also provides a library of C. albicans-derived nucleic acid sequences which comprise or encode targets for therapeutic drugs.

The nucleic acids of this invention are obtained directly from the DNA of the above referenced C. albicans strain by using the polymerase chain reaction (PCR). See "PCR, A Practical Approach" (McPherson, Quirke, and Taylor, eds., IRL Press, Oxford, UK, 1991) for details about the PCR. High fidelity PCR can be used to ensure a faithful DNA copy prior to expression. In addition, the authenticity of amplified products can be verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, NY).

It is also possible to obtain nucleic acids encoding C. albicans polypeptides from a cDNA library in accordance with protocols herein described. A cDNA encoding a C. albicans polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding C. albicans polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *C. albicans*. With the sequence information set forth in the present application, sequences of about twenty or more nucleotides are identified which provide the desired inclusivity and exclusivity with respect to *C. albicans* and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than about 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Candida species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *C. albicans* nucleic acid from one strain from the nucleic acid of other another strain as well as from other organisms. Nucleic acid having twenty or more nucleotides in a sequence of the invention contained in the Sequence Listing can also have utility to separate other Candida species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *C. albicans* nucleic acid. These nucleic acids may also have utility as primers for the amplification of nucleic acids in other Candida species. With respect to polymerase chain reaction (PCR) techniques, nucleic acid sequences of ≧about 10–15 nucleotides of the invention contained in the Sequence Listing have utility in conjunction with suitable enzymes and reagents to create copies of *C. albicans* nucleic acid. More preferably, the sequence will comprise at least about twenty or more nucleotides to convey stability to the hybridization product formed between the primer and the intended target molecules. Binding conditions of primers greater than about 100 nucleotides are often more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *C. albicans* and/or other Candida species. The copies can also be incorporated into cloning and expression vectors to generate polypeptides corresponding to the nucleic acid synthesized by PCR, as is described in greater detail herein.

The nucleic acids of the present invention find use as templates for the recombinant production of *C. albicans*-derived peptides or polypeptides.

Antisense

Nucleic acid or nucleic acid-hybridizing derivatives isolated or synthesized in accordance with the sequences described herein have utility as antisense agents to prevent the expression of *C. albicans* genes. These sequences also have utility as antisense agents to prevent expression of genes of other Candida species.

In one embodiment, nucleic acid or derivatives corresponding to *C. albicans* nucleic acids is loaded into a suitable carrier such as a liposome or bacteriophage for introduction into fungal cells. For example, a nucleic acid having about twenty or more nucleotides is capable of binding to bacteria nucleic acid or bacteria messenger RNA. Preferably, the antisense nucleic acid is comprised of at least about 20 or more nucleotides to provide necessary stability of a hybridization product of non-naturally occurring nucleic acid and fungal nucleic acid and/or fungal messenger RNA. Nucleic acid having a sequence greater than about 1000 nucleotides in length is difficult to synthesize but can be generated by recombinant DNA techniques. Methods for loading antisense nucleic acid in liposomes are known in the art as exemplified, for example, in U.S. Pat. No. 4,241,046 issued Dec. 23, 1980 to Papahadjopoulos et al.

The present invention encompasses isolated polypeptides and nucleic acids derived from *C. albicans* that are useful as reagents for diagnosis of fungal infection, components of effective anti-fungal vaccines, and/or as targets for anti-fungal drugs, including anti-*C. albicans* drugs.

Expression of *C. albicans* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the contig from which each ORF was identified (numbered arbitrarily). Each contig represents a continuous stretch of the genomic sequence of the organism. The second column lists the ORF designation. The third and fourth columns list the SEQ ID numbers for the nucleic acid and amino acid sequences corresponding to each ORF, respectively. The fifth and sixth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons," ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The seventh column provides, where available, either a public database accession number or our own sequence name. The eighth and ninth columns provide metrics for assessing the likelihood of the homology match (determined by the BLASTP2 algorithm), as is known in the art, to the genes indicated in the eleventh column when the designated ORF was compared against a non-redundant comprehensive protein database. Specifically, the eighth column represents the "Blast Score" for the match (a higher score is a better match), and the ninth column represents the "P-value" for the match (the probability that such a match can have occurred by chance; the lower the value, the more likely the match is valid). If a BLASTP2 score of less than 46 was obtained, no value is reported in the table the "P-value." Column ten provides the name of the organism that was identified as having the closest homology match. The eleventh column provides, where available, the Swissprot accession number (SP),(SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. Information that is not preceded by a code designation in the eleventh column represents a description of the ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 14103, SEQ ID NO: 14104–SEQ ID NO: 28206 and in Table 2 together with routine cloning and sequencing methods, one of ordinary skill in the art will be able to clone and sequence all the nucleic acid fragments of interest including open reading frames (ORFs) encoding a large variety proteins of *C. albicans*.

Nucleic acid isolated or synthesized in accordance with the sequences described herein have utility to generate polypeptides. The nucleic acid of the invention exemplified in SEQ ID NO: 1–SEQ ID NO: 14103 and in Table 2 or fragments of said nucleic acid encoding active portions of *C. albicans* polypeptides can be cloned into suitable vectors or used to isolate nucleic acid. The isolated nucleic acid is combined with suitable DNA linkers and cloned into a suitable vector.

The function of a specific gene or operon can be ascertained by expression in a fungal strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae* or *Candida putida*, Methanobacterium strains or other Archaea, and Eubacteria such as *E. coli, B. Subtilis, S. Aureus, S. Pneumonia* or *Pseudomonas putida*. In some cases the expression host will utilize the natural *C. albicans* promoter whereas in others, it will be necessary to drive the gene with a promoter sequence derived from the expressing organism (e.g., an *E. coli* beta-galactosidase promoter for expression in *E. coli*).

To express a gene product using the natural *C. albicans* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory press (1989)), and other laboratory textbooks.

For example, a host cell transfected with a nucleic acid vector directing expression of a nucleotide sequence encoding a *C. albicans* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *C. albicans* peptide expression in *E. coli* is to express the protein in a host bacteria with an impaired capacity to proteolytically cleave the recombinant protein (Gottesman, S., *Gene Expression Technology: Methods in Enzymoloqy* 185, Academic Press, San Diego, Calif. (1990) 119–128). Another strategy would be to alter the nucleic acid encoding a *C. albicans* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein). The present invention provides a library of *C. albicans*-derived nucleic acid sequences. The libraries provide probes, primers, and markers which can be used as markers in epidemiological studies. The present invention also provides a library of *C. albicans*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 14103. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 14104–SEQ ID NO: 28206 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *C. albicans* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *C. albicans*-derived sequences or derivatives or fragments thereof. A large number of vectors, including plasmid and fungal vectors, have been described for replication and/or expression in a variety of eukaryotic and prokaryotic hosts, and may be used for cloning or protein expression.

The encoded *C. albicans* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *C. albicans* coding sequences may be synthesized by standard methods, isolated from natural sources, or prepared as hybrids, etc. Ligation of the *C. albicans* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, fungal infection, microinjection, microprojectile, or other established methods.

Appropriate host cells include bacteria, archebacteria, fungi, especially yeast, and plant and animal cells, especially mammalian cells. Of particular interest are *C. albicans, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *C. albicans*-derived peptides and polypeptides.

Advantageously, vectors may also include a transcription regulatory element (i.e., a promoter) operably linked to the *C. albicans* portion. The promoter may optionally contain operator portions and/or ribosome binding sites. Non-limiting examples of fungal promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included These sequences are well described in the art.

Nucleic acids encoding wild-type or variant *C. albicans*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *C. albicans*-derived peptides or polypeptides.

Identification and Use of *C. albicans* Nucleic Acid Sequences

The disclosed *C. albicans* polypeptide and nucleic acid sequences, or other sequences that are contained within ORFs, including complete protein-coding sequences, of which any of the disclosed *C. albicans*-specific sequences forms a part, are useful as target components for diagnosis and/or treatment of *C. albicans*-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *C. albicans* DNA as template; this is followed by sequencing the amplified product. The isolated nucleic acid encoding the disclosed sequence, or fragments thereof, can also be hybridized to *C. albicans* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting fungal infection. Therapeutic applications include without limitation vaccines, passive immunotherapy, and drug treatments directed against gene products that are both unique to fungi and essential for growth and/or replication of fungi.

Identification of Nucleic Acids Encoding Vaccine Components and Targets for Agents Effective Against *C. albicans*

The disclosed *C. albicans* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *C. albicans*. Identification of said immunogenic components involved in the determination of the function of the disclosed sequences, which can be achieved using a variety of approaches. Non-limiting examples of these approaches are described briefly below.

Homology to Known Sequences

Computer-assisted comparison of the disclosed *C. albicans* sequences with previously reported sequences present in publicly available databases is useful for identifying functional *C. albicans* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in a *C. albicans* sequence is therefore useful in determining the function of the encoded protein and identifying useful targets of antifungal drugs.

Of particular relevance to the present invention are structural features that are common to secretory, transmembrane, and surface proteins, including secretion signal peptides and hydrophobic transmembrane domains. *C. albicans* proteins identified as containing putative signal sequences and/or transmembrane domains are useful as immunogenic components of vaccines.

Targets for therapeutic drugs according to the invention include, but are not limited to, polypeptides of the invention, whether unique to *C. albicans* or not, that are essential for growth and/or viability of *C. albicans* under at least one growth condition. Polypeptides essential for growth and/or viability can be determined by examining the effect of deleting and/or disrupting the genes, i e, by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences

Because of the evolutionary relationship between different *C. albicans* strains, it is believed that the presently disclosed *C. albicans* sequences are useful for identifying, and/or discriminating between, previously known and new *C. albicans* strains. It is believed that other *C. albicans* strains will exhibit at least about 70% sequence homology with the presently disclosed sequence. Systematic and routine analyses of DNA sequences derived from samples containing *C. albicans* strains, and comparison with the present sequence allows for the identification of sequences that can be used to discriminate between strains, as well as those that are common to all *C. albicans* strains. In one embodiment, the invention provides nucleic acids, including probes, and peptide and polypeptide sequences that discriminate between different strains of *C. albicans*. Strain-specific components can also be identified functionally by their ability to elicit or react with antibodies that selectively recognize one or more *C. albicans* strains.

In another embodiment, the invention provides nucleic acids, including probes, and peptide and polypeptide sequences that are common to all *C. albicans* strains but are not found in other fungal species.

*C. albicans* Polypeptides

This invention encompasses isolated *C. albicans* polypeptides encoded by the disclosed *C. albicans* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding a *C. albicans* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *C. albicans* DNA as template; this is followed by sequencing the amplified product.

The polypeptides of the present invention, including function-conservative variants of the disclosed ORFs, may be isolated from wild-type or mutant *C. albicans* cells, or from heterologous organisms or cells (including, but not limited to, bacteria, fungi, insect, plant, and mammalian cells) including *C. albicans* into which a *C. albicans*-derived protein-coding sequence has been introduced and expressed. Furthermore, the polypeptides may be part of recombinant fusion proteins.

*C. albicans* polypeptides of the invention can be chemically synthesized using commercially automated procedures such as those referenced herein , including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *C. albicans* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a *C. albicans* protein or against peptides derived therefrom can be used as purification reagents. Other purification methods are possible.

The present invention also encompasses derivatives and homologues of *C. albicans*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *C. albicans*-derived polypeptides for use in the present invention, essentially the complete genomic sequence of a *C. albicans* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *C. albicans* polypeptide sequences that are contained within the open reading frames (ORFs), including complete protein-coding sequences, of which any of SEQ ID NO: 1–SEQ ID NO: 14103 forms a part. Table 2, which is appended herewith and which forms part of the present specification, provides a putative identification of the particular function of a polypeptide which is encoded by each ORF based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *C. albicans*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *C. albicans*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *C. albicans* infection, including use as markers in epidemiological studies. Non-limiting examples of such sequences are listed by SEQ ID NO in Table 2, which is appended.

The present invention also provides a library of *C. albicans*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of Candidate Protein Antigens for Antibody and Vaccine Development The selection of candidate protein antigens for vaccine development can be derived from the nucleic acids encoding *C. albicans* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1\times10^{-6}$ that the homology is only due to random chance) to membrane or exported proteins represent protein antigens for vaccine development. Possible functions can be provided to *C. albicans* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *C. albicans* Nucleic Acids and Polypeptides Based on the discovery of the *C. albicans* gene products of the invention provided in the Sequence Listing, one skilled in the art can alter the disclosed structure of *C. albicans* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *C. albicans* polypeptides. Such screens are useful for the identification of inhibitors of *C. albicans*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl Acad. Sci.* USA, 75: 5765[1978]).

Cassette Mutagenesis

Another method for preparing variants, cassette mutagenesis, is based on the technique described by Wells et al. (*Gene,* 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *C. albicans* Nucleic Acids and Polypeptides

It is possible to modify the structure of a *C. albicans* polypeptide for such purposes as increasing solubility, enhancing stability (e.g., shelf life ex vivo and resistance to proteolytic degradation in vivo). A modified *C. albicans* protein or peptide can be produced in which the amino acid sequence has been altered, such as by amino acid substitution, deletion, or addition as described herein.

An *C. albicans* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, a *C. albicans* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, a *C. albicans* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *C. albicans* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of a *C. albicans* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within a *C. albicans* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *C. albicans* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *C. albicans* polypeptide, e.g., of cellular proteins, or of randomly generated polypeptides which bind to a *C. albicans* protein. (The *C. albicans* domain is used as the bait protein and the library of variants are expressed as prey fusion proteins.) In an analogous fashion, a two hybrid assay (as with the other screening methods described herein), can be used to find polypeptides which bind a *C. albicans* polypeptide.

Display Libraries

In one approach to screening assays, the candidate peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a fungal cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and fl, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) Bio/Tech. 6, 1080–1083). Surface proteins of other bacterial species have also served as peptide fusion partners. Examples include the Staphylococcus protein A and the outer membrane IgA protease of Neisseria (Hansson et al. (1992) J. Bacteriol. 174, 4239–4245 and Klauser et al. (1990) EMBO J. 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) PNAS USA 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stablely associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) Proc. Natl. Acad. Sci. U.S.A. 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) Proc. Natl. Acad. Sci. U.S.A. 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) J. Med. Chem. 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) J. Med. Chem. 37(9):1233–1251), a molecular DNA library encoding $10^{12}$ decapeptides was constructed and the library expressed in an E. coli S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) Anal. Biochem 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *C. albicans* Polypeptides

The invention also provides for reduction of the protein binding domains of the subject *C. albicans* polypeptides to generate mimetics, e.g. peptide or non-peptide agents. The peptide mimetics are able to disrupt binding of a polypeptide to its counter ligand, e.g., in the case of a *C. albicans* polypeptide binding to a naturally occurring ligand. The critical residues of a subject *C. albicans* polypeptide which are involved in molecular recognition of a polypeptide can be determined and used to generate *C. albicans*-derived peptidomimetics which competitively or noncompetitively inhibit binding of the *C. albicans* polypeptide with an interacting polypeptide (see, for example, European patent applications EP-412,762A and EP-B31,080A).

For example, scanning mutagenesis can be used to map the amino acid residues of a particular *C. albicans* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of a *C. albicans* polypeptide to an interacting polypeptide and thereby interfere with the function of *C. albicans* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *C. albicans* Nucleic Acids and Polypeptides

This invention also features vaccine compositions for protection against infection by *C. albicans* or for treatment of *C. albicans* infection. In one embodiment, the vaccine compositions contain one or more immunogenic components such as a surface protein from *C. albicans*, or portion thereof, and a pharmaceutically acceptable carrier. Nucleic acids within the scope of the invention are exemplified by the nucleic acids of the invention contained in the Sequence Listing which encode *C. albicans* surface proteins. Any nucleic acid encoding an immunogenic *C. albicans* protein, or portion thereof, which is capable of expression in a cell, can be used in the present invention. These vaccines have therapeutic and prophylactic utilities.

One aspect of the invention provides a vaccine composition for protection against infection by *C. albicans* which contains at least one immunogenic fragment of a *C. albicans* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *C. albicans* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *C. albicans* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *C. albicans* polypeptide or fragment thereof or nucleic acid encoding a *C. albicans* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *C. albicans* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *C. albicans*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *C. albicans* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*C. albicans* fungal lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *C. albicans* polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of *C. albicans* in an infected host, or as a therapeutic agent in the aim to induce an immune response in a susceptible host to prevent infection by *C. albicans*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of a *C. albicans* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *C. albicans* infection, some are useful only for treating *C. albicans* infection, and some are useful for both preventing and treating *C. albicans* infection. In a preferred embodiment, the vaccine composition of the invention provides protection against *C. albicans* infection by stimulating humoral and/or cell-mediated immunity against *C. albicans*. It should be understood that amelioration of any of the symptoms of *C. albicans* infection is a desirable clinical goal, including a lessening of the dosage of medication used to treat *C. albicans*-caused disease, or an increase in the production of antibodies in the serum or mucous of patients.

Antibodies Reactive with *C. albicans* Polypeptides

The invention also includes antibodies specifically reactive with the subject *C. albicans* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *C. albicans* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *C. albicans* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*C. albicans* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between fungal and mammalian antigens.

The term antibody as used herein is intended to include fragments thereof which are also specifically reactive with *C. albicans* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*C. albicans* portion.

Both monoclonal and polyclonal antibodies (Ab) directed against *C. albicans* polypeptides or *C. albicans* polypeptide variants, and antibody fragments such as Fab' and F(ab')$_2$, can be used to block the action of *C. albicans* polypeptide and allow the study of the role of a particular *C. albicans* polypeptide of the invention in aberrant or unwanted intracellular signaling, as well as the normal cellular function of the *C. albicans* and by microinjection of anti-*C. albicans* polypeptide antibodies of the present invention.

Antibodies which specifically bind *C. albicans* epitopes can also be used in immunohistochemical staining of tissue samples in order to evaluate the abundance and pattern of expression of *C. albicans* antigens. Anti-*C. albicans* polypeptide antibodies can be used diagnostically in immuno-precipitation and immuno-blotting to detect and evaluate *C. albicans* levels in tissue or bodily fluid as part of a clinical testing procedure. Likewise, the ability to monitor *C. albicans* polypeptide levels in an individual can allow determination of the efficacy of a given treatment regimen for an individual afflicted with such a disorder. The level of a *C. albicans* polypeptide can be measured in cells found in bodily fluid, such as in urine samples or can be measured in tissue, such as produced by gastric biopsy. Diagnostic assays using anti-*C. albicans* antibodies can include, for example, immunoassays designed to aid in early diagnosis of *C. albicans* infections. The present invention can also be used as a method of detecting antibodies contained in samples from individuals infected by this bacterium using specific *C. albicans* antigens.

Another application of anti-*C. albicans* polypeptide antibodies of the invention is in the immunological screening of cDNA libraries constructed in expression vectors such as λgt11, λgt18-23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *C. albicans* polypeptide can then be detected with antibodies, as, for example, reacting nitrocellulose filters lifted from infected plates with anti-*C. albicans* polypeptide antibodies. Phage, scored by this assay, can then be isolated from the infected plate. Thus, the presence of *C. albicans* gene homologs can be detected and cloned from other species, and alternate isoforms (including splicing variants) can be detected and cloned.

Bio Chip Technology

The nucleic acid sequences or fragments thereof of the present invention lend themselves to the detection of nucleic acid sequences or fragments thereof of *C. albicans* or other species of Candida using nanotechnology apparatus, compositions and methods, referred to generically herein as "bio chip" technology. Bio chips containing arrays of nucleic acid sequence can also be used to measure expression of genes of *C. albicans* or other species of Candida. For example, to diagnose a patient with a *C. albicans* or other Candida infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chip technology can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequences which can be used with bio chip technology to understand regulatory networks in bacteria, measure the response to environmental signals or drugs as in drug screening, and study virulence induction. (Mons et al., 1998, *Nature Biotechnology*, 16: 45–48). Patents teaching this technology include U.S. Pat. Nos. 5,445,934, 5,744,305, and 5,800,992.

Kits Containing Nucleic Acids, Polypeptides or Antibodies of the Invention

The nucleic acid, polypeptides and antibodies of the invention can be conveniently combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Drug Screening Assays Using *C. albicans* Polypeptides

By making available purified and recombinant *C. albicans* polypeptides, the present invention provides assays which can be used to screen for drugs which are either agonists or antagonists of the normal cellular function, in this case, of the subject *C. albicans* polypeptides, or of their role in intracellular signaling. Such inhibitors or potentiators may be useful as new therapeutic agents to combat *C. albicans* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *C. albicans* polypeptide.

Screening assays can be constructed in vitro with a purified *C. albicans* polypeptide or fragment thereof, such as a *C. albicans* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *C. albicans* polypeptide. Some of these active compounds may directly, or with chemical alterations to promote membrane permeability or solubility, also inhibit or potentiate the same activity (e.g., enzymatic activity) in whole, live *C. albicans* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two fungal strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a fungal strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.*

4:2061–2068; Eilers and Schatz, Nature, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, Nature 340:245–246). The yeast two-hybrid system takes advantage of the properties of the GAL4 protein of the yeast Saccharomyces cerevisiae. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, Science 251:767–773, which involves testing the binding affinity of test compounds for a plurality of defined polymers synthesized on a solid substrate, may also be useful.

Compounds which bind to the polypeptides of the invention are potentially useful as antifungal agents for use in therapeutic compositions.

Pharmaceutical formulations suitable for antifungal therapy comprise the antifungal agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antifungal compositions include an antifungal effective amount of active agent. Antifungal effective amounts are those quantities of the antifungal agents of the present invention that afford prophylactic protection against fungal infections or which result in amelioration or cure of an existing fungal infection. This antifungal effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antifungal active agents or compositions can be formed into dosage unit forms, such as for example, creams, ointments, lotions, powders, liquids, tablets, capsules, suppositories, sprays, aerosols or the like. If the antifungal composition is formulated into a dosage unit form, the dosage unit form may contain an antifungal effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant (s), lubricant(s), plasticizer(s), colorant(s), dosage vehicle (s), absorption enhancer(s), stabilizer(s), bactericide(s), or the like.

For general information concerning formulations, see, e.g., Gilman et al. (eds.), 1990, Goodman and Gilman's: The Pharmacological Basis of Therapeutics, 8th ed., Pergamon Press; and Remington's Pharmaceutical Sciences, 17th ed., 1990, Mack Publishing Co., Easton, Pa.; Avis et al. (eds.), 1993, Pharmaceutical Dosage Forms: Parenteral Medications, Dekker, New York; Lieberman et al (eds.), 1990, Pharmaceutical Dosage Forms: Disperse Systems, Dekker, New York.

The antifungal agents and compositions of the present invention are useful for preventing or treating C. albicans infections. Infection prevention methods incorporate a prophylactically effective amount of an antifungal agent or composition. A prophylactically effective amount is an amount effective to prevent C. albicans infection and will depend upon the specific fungal strain, the agent, and the host. These amounts can be determined experimentally by methods known in the art and as described above.

C. albicans infection treatment methods incorporate a therapeutically effective amount of an antifungal agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial fungal infection has been resolved.

The antifungal agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing C. albicans Genomic Sequence

This invention provides nucleotide sequences of the genome of C. albicans which thus comprises a DNA sequence library of C. albicans genomic DNA. The detailed description that follows provides nucleotide sequences of C. albicans, and also describes how the sequences were obtained and how ORFs (Open Reading Frames) and protein-coding sequences can be identified. Also described are methods of using the disclosed C. albicans sequences in methods including diagnostic and therapeutic applications. Furthermore, the library can be used as a database for identification and comparison of medically important sequences in this and other strains of C. albicans as well as other species of Candida.

Chromosomal DNA from strain SC5314 of C. albicans was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in C. albicans. In Microbial Genome Methods. K. W. Adolph, editor. CRC Press. New York. p 17–37.). Genomic C. albicans DNA was hydrodynamically sheared in an HPLC and then separated on a standard 1% agarose gel. Fractions corresponding to 2500–3000 bp in length were excised from the gel and purifed by the GeneClean procedure (Bio101, Inc.).

The purified DNA fragments were then blunt-ended using T4 DNA polymerase. The healed DNA was then ligated to unique BstXI-linker adapters 5'-GTCTTCACCACGGGG-3' (SEQ ID NO:28,207) and 5'-GTGGTGAAGAC-3' (SEQ ID NO:28,208) in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adpated inserts were then ligated to BstXI-cut vector to construct a "shotgun" sub-lclone libraries.

Only major modifications to the protocols are highlighted. Briefly, the library was then transformed into DH5á competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p.157) with default program parameters and quality scores. The initial assembly was done at 2.3-fold coverage and yielded 5821 contigs.

Finishing could follow the initial assembly. Missing mates (sequences from clones that only gave reads from one end of the Candida DNA inserted in the plasmid) could be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks could be sequenced using the selected clones and primers. These data are then reassembled with PHRAP. Additional sequencing using PCR-generated templates and screened and/or unscreened lambda templates could be done in addition.

To identify C. albicans polypeptides the complete genomic sequence of C. albicans was analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences was evaluated with the program GEN-EMARKTM (Borodovsky and McIninch, 1993, Comp. Chem. 17:123).

Identification, Cloning and Expression of C. albicans Nucleic Acids

Expression and purification of the C. albicans polypeptides of the invention can be performed essentially as outlined below.

To facilitate the cloning, expression and purification of membrane and secreted proteins from C. albicans, a gene expression system, such as the pET System (Novagen), for cloning and expression of recombinant proteins in E. coli, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO: 14103) for cloning from strain SC5314 of C. albicans are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native C. albicans DNA sequence. All reverse primers (specific for the 3' end of any C. albicans ORF) include a EcoRI site at the extreme 5' terminus to permit cloning of each C. albicans sequence into the reading frame of the pET-28b. The pET-28b vector provides sequence encoding an additional 20 carboxy-terminal amino acids including six histidine residues (at the extreme C-terminus), which comprise the His-Tag. Genomic DNA prepared from strain SC5314 of C. albicans is used as the source of template DNA for PCR amplification reactions (Current Protocols in Molecular Biology, John Wiley and Sons, Inc., F. Ausubel et al., eds., 1994). To amplify a DNA sequence containing an C. albicans ORF, genomic DNA (50 nanograms) is introduced into a reaction vial containing 2 mM $MgCl_2$, 1 micromolar synthetic oligonucleotide primers (forward and reverse primers) complementary to and flanking a defined C. albicans ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *C. albicans* Nucleic Acids Into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL21(DE3), are transformed with recombinant pET expression plasmids carrying the cloned *C. albicans* sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with *C. albicans* Nucleic Acids Individual BL21 clones transformed with recombinant pET-28b *C. albicans* ORFs are analyzed by PCR amplification of the cloned inserts using the same forward and reverse primers, specific for each *C. albicans* sequence, that were used in the original PCR amplification cloning reactions. Successful amplification verifies the integration of the *C. albicans* sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned *C. albicans* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant *C. albicans* Sequences in *E. coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *C. albicans* sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the *C. albicans* recombinant constructions. Transformed cells are cultured in SOC medium for 1 hour, and the culture is then plated on LB plates containing 25 micrograms/ml kanamycin sulfate. The following day, fungal colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *C. albicans* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells are thawed, resupended in buffer and ruptured by several passages through a small volume microfluidizer (Model M-110S, Microfluidics International Corporation, Newton, Mass.). The resultant homogenate is centrifuged to yield a clear supernatant (crude extract) and following filtration the crude extract is fractionated over columns. Fractions are monitored by absorbance at $OD_{280}$ nm. and peak fractions may analyzed by SDS-PAGE.

The concentrations of purified protein preparations are quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations are purchased from BioRad (Hercules, Calif., USA), and stained with Coomassie blue. Molecular weight markers may include rabbit skeletal muscle myosin (200 kDa), *E. coli* β-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5696 | 13860691_f3_8 | 1 | 14104 | 732 | 244 | P15847 | 261 | 1.3(10)-22 | *Plasmodium falciparum* | 41-2 protein antigen precursor. |
| CONTIG5309 | 21953186_f2_4 | 2 | 14105 | 531 | 177 | P23746 | 98 | 0.00209 | *Plasmodium falciparum* | 101 kd malaria antigen (p101) (acidic basic repeat antigen) (fragment). |
| CONTIG5514 | 11804080_c1_9 | 3 | 14106 | 1206 | 402 | P31237 | 152 | 3.1(10)-8 | *Actinidia chinensis* | 1-aminocyclopropane-1 carboxylate oxidase (acc oxidase) (ethylene- forming enzyme) (efe) |
| CONTIG2279 | 22115640_f3_3 | 4 | 14107 | 390 | 130 | P10990 | 242 | 1.8(10)-20 | *Strongylocentrotus franciscanus* | actin 15a. |
| CONTIG5721 | 4001330_c2_24 | 5 | 14108 | 1011 | 337 | P38673 | 790 | 3.2(10)-100 | *Neurospora crassa* | actin-like protein (centractin). |
| CONTIG5565 | 3906531_c3_30 | 6 | 14109 | 1134 | 378 | P14235 | 1933 | 8.6(10)-200 | *Candida albicans* | actin. |
| CONTIG5425 | 10040912_c3_15 | 7 | 14110 | 1842 | 614 | P46589 | 1451 | 1.0(10)-148 | *Candida albicans* | adherence factor (adhesion and aggregation mediating surface antigen). |
| b1x18674.y | 22456518_c2_1 | 8 | 14111 | 525 | 175 | P32317 | 387 | 5.7(10)-36 | *Saccharomyces cerevisiae* | afg1 protein. |
| CONTIG3076 | 24807836_c2_3 | 9 | 14112 | 717 | 239 | P39010 | 148 | 2.1(10)-9 | *Saccharomyces cerevisiae* | ankyrin repeat-containing protein akr1. |
| CONTIG3660 | 24876587_c1_3 | 10 | 14113 | 1395 | 465 | P39010 | 588 | 2.8(10)-57 | *Saccharomyces cerevisiae* | ankyrin repeat containing protein akr1. |
| CONTIG1408 | 10960782_c1_5 | 11 | 14114 | 1278 | 426 | 146590 | 1009 | 7.0(10)-102 | *Candida albicans* | agglutinin-like protein precursor |
| CONTIG1838 | 1444535_c3_5 | 12 | 14115 | 303 | 101 | P46590 | 107 | 9.0(10)-5 | *Candida albicans* | agglutinin-like protein precursor |
| CONTIG2390 | 14954018_f3_4 | 13 | 14116 | 1347 | 449 | P46590 | 1061 | 2.2(10)-107 | *Candida albicans* | agglutinin-like protein precursor. |
| CONTIG2391 | 32677000_c2_2 | 14 | 14117 | 723 | 241 | P46590 | 272 | 2.3(10)-22 | *Candida albicans* | agglutinin-like protein precursor. |
| CONTIG2783 | 12316931_f2_3 | 15 | 14118 | 1506 | 502 | P46590 | 1481 | 6.9(10)-152 | *Candida albicans* | agglutinin-like protein precursor. |
| CONTIG279 | 12898567_f1_1 | 16 | 14119 | 462 | 154 | P46590 | 335 | 45(10)-29 | *Candida albicans* | agglutinin-like protein precursor. |
| CONTIG324 | 7145382_c3_3 | 17 | 14120 | 513 | 171 | P46590 | 497 | 2.2(10)-46 | *Candida albicans* | agglutinin-like protein precursor. |
| CONTIG3672 | 36038258_c2_7 | 18 | 14121 | 1569 | 523 | P46590 | 676 | 1.3(10)-80 | *Candida albicans* | agglutinin-like protein precursor. |
| CONTIG378 | 10190962_c1_2 | 19 | 14122 | 699 | 233 | P46590 | 640 | 1.1(10)-61 | *Candida albicans* | agglutinin-like protein precursor. |
| CONTIG4641 | 32609555_c2_8 | 20 | 14123 | 3180 | 1060 | P46590 | 1374 | 1.5(10)-140 | *Candida albicans* | agglutinin-like protein precursor. |
| CONTIG4725 | 26813317_c3_6 | 21 | 14124 | 330 | 110 | P46590 | 109 | 5.5(10)-5 | *Candida albicans* | agglutinin-like protein precursor. |
| CONTIG5089 | 14094431_f3_6 | 22 | 14125 | 1536 | 512 | P46590 | 1229 | 3.5(10)-125 | *Candida albicans* | agglutinin-like protein precursor. |
| CONTIG5089 | 12303906_f3_7 | 23 | 14126 | 1158 | 386 | P46590 | 960 | 1.1(10)-96 | *Candida albicans* | agglutinin-like protein precursor. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3930 | 24610302_f3_3 | 24 | 14127 | 2034 | 678 | P12807 | 2361 | 3.7(10)-245 | Pichia angusta | peroxisomal copper amine oxidase (ec 1.4.3.6). |
| CONTIG4975 | 11923760_f2_2 | 25 | 14128 | 246 | 82 | P12807 | 170 | 8.0(10)-12 | Pichia angusta | peroxisomal copper amine oxidase (ec 1.4.3.6). |
| CONTIG1409 | 4331332_c1_1 | 26 | 14129 | 825 | 275 | P22861 | 974 | 3.7(10)-98 | Debaryomyces occidentalis | glucoamylase 1 precursor (ec 3.2.1.3) (glucan 1,4-alpha-glucosidase) (1,4-alpha-d-glucan glucohydrolase). |
| CONTIG4355 | 860936_c3_8 | 27 | 14130 | 1347 | 449 | P22861 | 1797 | 22(10)-185 | Debaryomyces occidentalis | glucoamylase 1 precursor (ec 3.2.1.3) (glucan 1,4-alpha-glucosidase) (1,4-alpha-d-glucan glucohydrolase). |
| CONTIG4543 | 23828132_c1_5 | 28 | 14131 | 1638 | 546 | P37302 | 1199 | 5.2(10)-122 | Saccharomyces cerevisiae | aminopeptidase y precursor (ec 3.4.11.-) |
| CONTIG1102 | 33487527_c2_3 | 29 | 14132 | 846 | 282 | P43066 | 1121 | 9.6(10)-114 | Candida albicans | d-arabinitol 2-dehydrogenase (ribulose forming) (ardh) (ec 1.1.1.-) |
| CONTIG2679 | 26804052_c2_5 | 30 | 14133 | 2091 | 697 | P32770 | 570 | 1.1(10)-68 | Saccharomyces cerevisiae | arp protein. |
| CONTIG3101 | 4695289_c1_2 | 31 | 14134 | 1188 | 396 | P51691 | 512 | 4.5(10)-88 | Pseudomonas aeruginosa | arylsulfatase(ec 3.1.6.l)(aryl-sulphate sulphohydrolase). |
| CONTIG3921 | 6823300_f2_1 | 32 | 14135 | 2088 | 696 | Q04519 | 309 | 2.1(10)-26 | Mus musculus | sphingoinyelin phosphodiesterase precursor (ec 3.1.4.2) (acid sphingomyelinase). |
| CONTIG5771 | 4116286_c3_44 | 33 | 14136 | 2133 | 711 | Q04519 | 363 | 1.8(10)-30 | Mus musculus | sphingomyelin phosphodiesterase precursor (ec 3.1.4.12) (acid sphingomyelinase). |
| CONTIG4276 | 3380416_f3_1 | 34 | 14137 | 960 | 320 | Q08853 | 97 | 0.17 | Plasmodium falciparum | calcium-transporting atpase (ec 3.6.1.38) (calcium pump). |
| CONTIG5820 | 15628143_c3_88 | 35 | 14138 | 333 | 111 | Q03671 | 353 | 2.2(10)-32 | Candida parapsilosis | atp synthase a chain precursor (ec 3.6.1.34) (protein 6). |
| CONTIG5820 | 4037893_c3_87 | 36 | 14139 | 201 | 67 | Q03671 | 259 | 2.1(10)-22 | Candida parapsilosis | atp synthase a chain precursor (ec 3.6.1.34) (protein 6). |
| CONTIG5820 | 26816531_c3_86 | 37 | 14140 | 273 | 91 | Q03671 | 113 | 1.7(10)-6 | Candida parapsilosis | atp synthase a chain precursor (ec 3.6.1.34) (protein 6). |
| CONTIG2048 | 1377017_f2_1 | 38 | 14141 | 1269 | 423 | P39960 | 323 | 1.8(10)-27 | Saccharomyces cerevisiae | gtpase activating protein bem2/ipl2. |
| CONTIG5723 | 5901587_c2_21 | 39 | 14142 | 957 | 319 | P38934 | 377 | 6.7(10)-35 | Saccharomyces cerevisiae | nuclear segregation protein bfr1. |
| CONTIG5723 | 13673178_c3_26 | 40 | 14143 | 549 | 183 | P38934 | 146 | 1.6(10)-9 | Saccharomyces cerevisiae | nuclear segregation protein bfr1. |
| CONTIG5101 | 4085130_c3_12 | 41 | 14144 | 1098 | 366 | P22506 | 922 | 1.2(10)-92 | Saccharomycopsis fibuligera | beta-glucosidase 1 precursor (ec 3.2.1.21) (gentiobiase) (cellobiase) (beta-d-glucoside glucohydrolase). |
| CONTIG5071 | 3908177_c1_9 | 42 | 14145 | 525 | 175 | P22507 | 566 | 2.1(10)-54 | Saccharomycopsis fibuligera | beta-glucosidase 2 precursor (ec 3.2.1.21) (gentiobiase) (cellobiase) (beta-d-glucoside glucohydrolase). |
| CONTIG5101 | 32204500_c1_9 | 43 | 14146 | 939 | 313 | P22507 | 495 | 1.3(10)-46 | Saccharomycopsis fibuligera | beta-glucosidase 2 precursor (ec 3.2.1.21) (gentiobiase) (cellobiase) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5075 | 20345305_c3_10 | 44 | 14147 | 300 | 100 | P07337 | 261 | 1.8(10)-21 | Kluyveromyces marxianus | (beta-d-glucoside glucohydrolase). beta-d-glucoside precursor (ec 3.2.1.21) (gentiobiase) (cellobiase) (beta-d-glucoside glucohydrolase). |
| CONTIG5449 | 26375638_f1_1 | 45 | 14148 | 702 | 234 | P07337 | 635 | 3.1(10)-62 | Kluyveromyces marxianus | beta-glucosidase precursor (ec 3.2.1.21) (gentiobiase) (cellobiase) (beta-d-glucoside glucohydrolase). |
| CONTIG5449 | 19660377_f1_2 | 46 | 14149 | 1545 | 515 | P07337 | 726 | 1.3(10)-99 | Kluyveromyces marxianus | beta-glucosidase precursor (ec 3.2.1.21) (gentiobiase) (cellobiase) (beta-d-glucoside glucohydrolase). |
| CONTIG1398 | 23629128_f3_1 | 47 | 14150 | 903 | 301 | P24686 | 600 | 5.9(10)-57 | Emericella nidulans | negative regulator of mitosis. |
| CONTIG5581 | 12203280_c3_17 | 48 | 14151 | 1629 | 543 | P28873 | 2410 | 2.5(10)-250 | Candida albicans | benomyl/methotrexate resistance protein. |
| CONTIG5629 | 15657500_c2_17 | 49 | 14152 | 234 | 78 | P28873 | 326 | 6.2(10)-29 | Candida albicans | benomyl/methotrexate resistance protein. |
| CONTIG3935 | 9923265_f2_4 | 50 | 14153 | 195 | 65 | P80193 | 96 | 0.00029 | Pseudomonas sp. | gamma-butyrobetaine,2-oxoglutarate dioxygenase (ec 1.14.11.1) (gamma-butyrobetaine hydroxylase). |
| CONTIG4894 | 31753205_f3_3 | 51 | 14154 | 792 | 264 | P39969 | 155 | 5.5(10)-10 | Saccharomyces cerevisiae | boi2 protein (beb1 protein). |
| b3x17654.y | 10737800_c2_1 | 52 | 14155 | 288 | 96 | P39969 | 188 | 1.7(10)-13 | Saccharomyces cerevisiae | boi2 protein (beb1 protein). |
| CONTIG3497 | 6851637_c2_7 | 53 | 14156 | 1485 | 495 | P48582 | 97 | 7.5(10)-7 | Saccharomyces cerevisiae | bro1 protein. |
| CONTIG5100 | 1272175_f3_2 | 54 | 14157 | 981 | 327 | P26448 | 620 | 1.2(10)-60 | Saccharomyces cerevisiae | cell cycle arrest protein bub2. |
| CONTIG5769 | 4023377_f1_1 | 55 | 14158 | 3768 | 1256 | P33314 | 446 | 3.6(10)-78 | Saccharomyces cerevisiae | inhibitory regulator protein bud2/cla2. |
| CONTIG4354 | 969187_c1_6 | 56 | 14159 | 399 | 133 | P25558 | 111 | 4.5(10)-5 | Saccharomyces cerevisiae | bud site selection protein bud3. |
| CONTIG5785 | 20509652_c1_27 | 57 | 14160 | 690 | 230 | P36581 | 400 | 2.3(10)-37 | Schizosaccharomyces pombe | calnexin homolog precursor. |
| CONTIG4383 | 29859375_f3_7 | 58 | 14161 | 318 | 106 | P43059 | 171 | 4.5(10)-12 | Candida albicans | lysine/arginine permease (basic amino acids permease). |
| CONTIG2206 | 21504753_f2_1 | 59 | 14162 | 1086 | 362 | P11356 | 1462 | 7.0(10)-150 | Candida tropicalis | acyl-coenzyme a oxidase pxp-2 (ec 1.3.3.6). |
| CONTIG956 | 35678160_c3_4 | 60 | 14163 | 198 | 66 | P47756 | 96 | 0.00017 | Homo sapiens | f-actin capping protein beta subunit (capz). |
| CONTIG4105 | 43460811_c3_9 | 61 | 14164 | 1227 | 409 | P28871 | 1995 | 2.2(10)-206 | Candida albicans | candidapepsin 2 precursor (ec 3.4.23.24) (aspartate protease 2) (acp 2) (secreted aspartic protease 2). |
| CONTIG551 | 12000410_f3_2 | 62 | 14165 | 537 | 179 | P43092 | 852 | 3.1(10)-85 | Candida albicans | candidapepsin 3 precursor (ec 3.4.23.24) (aspartate protease 3) (acp 3) (secreted aspartic protease 3). |
| CONTIG4632 | 14554508_c3_10 | 63 | 14166 | 1269 | 423 | P43094 | 2144 | 3.7(10)-222 | Candida | candidapepsin 5 precursor (ec |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4738 | 30711687_c1_6 | 64 | 14167 | 1053 | 351 | P43095 | 1597 | 3.5(10)-164 | Candida albicans | 3,4.23.24) (aspartate protease 5) (acp 5) (secreted aspartic protease 6) (secreted aspartic protease 6) candidapepsin 6 precursor (ec 3.4.23.24) (aspartatc protease 6) |
| CONTIG1325 | 1345311_c3_3 | 65 | 14168 | 648 | 216 | P43096 | 739 | 2.8(10)-73 | Candida albicans | candidapepsin 7 precursor (ec 3.4.23.24) (aspartate protease 7) (acp 7) (secreted aspartic protease 7). |
| CONTIG2452 | 29956630_f1_1 | 66 | 14169 | 672 | 224 | P43096 | 1116 | 3.2(10)-113 | Candida albicans | candidapepsin 7 precursor (ec 3.4.23.24) (aspartate protease 7) (acp 7) (secreted aspartic protease 7). |
| CONTIG5582 | 29332625_f3_13 | 67 | 14170 | 588 | 196 | P31225 | 830 | 6.5(10)-83 | Candida albicans | corticosteroid-binding protein. |
| CONTIG3221 | 26594686_f1_1 | 68 | 14171 | 1011 | 337 | P01129 | 130 | 1.5(10)-5 | Schizosaccharomyces pombe | start control protein cdc10. |
| CONTIG4931 | 22462507_c1_12 | 69 | 14172 | 1248 | 416 | Q09822 | 139 | 4.7(10)-6 | Schizosaccharomyces pombe | cell division control protein 15. |
| CONTIG2190 | 34375931_c2_2 | 70 | 14173 | 1128 | 376 | P53699 | 1851 | 4.2(10)-191 | Candida albicans | cell division control protein 4. |
| CONTIG4308 | 33250391_f3_3 | 71 | 14174 | 213 | 71 | P53699 | 360 | 2.5(10)-32 | Candida albicans | cell division control protein 4. |
| CONTIG5582 | 3908250_c3_16 | 72 | 14175 | 651 | 217 | P53699 | 447 | 6.0(10)-42 | Candida albicans | cell division control protein 4. |
| CONTIG5233 | 4425683_c2_12 | 73 | 14176 | 1638 | 546 | P41892 | 239 | 5.2(10)-22 | Schizosaccharomyces pombe | cell division control protein 7 (ec 2.7.1.-). |
| CONTIG672 | 14460782_c1_1 | 74 | 14177 | 678 | 226 | P41733 | 100 | 1.2(10)-10 | Saccharomyces cerevisiae | cell division control protein 91. |
| b9x12n34.y | 29410628_c3_2 | 75 | 14178 | 465 | 155 | P41733 | 239 | 5.9(10)-20 | Saccharomyces cerevisiae | cell division control protein 91. |
| CONTIG5371 | 13862507_f3_7 | 76 | 14179 | 255 | 85 | P53700 | 327 | 1.3(10)-29 | Candida albicans | cytochrome c heme lyase (ec 4.4.1.17) (cch1) (holocytochrome-c synthase). |
| CONTIG5016 | 25647260_f3_3 | 77 | 14180 | 369 | 123 | Q09184 | 215 | 2.6(10)-17 | Schizosaccharomyces pombe | curved dna-binding protein (42 kd protein). |
| b9x12l50.x | 2390632_f1_1 | 78 | 14181 | 483 | 161 | Q09184 | 390 | 2.7(10)-36 | Schizosaccharomyces pombe | curved dna-binding protein (42 kd protein). |
| CONTIG3305 | 21676555_f3_5 | 79 | 14182 | 366 | 122 | Q02224 | 100 | 0.0011 | Homo sapiens | centromeric protein c (cenp-c protein). |
| CONTIG823 | 13776689_c1_2 | 80 | 14183 | 672 | 224 | Q02224 | 99 | 0.09299 | Homo sapiens | centromeric protein e (cenp-e protein). |
| CONTIG3114 | 13082811_c3_10 | 81 | 14184 | 1392 | 464 | P40953 | 1818 | 1.3(10)-187 | Candida albicans | chitinase 2 precursor (ec 3.2.1.14). |
| CONTIG5812 | 33706277_c2_25 | 82 | 14185 | 771 | 257 | P40954 | 314 | 1.3(10)-27 | Candida albicans | chitinase 3 precursor (ec 3.2.1.14). |
| CONTIG4261 | 13877252_c2_5 | 83 | 14186 | 393 | 131 | P23316 | 581 | 1.6(10)-56 | Candida albicans | chitin synthase 1 (ec 2.4.1.16) (chitin-udp acetyl-glucosaminyl transferase I). |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3147 | 3906525_c3_8 | 84 | 14187 | 858 | 286 | P30572 | 1122 | 7.5(10)-114 | Candida albicans | chitinsynthase2 (ec 2.4.1.16) (chitin-udp acetyl-glucosaminyl transferase 2). |
| CONTIG5709 | 9844380_f1_2 | 85 | 14188 | 405 | 135 | P30573 | 493 | 5.5(10)-46 | Candida albicans | chitin synthase 3 (ec 2.4.1.16) (chitin-udp acetyl-glucosaminyl transferase 3). |
| CONTIG4697 | 22036063_f3_2 | 86 | 14189 | 351 | 117 | P20486 | 445 | 4.2(10)-42 | Saccharomyces cerevisiae | cyclin-dependent kinases regulatory subunit (cell division control prutein cks1). |
| CONTIG400 | 25963877_c2_12 | 87 | 14190 | 276 | 92 | P42916 | 93 | 0.00042 | Bos taurus | collectin-43 (cl-43). |
| CONTIG1895 | 33392067_c3_3 | 88 | 14191 | 1377 | 459 | P17697 | 93 | 0.2 | Bos taurus | clusterin precursor (glycoprotein |
| CONTIG5633 | 5213966_f1_1 | 89 | 14192 | 582 | 194 | P32782 | 854 | 1.8(10)-85 | Candida albicans | 3',5'-cyclic-nucleotide phosphodiesterase (ec 3.1.4.17) (pdease). |
| CONTIG5314 | 985452_f3_8 | 90 | 14193 | 918 | 306 | P54623 | 95 | 0.17999 | Drosophila melanogaster | centrosomin. |
| CONTIG5820 | 22454388_f2_23 | 91 | 14194 | 192 | 64 | P98001 | 236 | 3.7(10)-19 | Saccharomyces douglasii | cytochrome c oxidase polypeptide ii (ec 1.9.3.1). |
| CONTIG5820 | 20516937_c3_91 | 92 | 14195 | 363 | 121 | P43373 | 508 | 8.8(10)-49 | Candida glabrata | cytochrome c oxidase polypeptide ii (ec 1.9.3.1). |
| CONTIG5820 | 1053393_c3_90 | 93 | 14196 | 192 | 64 | P43373 | 221 | 2.2(10)-18 | Candida glabrata | cytochrome c oxidase polypeptide ii (ec 1.9.3.1). |
| CONTIG5766 | 4879681_c1_23 | 94 | 14197 | 1170 | 390 | P16141 | 1479 | 1.1(10)-151 | Candida maltosa | cytochrome p450 liia4 (alkane-inducible) (ec 1.14.14.1) (p450-alk3a) (cyp52a3-b). |
| CONTIG1622 | 4881561_f3_1 | 95 | 14198 | 309 | 103 | P24458 | 282 | 3.2(10)-24 | Candida maltosa | cytochrome p450 liia5 (alkane-inducible) (ec 1.14.14.1) (p450-alk2a) (cyp52a3-b). |
| CONTIG948 | 24633002_c2_2 | 96 | 14199 | 717 | 239 | P24458 | 933 | 8.0(10)-94 | Candida maltosa | cytochrome p450 liia5 (alkane-inducible) (ec 1.14.14.1) (p450-alk2a) (cyp52a3-b). |
| CONTIG4944 | 2582760_f1_3 | 97 | 14200 | 1998 | 666 | P43079 | 2528 | 7.7(10)-263 | Candida albicans | transcription factor ceca. |
| b2x11953.x | 14567286_c3_2 | 98 | 14201 | 330 | 110 | Q01981 | 120 | 8.6(10)-7 | Emericella nidulans | dna-binding protein ceca. |
| CONTIG5461 | 12619012_c2_12 | 99 | 14202 | 1029 | 343 | P33153 | 1510 | 5.7(10)-155 | Candida albicans | gtp-binding rho-like protein. |
| CONTIG1191 | 22898508_c3_2 | 100 | 14203 | 324 | 108 | P53707 | 560 | 2.7(10)-54 | Candida albicans | 30 kd cell surface protein (fragment). |
| CONTIG2359 | 4331511_c3_4 | 101 | 14204 | 672 | 224 | P53707 | 1066 | 6.5(10)-108 | Candida albicans | 30 kd cell surface protein (fragment). |
| b2x13715.y | 35314012_c1_1 | 102 | 14205 | 441 | 147 | P38877 | 104 | 5.7(10)-6 | Saccharomyces cerevisiae | kinetochore protein ctf8. |
| CONTIG5363 | 22345012_c1_16 | 103 | 14206 | 741 | 247 | Q03100 | 96 | 0.062 | Dictyostelium discoideum | adenylate cyclase, aggregation specific (ec 4.6.1.1) (atp pyrophosphate-lyase) (adenylyl cyclase). |
| CONTIG65392 | 20160763_c2_5 | 104 | 14207 | 711 | 237 | P23466 | 97 | 0.16 | Saccharomyces kluyveri | adenylatecyclase (ec 4.6.1.1)(atp pyrophosphate-lyase) (adenylyl |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5532 | 36031255_c2_13 | 105 | 14208 | 777 | 259 | P23466 | 92 | 0.41999 | Saccharomyces kluyveri | cyclase). adenylate cyclase (ec 4.6.1.1) (atp pyrophosphate-lyase) (adenylyl cyclase). |
| CONTIG5820 | 12506285_f2_31 | 106 | 14209 | 345 | 115 | P48877 | 436 | 3.7(10)-41 | Pichia canadensis | cytochrome b (ec 1.10.2.2). |
| CONTIG5818 | 12552137_c1_31 | 107 | 14210 | 1194 | 398 | P50867 | 1216 | 8.3(10)-124 | Emericella nidulans | cysteine synthase (ec 4.2.99.8)(o-acetylserine sulfhydrytase) (o-acetylserine (thiol)-lyase) (csase). |
| CONTIG918 | 4803802_f2_2 | 108 | 14211 | 210 | 70 | P28875 | 222 | 4.5(10)-18 | Candida albicans | zinc finger protein 1. |
| CONTIG4794 | 26055406_c3_5 | 109 | 14212 | 621 | 207 | Q05329 | 278 | 1.3(10)-23 | Homo sapiens | glutamate decarboxylase, 65 kd isoform (ec 4.1.1.15) (gad-65) (65 kd glutamic acid decarboxylase). |
| CONTIG413 | 36371013_f1_1 | 110 | 14213 | 555 | 185 | P31115 | 227 | 2.1(10)-18 | Saccharomyces cerevisiae | depressed growth-rate protein deg1. |
| CONTIG3974 | 25392512_f3_2 | 111 | 14214 | 519 | 173 | P31115 | 343 | 2.7(10)-31 | Saccharomyces cerevisiae | depressed growth-rate protein deg1. |
| CONTIG1047 | 2242052_f2_3 | 112 | 14215 | 195 | 65 | P50265 | 168 | 2.7(10)-12 | Candida albicans | dlh1 protein. |
| CONTIG4729 | 20395443_c3_9 | 113 | 14216 | 432 | 144 | P52496 | 296 | 3.6(10)-25 | Candida albicans | dna ligase (ec 6.5.1.1) (polydeoxyribonucleotide synthase (atp)). |
| CONTIG5311 | 334400656_f3_5 | 114 | 14217 | 2175 | 725 | P52496 | 3482 | 0 | Candida albicans | dna ligase (ec 6.5.1.1) (polydeoxyribonucleotide synthase (atp)). |
| CONTIG2547 | 14570671_f2_2 | 115 | 14218 | 543 | 181 | P33309 | 377 | 6.7(10)-35 | Saccharomyces cerevisiae | dom34 protein. |
| CONTIG5806 | 22534537_c3_41 | 116 | 14219 | 1539 | 513 | P52025 | 102 | 0.069 | Methanococcus voltae | dna polymerase (ec 2.2.2.2). |
| CONTIG2772 | 962816_c1_5 | 117 | 14220 | 747 | 249 | P33793 | 92 | 0.28999 | Variola virus | dna polymerase (ec 2.7.7.7). |
| CONTIG5770 | 14460760_c3_34 | 118 | 14221 | 651 | 217 | P18899 | 151 | 1.1(10)-14 | Saccharomyces cerevisiae | ddr48 stress protein (dna damage-responsive protein 48) (ddrp 48) (yp 75) (flocculent specific protein). |
| CONTIG5802 | 24036003_c3_37 | 119 | 14222 | 291 | 97 | P45444 | 130 | 1.2(10)-6 | Emericella nidulans | dynein heavy chain, cytosolic (dyhc). |
| b1x11226.y | 2145390_f2_1 | 120 | 14223 | 687 | 229 | P03856 | 1039 | 4.7(10)-105 | Escherichia coli | protein e. |
| CONTIG2765 | 16678933_c3_4 | 121 | 14224 | 330 | 110 | P54352 | 147 | 1.5(10)-9 | Drosophila melanogaster | ethanolamine kinase (ec 2.7.1.82) (easily shocked protein). |
| CONTIG1837 | 24394415_c1_3 | 122 | 14225 | 222 | 74 | P43084 | 201 | 1.2(10)-15 | Candida albicans | probable nadph dehydrogenase (ec 1.6.99.1) (estrogen-binding protein) (ebp). |
| CONTIG430 | 47057_c3_2 | 123 | 14226 | 792 | 264 | P43084 | 998 | 1.0(10)-100 | Candida albicans | probable nadph dehydrogenase (ec 1.6.99.1) (estrogen-binding protein) (ebp). |
| CONTIG5598 | 13865892_f1_2 | 124 | 14227 | 927 | 309 | Q07730 | 816 | 2.0(10)-81 | Candida albicans | ece1 protein. |
| CONTIG3402 | 22074062_c3_11 | 125 | 14228 | 318 | 106 | Q06889 | 241 | 3.1(10)-20 | Homo sapiens | early growth response protein 3 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x16352.y | 36125311_c3_1 | 126 | 14229 | 657 | 219 | P20829 | 96 | 0.031 | *Drosophila melanogaster* | (egr-3) (zinc finger protein pilot). retrovirus-related env polyprotein (transposon 297). |
| CONTIG5801 | 14142525_f3_19 | 127 | 14230 | 450 | 150 | P30195 | 98 | 0.005 | *Staphylococcus epidermidis* | epidermin biosynthesis biosynthesis protein epib. |
| CONTIG2399 | 8995963_f1_1 | 128 | 14231 | 939 | 313 | P07992 | 237 | 4.5(10)-20 | *Homo sapiens* | dna excision repair protein ercc-1. |
| CONTIG4000 | 1173500_f1_1 | 129 | 14232 | 1245 | 415 | P26337 | 104 | 0.021 | *Trypanosoma equiperdum* | putative adenylate cyclase regulatory protein. |
| CONTIG5532 | 7157067_c2_11 | 130 | 14233 | 1341 | 447 | P26337 | 100 | 0.067 | *Trypanosoma equiperdum* | putative adenylate cyclase regulatory protein. |
| CONTIG5145 | 26174017_c3_13 | 131 | 14234 | 882 | 294 | P33056 | 90 | 0.34 | *Variola virus* | early transcription factor 70 kd subunit. |
| CONTIG3960 | 1987818_f2_1 | 132 | 14235 | 1599 | 533 | P21268 | 116 | 0.0022 | *Saccharomyces cerevisiae* | factor arrest protein. |
| CONTIG4071 | 11757652_f2_4 | 133 | 14236 | 945 | 315 | P34731 | 1477 | 1.8(10)-151 | *Candida albicans* | fatty acid synthase, subunit beta (ec 2.3.1.86) (contains: 3-hydroxypalmitoyl-[acyl-carrier-protein] dehydratase (ec 4.2.1.61); enoyl-[acyl-carrier-protein] reductase (nadh) (ec 1.3.1.9); [acyl-carrier-protein] acetyltransferase (ec 2.3.1.38); [acyl-car omega-6 fatty acid desaturase, endoplasmic reticulum isozyme 1 (ec 1.14.99.-). |
| CONTIG1277 | 16610692_f1_1 | 134 | 14237 | 333 | 111 | P48630 | 233 | 2.6(10)-19 | *Glycine max* | |
| CONTIG2753 | 4725626_c3_4 | 135 | 14238 | 1326 | 442 | P46313 | 731 | 2.1(10)-72 | *Arabidopsis thaliana* | omega-6 fatty acid desaturase, endoplasmic reticulum (ec 1.14.99.-) (delta-12 desaturase). |
| CONTIG4775 | 2164000_c2_9 | 136 | 14239 | 1212 | 404 | P49842 | 93 | 0.079 | *Homo sapiens* | gl1 protein. |
| CONTIG5243 | 4425812_c1_7 | 137 | 14240 | 1923 | 641 | P34116 | 92 | 0.62 | *Dictyostelium discoideum* | cell surface glycoprotein gp138b precursor. |
| CONTIG3578 | 5126507_c2_3 | 138 | 14241 | 1146 | 382 | P03351 | 94 | 0.14 | Equine infectious anemia virus | gag polyprotein (contains: core proteins p15, p26, p11, p9). |
| CONTIG5032 | 24017191_c2_9 | 139 | 14242 | 1776 | 592 | P32257 | 91 | 0.65 | *Kluyveromyces lactis gal11.* | transcription regulatory protein |
| CONTIG1956 | 4863802_c3_1 | 140 | 14243 | 1002 | 334 | P27613 | 90 | 0.04599 | *Trichostrongylus colubriformis* | globin-like host-protective antigen precursor. |
| b9x11y68.x | 5866437_c3_2 | 141 | 14244 | 282 | 94 | P55143 | 96 | 4.0(10)-5 | *Ricinus communis* | glutaredoxin. |
| CONTIG3232 | 36069567_f1_1 | 142 | 14245 | 408 | 136 | Q00582 | 179 | 1.3(10)-13 | *Saccharomyces cerevisiae* | gtp-binding protein gtr1. |
| CONTIG3743 | 24256760_c3_7 | 143 | 14246 | 759 | 253 | P50505 | 373 | 1.3(10)-33 | *Debaryomyces occidentalis* | high affinity potassium transporter. |
| CONTIG5247 | 256700_f1_1 | 144 | 14247 | 576 | 192 | P50505 | 467 | 7.5(10)-44 | *Debaryomyces occidentalis* | high affinity potassium transporter. |
| CONTIG3696 | 9776562_f1_2 | 145 | 14248 | 741 | 247 | P20449 | 336 | 2.2(10)-34 | *Saccharomyces cerevisiae* | probable atp-dependent rna helicase ca5/6. |
| CONTIG4636 | 23493942_c3_6 | 146 | 14249 | 249 | 83 | P20449 | 273 | 2.2(10)-23 | *Saccharomyces cerevisiae* | probable atp-dependent rna |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5736 | 194075_c2_26 | 147 | 14250 | 195 | 65 | P22414 | 226 | 1.2(10)-17 | *Saccharomyces cerevisiae* | helicase ca5/6. |
| CONTIG5736 | 517943_c1_18 | 148 | 14251 | 2472 | 824 | P22414 | 3749 | 0 | *Candida tropicalis* | hydratase-dehydrogenase-epimerase (hde). |
| CONTIG2897 | 4945130_f1_2 | 149 | 14252 | 474 | 158 | P49374 | 294 | 1.8(10)-25 | *Candida tropicalis* | hydralase-dehydrogenase-epimerase (hde). |
| CONTIG4857 | 213538_f2_2 | 150 | 14253 | 1089 | 363 | P49374 | 966 | 2.6(10)-97 | *Kluyveromyces lactis* | high-affinity glucose transporter. |
| CONTIG5586 | 4193757_f2_4 | 151 | 14254 | 1137 | 379 | P49374 | 1050 | 32(10)-106 | *Kluyveromyces lactis* | high-affinity glucose transporter. |
| CONTIG3999 | 167627_f2_2 | 152 | 14255 | 462 | 154 | P46973 | 130 | 44(10)-18 | *Kluyveromyces lactis* | high-affinity glucose transporter. |
| CONTIG4537 | 22304687_c3_9 | 153 | 14256 | 1872 | 624 | P20050 | 238 | 80(10)-17 | *Saccharomyces cerevisiae* | hit1 protein. |
| CONTIG364 | 589040_f3_1 | 154 | 14257 | 279 | 93 | P14586 | 97 | 3.1(10)-5 | *Saccharomyces cerevisiae* | meiosis specific protein hop1. |
| CONTIG3783 | 14490885_c3_10 | 155 | 14258 | 1068 | 356 | P25619 | 385 | 9.5(10)-36 | *Plasmodium falciparum* | histidine-rich protein. |
| CONTIG4918 | 10192125_f2_4 | 156 | 14259 | 993 | 331 | P22121 | 99 | 0.04299 | *Saccharomyces cerevisiae* | 30 kd heat shock protein. |
| CONTIG929 | 7036558_c3_2 | 157 | 14260 | 858 | 286 | P53706 | 1279 | 1.7(10)-130 | *Kluyveromyces lactis* | heat shock factor protein (hsf) (heat shock transcription factor) (hstf). |
| b2x15627.y | 22772062_c3_5 | 158 | 14261 | 348 | 116 | P53706 | 527 | 1.6(10)-49 | *Candida albicans* | atp-dependent permease hs16 (ste6 homolog). |
| b2x15627.y | 4189792_c2_3 | 159 | 14262 | 204 | 68 | P53706 | 264 | 1.8(10)-21 | *Candida albicans* | atp-dependent permease hs16 (ste6 homolog). |
| b2x10287.y | 4391406_f1_1 | 160 | 14263 | 498 | 166 | P53706 | 792 | 5.2(10)-78 | *Candida albicans* | atp-dependent permease hs16 (ste6 homolog). |
| b1x11761.y | 234400_f3_1 | 161 | 14264 | 417 | 139 | P53706 | 453 | 1.3(10)-41 | *Candida albicans* | atp-dependent permease hs16 (ste6 homolog). |
| CONTIG1650 | 5364719_c1_2 | 162 | 14265 | 777 | 259 | P53706 | 861 | 1.6(10)-85 | *Candida albicans* | atp-dependent permease hs16 (ste6 homolog). |
| CONTIG64966 | 25625192_f2_4 | 163 | 14266 | 759 | 253 | P46599 | 1152 | 5.0(10)-117 | *Candida albicans* | serine/threonine protein kinase ste7 homolog (ec 2.7.1.-). |
| CONTIG5291 | 36135942_c2_14 | 164 | 14267 | 669 | 223 | P42259 | 108 | 0.00051 | *Natronobacterium pharaonis* | sensory rhodopsin ii transducer (htr ii) (methyl-accepting phototaxis protein ii) (mpp-ii). |
| CONTIG1484 | 26605306_f1_1 | 165 | 14268 | 420 | 140 | P46593 | 99 | 0.00029 | *Candida albicans* | hyphal wall protein 1 (fragment). |
| CONTIG48 | 16890877_c2_2 | 166 | 14269 | 909 | 303 | P46593 | 101 | 0.00018 | *Candida albicans* | hyphal wall protein 1 (fragment). |
| CONTIG5201 | 29339457_f3_6 | 167 | 14270 | 564 | 188 | P46593 | 170 | 7.0(10)-12 | *Candida albicans* | hyphal wall protein 1 (fragment). |
| CONTIG5372 | f2831)5_c1_13 | 168 | 14271 | 396 | 132 | P46593 | 192 | 3.0(10)-14 | *Candida albicans* | hyphal wall protein 1 (fragment). |
| CONTIG2628 | 253211_f3_3 | 169 | 14272 | 195 | 65 | P46591 | 115 | 9.0(10)-6 | *Candida albicans* | hyphally regulated protein precursor. |
| CONTIG2694 | 7069056_f3_4 | 170 | 14273 | 873 | 291 | P46591 | 338 | 1.3(10)-29 | *Candida albicans* | hyphally regulated protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3086 | 12000417_f3_5 | 171 | 14274 | 2139 | 713 | P46591 | 127 | 9.8(10)-5 | *Candida albicans* | hyphally regulated protein precursor |
| CONTIG3326 | 1214075_c1_5 | 172 | 14275 | 1485 | 495 | P46591 | 490 | 5.7(10)-46 | *Candida albicans* | hyphally regulated protein precursor. |
| CONTIG3270 | 879510_c3_7 | 173 | 14276 | 1821 | 607 | P46591 | 553 | 8.4(10)-53 | *Candida albicans* | hyphally regulated protein precursor. |
| CONTIG64223 | 24234642_c1_6 | 174 | 14277 | 879 | 293 | P46591 | 264 | 1.1(10)-21 | *Candida albicans* | hyphally regulated protein precursor. |
| CONTIG5648 | 1214055_f3_12 | 175 | 14278 | 855 | 285 | P46591 | 291 | 1.3(10)-24 | *Candida albicans* | hyphally regulated protein precursor. |
| CONTIG5648 | 29317507_f1_2 | 176 | 14279 | 786 | 262 | P46591 | 106 | 0.00075 | *Candida albicans* | hyphally regulated protein precursor. |
| CONTIG81 | 3314188_f3_2 | 177 | 14280 | 798 | 266 | P46591 | 328 | 1.5(10)-28 | *Candida albicans* | hyphally regulated protein precursor. |
| CONTIG825 | 30475963_f3_2 | 178 | 14281 | 696 | 232 | P46591 | 224 | 2.1(10)-17 | *Candida albicans* | hyphally regulated protein precursor. |
| b3x11288.y | 437556_c2_2 | 179 | 14282 | 549 | 183 | P46591 | 287 | 3.7(10)-24 | *Candida albicans* | byphally regulated protein precursor. |
| CONTIG4668 | 11829701_c3_7 | 180 | 14283 | 1989 | 663 | P53705 | 3115 | 0 | *Candida albicans* | integrin alpha chain-like protein. |
| CONTIG5178 | 29935005_f1_3 | 181 | 14284 | 2781 | 927 | P53705 | 3314 | 0 | *Candida albicans* | integrin alpha chain-like protein. |
| CONTIG5810 | 20335201_f1_3 | 182 | 14285 | 1170 | 390 | P10621 | 206 | 1.3(10)-14 | *Streptomyces clavuligerus* | isopenicillin n synthetase (ipns). |
| CONTIG5517 | 5212802_f3_4 | 183 | 14286 | 4947 | 1649 | P46940 | 711 | 2.6(10)-87 | *Homo sapiens* | ras gtpase-activating-like protein iqgap1 (p195). |
| CONTIG3282 | 235625_c2_8 | 184 | 14287 | 1806 | 602 | P47135 | 339 | 4.7(10)-28 | *Saccharomyces cerevisiae* | jsn1 protein. |
| b2x12745.y | 7666693_f1_1 | 185 | 14288 | 573 | 191 | P47135 | 260 | 3.7(10)-21 | *Saccharomyces cerevisiae* | jsn1 protein. |
| b3x14232.y | 24088887_f1_1 | 186 | 14289 | 345 | 115 | P52553 | 96 | 4.0(10)-5 | *Saccharomyces cerevisiae* | protein yke2. |
| CONTIG839 | 5175282_c2_4 | 187 | 14290 | 183 | 61 | P28874 | 193 | 2.1(10)-15 | *Candida albicans* | kre1 protein precursor (fragment). |
| CONTIG5075 | 4739042_f3_3 | 188 | 14291 | 336 | 112 | P09805 | 209 | 1.1(10)-15 | *Kluyveromyces lactis* | killer toxin alpha and beta subunits precursor (rf2 protein) (endochitinase (ec 3.2.1.14)). |
| CONTIG5075 | 35395043_f3_4 | 189 | 14292 | 984 | 328 | P09805 | 701 | 1.8(10)-68 | *Kluyveromyces lactis* | killer toxin alpha and beta subunits precursor (rf2 protein) (endochitinase (ec 3.2.1.14)). |
| CONTIG4335 | 20954183_f1_1 | 190 | 14293 | 1959 | 653 | P48012 | 684 | 2.0(10)-67 | *Debaryomyces occidentalis* | 3-isopropylinalate dehydrogenase (ec1.1.1.85) (beta-ipm dehydrogenase) (imdh) (3-ipm-dh). |
| CONTIG4900 | 23472510_f2_4 | 191 | 14294 | 1149 | 383 | P20261 | 91 | 0.34999 | *Candida rugosa* | lipase 1 precursor (ec 3.1.1.3). |
| CONTIG1645 | 20805438_f2_1 | 192 | 14295 | 906 | 302 | P25391 | 94 | 0.47999 | *Homo sapiens* | laminin alpha-1 chain precursor (laminin a chain). |
| CONTIG1891 | 36413317_f1_1 | 193 | 14296 | 1575 | 525 | P07866 | 493 | 4.5(10)-56 | *Saccharomyces cerevisiae* | low temperature essential protein. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1930 | 32043881_c3_9 | 194 | 14297 | 528 | 176 | P34078 | 217 | 3.0(10)-17 | Saccharomyces cerevisiae | low-temperature viability protein ltv1. |
| CONTIG3539 | 813280_f2_4 | 195 | 14298 | 693 | 231 | P55080 | 141 | 5.0(10)-9 | Gallus gallus | microfibrillar-associated protein 1. |
| CONTIG5512 | 554652_f1_1 | 196 | 14299 | 1518 | 506 | P20484 | 598 | 5.9(10)-82 | Saccharomyces cerevisiae | mak11 protein precursor. |
| CONTIG1224 | 35206700_f3_1 | 197 | 14300 | 378 | 126 | P23059 | 97 | 3.1(10)-5 | Saccharomyces cerevisiae | mak31 protein. |
| CONTIG5644 | 35240930_f2_7 | 198 | 14301 | 942 | 314 | P23060 | 338 | 9.0(10)-31 | Saccharomyces cerevisiae | mak32 protein. |
| CONTIG1593 | 2162788_f2_1 | 199 | 14302 | 984 | 328 | P40850 | 218 | 6.9(10)-25 | Saccharomyces cerevisiae | mk11 protein. |
| CONTIG3546 | 19569450_c1_5 | 200 | 14303 | 498 | 166 | Q06138 | 361 | 3.2(10)-33 | Mus musculus | mo25 protein. |
| CONTIG1287 | 15054563_c1_1 | 201 | 14304 | 621 | 207 | P53583 | 237 | 3.0(10)-19 | Saccharomyces cerevisiae | mpa43 protein. |
| b9x13e70.x | 4569682_f1_1 | 202 | 14305 | 432 | 144 | P53583 | 145 | 2.7(10)-9 | Saccharomyces cerevisiae | mpa43 protein. |
| CONTIG5115 | 7062777_c2_14 | 203 | 14306 | 1383 | 461 | P21339 | 834 | 2.5(10)-83 | Saccharomyces cerevisiae | morphogenesis-related protein (multicopy suppression of a budding defect 1). |
| CONTIG4502 | 391002_f3_2 | 204 | 14307 | 1635 | 545 | P52918 | 995 | 2.2(10)-100 | Saccharomyces cerevisiae | msn5 protein. |
| CONTIG5314 | 31484427_c2_14 | 205 | 14308 | 1968 | 656 | P52918 | 779 | 6.0(10)-111 | Saccharomyces cerevisiae | msn5 protein. |
| CONTIG2404 | 36142127_f1_1 | 206 | 14309 | 489 | 163 | P09091 | 100 | 1.5(10)-5 | Saccharomyces cerevisiae | mating-type protein a-1, incompletely spliced. |
| CONTIG2414 | 37517_f3_1 | 207 | 14310 | 849 | 283 | P38680 | 311 | 9.5(10)-28 | Neurospora crassa | n amino acid transport system protein (methyltryptophan resistance protein). |
| CONTIG4065 | 15633576_c1_6 | 208 | 14311 | 537 | 179 | Q04802 | 899 | 3.2(10)-91 | Candida albicans | glucosamine-6-phosphate isomerase(ec 5.3.1.10) (glucosamine-6-phosphate deaminase). |
| b3x10122.x | 31484388_c2_3 | 209 | 14312 | 315 | 105 | P52920 | 422 | 1.1(10)-39 | Saccharomyces cerevisiae | nbp35 protein. |
| CONTIG1945 | 24024063_f3_3 | 210 | 14313 | 453 | 151 | P42114 | 249 | 2.3(10)-21 | Neurospora crassa | nadh-ubiquinone oxidoreductase 14.8 kd subunit (ec 1.6.5.3) (ec 1.6.99.3) (complex i-14.8 kd) (ci-14.8kd). |
| CONTIG5639 | 10203251_c1_12 | 211 | 14314 | 237 | 79 | Q02368 | 120 | 1.1(10)-7 | Bos Taurus | nadh-ubiquinone oxidoreductase b18 subunit (ec 1.6.5.3) (ec 1.6.99.3) (complex i-b18) (ci-b18). |
| CONTIG5156 | 19939166_c2_10 | 212 | 14315 | 1305 | 435 | P38830 | 372 | 1.2(10)-49 | Saccharomyces cerevisiae | ndt80 protein. |
| CONTIG5590 | 808343_f2_7 | 213 | 14316 | 657 | 219 | P38830 | 346 | 6.0(10)-31 | Saccharomyces cerevisiae | ndt80 protein. |
| CONTIG4140 | 1225637_f2_2 | 214 | 14317 | 1008 | 336 | P12036 | 97 | 0.079 | Homo sapiens | neurofilament triplet h protein (200 kd neurofilament protein) (nf-h). |
| CONTIG5109 | 19787840_f1_2 | 215 | 14318 | 195 | 65 | P42117 | 121 | 9.0(10)-8 | Neurospora crassa | nadh-ubiquinone oxidoreductase 9.5 kd subunit (ec 1.6.5.3) (ec |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5725 | 447087_f1_1 | 216 | 14319 | 2214 | 738 | P15296 | 110 | 0.01 | Drosophila melanogaster | 1.6.99.3) (complex i-9.5kd) (ci-9.5) (ubiquinone-binding protein). 71 kd protein in nof-fb transposable element. |
| CONTIG5820 | 23911302_c3_92 | 217 | 14320 | 333 | 111 | P48901 | 274 | 5.5(10)-24 | Pichia canadensis | nadh-ubiquinone oxidoreductase chain 1 (ec 1.6.5.3). |
| CONTIG5820 | 23568800_f2_29 | 218 | 14321 | 327 | 109 | P48909 | 263 | 8.0(10)-23 | Candida parapsilosis | nadh-ubiquinone oxidoreductase chain 3 (ec 1.6.5.3). |
| b3x16007.y | 10593768_c2_1 | 219 | 14322 | 465 | 155 | P03913 | 765 | 5.0(10)-76 | Eurotium amstelodami | nadh-ubiquinone oxidoreductase chain 4 (ec1.6.5.3). |
| CONTIG5820 | 35955252_f2_32 | 220 | 14323 | 228 | 76 | P48919 | 251 | 9.6(10)-21 | Candida parapsilosis | nadh-ubiquinone oxidoreductase chain 5 (ec 1.6.5.3). |
| CONTIG5820 | 4163430_f2_33 | 221 | 14324 | 234 | 78 | P48919 | 205 | 9.4(10)-16 | Candida parapsilosis | nadh-ubiquinone oxidoreductase chain 5 (ec1.6.53) |
| CONTIG5820 | 1064800_f2_34 | 222 | 14325 | 957 | 319 | P48919 | 1095 | 5.5(10)-111 | Candida parapsilosis | nadh-ubiquinone oxidoreductase chain 5 (ec 1.6.5.3). |
| CONTIG5820 | 478427_c1_67 | 223 | 14326 | 444 | 148 | P48923 | 189 | 5.5(10)-15 | Candida parapsilosis | nadh-ubiquinone oxidoreductase chain 6 (ec 1.6.5.3). |
| CONTIG2096 | 33228382_f2_1 | 224 | 14327 | 666 | 222 | P24917 | 802 | 6.2(10)-80 | Neurospora crassa | nadh-ubiquinone oxidoreductase 51 kd subunit precursor (ec 1.6.99.3) (complex i-51kd) (ec 1.6.5.3) (ci-51kd). |
| CONTIG4848 | 2835843_c3_7 | 225 | 14328 | 375 | 125 | P24917 | 342 | 3.3(10)-31 | Neurospora crassa | nadh-uhiquinone oxidoreductase 51kd subunit precursor (ec 1.6.99.3) (complex i-51kd) (ci-51kd). |
| CONTIG4889 | 4148275_c3_3 | 226 | 14329 | 360 | 120 | P22142 | 525 | 1.3(10)-50 | Neurospora crassa | nadh-ubiquinone oxidoreductase 49 kd subunit precursor (ec 1.6.5.3) (ec 1.6.99.3) (complex i-49kd) (ci-49kd). |
| CONTIG2672 | 10660657_f1_2 | 227 | 14330 | 303 | 101 | P25284 | 124 | 2.7(10)-7 | Neurospora crassa | nadh-ubiquinone oxidoreductase 40 kd subunit precursor (ec 1.6.5.3) (ec 1.6.99.3) (complex i-40kd) (ci-40kd). |
| CONTIG5373 | 35242916_c3_9 | 228 | 14331 | 966 | 322 | P25284 | 670 | 6.0(10)-66 | Neurospora crassa | nadh-ubiquinone oxidoreductase 40 kd suhunit precursor (ec 1.6.5.3) (ec 1.6.99.3) (complex i-40kd) (ci-40kd). |
| CONTIG5591 | 11991308_c2_10 | 229 | 14332 | 528 | 176 | Q00673 | 618 | 1.8(10)-60 | Candida maltosa | probable nadh-ubiquinone oxidoreductase 30.4 kd subunit precursor (ec 1.6.5.3) (ec 1.6.99.3) (complex i-30kd) (ci-31kd) (alkane inducible protein 1). |
| CONTIG5814 | 22381885_f3_22 | 230 | 14333 | 771 | 257 | P40915 | 667 | 1.2(10)-65 | Neurospora crassa | nadh-ubiquinone dehydrogenase 24 kd suhunit precursor (ec 1.6.5.3) (ec 1.6.99.3). |
| CONTIG5490 | 24417937_c1_11 | 231 | 14334 | 627 | 209 | P19968 | 289 | 1.3(10)-25 | Neurospora crassa | nadh-ubiquinone oxidoreductase 21.3 kd subunit (ec 1.6.99.3). |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3874 | 196932_f1_1 | 232 | 14335 | 645 | 215 | P25710 | 92 | 0.021 | *Neurospora crassa* | nadh-ubiquinone oxidoreductase 21.3 kd subunit (ec 1.6.5.3) (ec 1.6.99.3). |
| CONTIG5820 | 11828900_f3_57 | 233 | 14336 | 303 | 101 | P48929 | 154 | 2.8(10)-11 | *Candida parapsilosis* | nadh-ubiquinone oxidoreductase chain 41 (ec 1.6.5.3). |
| CONTIG2465 | 21975640_c2_7 | 234 | 14337 | 1638 | 546 | Q00402 | 525 | 8.5(10)-49 | *Saccharomyces cerevisiae* | nuclear migration protein num1. |
| CONTIG555 | 20425012_f2_1 | 235 | 14338 | 510 | 170 | Q00402 | 223 | 1.0(10)-16 | *Saccharomyces cerevisiae* | nuclear migration protein num1. |
| b2x13015.y | 25573505_c3_4 | 236 | 14339 | 654 | 218 | Q00402 | 223 | 1.0(10)-16 | *Saccharomyces cerevisiae* | nuclear migration protein num1. |
| b2x10141.y | 26571942_f3_1 | 237 | 14340 | 450 | 150 | Q00402 | 172 | 2.7(10)-11 | *Saccharomyces cerevisiae* | nuclear migration protein num1. |
| CONTIG3947 | 21537801_c3_5 | 238 | 14341 | 528 | 176 | P52503 | 149 | 9.6(10)-11 | *Mus musculus* | nadh-ubiquinone oxidoreductase 13 kd-a subunit (ec 1.6.5.3) (ec 1.6.99.3) (complex i-13kd-a) (ci-1 kd-a) (fragment). |
| CONTIG2623 | 4725926_f2_2 | 239 | 14342 | 327 | 109 | Q03015 | 121 | 9.0(10)-8 | *Neurospora crassa* | nadh-ubiquinone oxidoreductase 12 kd subunit precursor (ec 1.6.5.3) (ec 1.699.3) (complex i-12kd) (ci-12kd). |
| CONTIG3478 | 21663963_f3_3 | 240 | 14343 | 432 | 144 | P21976 | 228 | 4.0(10)-19 | *Neurospora crassa* | nadh-ubiquinone oxidoreductase 20.8 kd subunit (ec 1.6.5.3) (ec 1.6.99.3). |
| CONTIG13320 | 4816405_f2_2 | 241 | 14344 | 867 | 289 | Q01969 | 120 | 8.0(10)-5 | *Thermotoga maritima* | outer membrane protein alpha precursor. |
| CONTIG4181 | 24647750_c1_4 | 242 | 14345 | 1221 | 407 | P46596 | 1525 | 1.5(10)-156 | *Candida albicans* | opaque-phase-specific protein op4 precursor. |
| CONTIG1077 | 6672838_f2_1 | 243 | 14346 | 453 | 151 | P80324 | 115 | 2.5(10)-6 | *Rhodotorula gracilis* | d-amino acid oxidase (ec 1.4.3.3) (damox). |
| b9x12q69.y | 1178411_c1_2 | 244 | 14347 | 549 | 183 | P80324 | 206 | 2.2(10)-16 | *Rhodotorula gracilis* | d-amino acid oxidase (ec 1.4.3.3) (damox). |
| CONTIG3506 | 24242188_f2_2 | 245 | 14348 | 1725 | 575 | P54675 | 94 | 0.55 | *Dictyostelium discoideum* | phosphalidylinositol 3-kinase 3 (ec 2.7.1.137) (ptdins-3-kinase) (pi3k) (fragment). |
| CONTIG5547 | 34094186_f2_1 | 246 | 14349 | 927 | 309 | P21171 | 98 | 0.02199 | *Listeria monocytogenes* | protein p60 precursor(invasion-associaled protein). |
| CONTIG2585 | 24812505_c1_5 | 247 | 14350 | 1251 | 417 | P32521 | 297 | 6.5(10)-25 | *Saccharomyces cerevisiae* | pab-dependentpoly(a)-speciric ribonuclease (ec 3.1.13.4). |
| CONTIG3014 | 23603453_c1_4 | 248 | 14351 | 1413 | 471 | P32521 | 437 | 7.7(10)-40 | *Saccharomyces cerevisiae* | pab-dependent poly(a)-specific ribonuclease (ec 3.1.13.4). |
| CONTIG2423 | 2036666_f3_2 | 249 | 14352 | 606 | 202 | P46463 | 413 | 1.8(10)-37 | *Pichia pastoris* | peroxisome biosynthesis protein pas1. |
| b9x12387.y | 26306933_c2_3 | 250 | 14353 | 705 | 235 | P46463 | 305 | 6.4(10)-26 | *Pichia pastoris* | peroxisome biosynthesis protein pas1. |
| CONTIG1709 | 6648317_f1_1 | 251 | 14354 | 765 | 255 | P33289 | 292 | 1.6(10)-24 | *Pichia pastoris* | peroxisome biosynthesis protein pas5. |
| CONTIG2462 | 6288182_c1_3 | 252 | 14355 | 831 | 277 | P33289 | 176 | 5.2(10)-11 | *Pichia pastoris* | peroxisome biosynthesis protein pas5. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5437 | 21985910_f3_8 | 253 | 14356 | 807 | 269 | P38759 | 409 | 5.5(10)-55 | *Saccharomyces cerevisiae* | pep11 protein. |
| CONTIG1216 | 22687682_c1_2 | 254 | 14357 | 903 | 301 | P37591 | 90 | 0.12 | *Salmonella typhimurium* | phosphoglycerate transport regulatory protein pgtc precursor. |
| CONTIG1009 | 11736666_c3_2 | 255 | 14358 | 1128 | 376 | P15245 | 636 | 7.9(10)-68 | *Trichosporon cutaneum* | phenol 2-monooxygenase (ec 1.14.13.7) (phenol hydroxylase). |
| CONTIG1779 | 21750252_c1_1 | 256 | 14359 | 579 | 193 | P15245 | 240 | 2.2(10)-19 | *Trichosporon cutaneum* | phenol 2-monooxygenase (ec 1.14.13.7) (phenol hydroxylase). |
| CONTIG2250 | 471040_c2_3 | 257 | 14360 | 1074 | 358 | P15245 | 590 | 1.8(10)-57 | *Trichosporon cutaneum* | phenol 2-monooxygenase (ec 1.14.13.7) (phenol hydroxylase). |
| CONTIG4933 | 24064692_f1_1 | 258 | 14361 | 3192 | 1064 | P17442 | 497 | 1.8(10)-72 | *Saccharomyces cerevisiae* | phosphate system positive regulatory protein pho81 (cdk inhibitor pho81). |
| CONTIG4933 | 14541562_f3_5 | 259 | 14362 | 591 | 197 | P17442 | 16 | 1.1(10)-11 | *Saccharomyces cerevisiae* | phosphate system positive regulatory protein pho81 (cdk inhibitor pho81). |
| CONTIG2620 | 6250_f3_2 | 260 | 14363 | 762 | 254 | P30887 | 128 | 3.0(10)-12 | *Yarrowia lipolytica* | acid phosphatase precursor (ec 3.1.3.2). |
| CONTIG5710 | 21679063_f1_2 | 261 | 14364 | 990 | 330 | P30887 | 556 | 7.2(10)-54 | *Yarrowia lipolytica* | acid phosphatase precursor (ec 3.1.3.2). |
| b1x13625.x | 24413917_f2_1 | 262 | 14365 | 237 | 79 | P43076 | 314 | 1.2(10)-27 | *Candida albicans* | ph responsive protein 1 precursor. |
| CONTIG2401 | 4694507_f2_3 | 263 | 14366 | 621 | 207 | P54677 | 94 | 0.08 | *Dichyostelium discoideum* | phosphatidylinositol 4-kinase (ec 2.7.1.67) (ptdins-4-kinase) (pi4k-alpha). |
| CONTIG5742 | 2_f3_15 | 264 | 14367 | 1602 | 534 | P46547 | 674 | 2.2(10)-66 | *Acromonas sobria* | proline iminopeptidase (ec 3.4.11.5) (prolyl aminopeptidase). |
| CONTIG261 | 1193951_c1_2 | 265 | 14368 | 711 | 237 | Q03178 | 344 | 2.1(10)-31 | *Saccharomyces cerevisiae* | pir1 protein precursor. |
| CONTIG321 | 20900277_f2_1 | 266 | 14369 | 537 | 179 | Q03178 | 275 | 4.2(10)-24 | *Saccharomyces cerevisiae* | pir1 protein precursor. |
| CONTIG2674 | 24641526_c1_4 | 267 | 14370 | 753 | 251 | Q03180 | 150 | 4.2(10)-9 | *Saccharomyces cerevisiae* | pir3 protein precursor. |
| CONTIG4408 | 900312_c2_5 | 268 | 14371 | 276 | 92 | Q03180 | 316 | 1.8(10)-28 | *Saccharomyces cerevisiae* | pir3 protein precursor. |
| CONTIG5438 | 23550277_f2_3 | 269 | 14372 | 927 | 309 | Q03180 | 151 | 1.3(10)-9 | *Saccharomyces cerevisiae* | pir3 protein precursor. |
| CONTIG2663 | 195900_c1_6 | 270 | 14373 | 906 | 302 | P14262 | 226 | 6.7(10)-19 | *Bacillus cereus* | 1-phosphatidylinositol phosphodiesterase precursor (ec 3.1.4.10) (phosphatidylinositol-specific phospholipase c) (pi-plc). |
| CONTIG4729 | 1960002_c2_8 | 271 | 14374 | 768 | 256 | P14262 | 211 | 3.2(10)-17 | *Bacillus cereus* | 1-phosphatidylinositol phosphodiesterase precursor (ec 3.1.4.10) (phosphatidylinositol-specific phospholipase c) (pi-plc). |
| CONTIG5819 | 9953410_c2_51 | 272 | 14375 | 912 | 304 | P08954 | 251 | 1.5(10)-21 | *Bacillus thuringiensis* | 1-phosphatidylinositol phosphodiesterase precursor (ec 3.1.4.10) (phosphatidylinositol-specific phospholipase c) (pi-plc). |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2658 | 20878327_f3_4 | 273 | 14376 | 621 | 207 | Q07066 | 117 | 1.2(10)-5 | Rattus norvegicus | 22 kd peroxisomal membrane protein. |
| CONTIG4228 | 9953916_f2_2 | 274 | 14377 | 1158 | 386 | P19881 | 505 | 1.8(10)-48 | Saccharomyces cerevisiae | 4-nitrophenylphosphatase (ec 3.1.3.41) (pnppase). |
| CONTIG5607 | 2743761_f2_3 | 275 | 14378 | 978 | 326 | P19881 | 499 | 7.9(10)-48 | Saccharomyces cerevisiae | 4-nitrophenylphosphatase (ec 3.1.3.41) (pnppase). |
| CONTIG4086 | 24257827_f1_1 | 276 | 14379 | 1794 | 598 | P27401 | 271 | 5.2(10)-20 | Simian foamy virus | pol polyprotein (contains: protease (ec 3.4.23.-); reverse transcriptase (ec 2.7.7.49); endonuclease). |
| CONTIG3273 | 23549091_c1_3 | 277 | 14380 | 1227 | 409 | P11976 | 134 | 1.8(10)-5 | Dictyostelium discoideum | prestalk protein precursor. |
| CONTIG4135 | 4391000_c3_14 | 278 | 14381 | 750 | 250 | P43078 | 633 | 5.0(10)-62 | Candida albicans | probable protein-tyrosine phosphatase (ec 3.1.3.48). |
| CONTIG3462 | 6051688_f1_1 | 279 | 14382 | 738 | 246 | P46030 | 1046 | 8.5(10)-106 | Candida albicans | peptide transporter ptr2. |
| CONTIG3462 | 35397630_f1_2 | 280 | 14383 | 447 | 149 | P46030 | 660 | 6.9(10)-65 | Candida albicans | peptide transporter ptr2. |
| CONTIG5662 | 22063750_c2_11 | 281 | 14384 | 798 | 266 | P46030 | 969 | 1.2(10)-97 | Candida albicans | peptide transporter ptr2. |
| CONTIG5277 | 12121001_f1_1 | 282 | 14385 | 1455 | 485 | P21304 | 1116 | 3.2(10)-113 | Saccharomyces cerevisiae | periodic tryptophan protein 1. |
| CONTIG5277 | 35160930_f2_5 | 283 | 14386 | 471 | 157 | P21304 | 314 | 1.3(10)-27 | Saccharomyces cerevisiae | periodic tryptophan protein |
| CONTIG4400 | 20367130_c2_7 | 284 | 14387 | 2481 | 827 | P25635 | 2564 | 1.2(10)-266 | Saccharomyces cerevisiae | periodic tryptophan protein 2. |
| CONTIG4400 | 11212511_c2_6 | 285 | 14388 | 255 | 85 | P25635 | 233 | 2.2(10)-18 | Saccharomyces cerevisiae | periodic tryptophan protein 2. |
| CONTIG5805 | 4565937_c3_44 | 286 | 14389 | 1350 | 450 | P32747 | 851 | 3.8(10)-85 | Schizosaccharomyces pombe | dihydroorotate dehydrogenase precursor (ec 1.3.3.1) (dihydroorotate oxidase) (dhodchase). |
| CONTIG3991 | 24625633_c2_10 | 287 | 14390 | 462 | 154 | P38230 | 112 | 4.4(10)-6 | Saccharomyces cerevisiae | putalive quinone oxidoreductase (ec 1.6.5.5) (nadph:quinone reductase) |
| CONTIG1000 | 14641562_f3_2 | 288 | 14391 | 798 | 266 | P43123 | 486 | 18(10)-46 | Saccharomyces cerevisiae | hypothetical 53.5 kd protein in pho2-pol3 intergenic region. |
| CONTIG722 | 15104049_c1_1 | 289 | 14392 | 708 | 236 | P43123 | 614 | 5.0(10)-60 | Saccharomyces cerevisiae | hypothetical 53.5 kd protein in pho2-pol3 intergenic region. |
| CONTIG3961 | 19941377_c1_4 | 290 | 14393 | 861 | 287 | P43124 | 307 | 1.7(10)-27 | Saccharomyces cerevisiae | hypothetical 46.1 kd protein in pho2-pol3 intergenic region. |
| CONTIG3081 | 26771927_f2_2 | 291 | 14394 | 1776 | 592 | P10563 | 145 | 1.6(10)-6 | Emericella nidulans | quinic acid utilization activator. |
| CONTIG5205 | 24648263_c1_3 | 292 | 14395 | 654 | 218 | P15325 | 91 | 0.11 | Emericella nidulans | quinate permease (quinate transporter). |
| CONTIG5535 | 875380_c3_26 | 293 | 14396 | 1314 | 438 | P15325 | 777 | 2.7(10)-77 | Emericella nidulans | quinate permease (quinate transporter). |
| CONTIG4158 | 21959653_f2_1 | 294 | 14397 | 1389 | 463 | Q00799 | 106 | 0.035 | Plasmodium vivax | reticulocyte binding protein 2 (fragment). |
| CONTIG4231 | 35979552_f1_2 | 295 | 14398 | 798 | 266 | Q09823 | 91 | 0.28999 | Schizosaccharomyces | meiotic recombination protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1116 | 4323388_f2_1 | 296 | 14399 | 357 | 119 | P06615 | 484 | 3.1(10)-46 | Escherichia coli | rec10. resolvase (protein d). |
| CONTIG4168 | 23494750_c3_6 | 297 | 14400 | 792 | 264 | P25560 | 281 | 3.6(10)-38 | Saccharomyces cerevisiae | rer1 protein. |
| CONTIG4253 | 21564705_f3_3 | 298 | 14401 | 873 | 291 | P13830 | 92 | 0.003 | Plasmodium falciparum antigen precursor. | ring-infected erythrocyte surface antigen precursor. |
| CONTIG89 | 480205_f3_1 | 299 | 14402 | 564 | 188 | P13830 | 98 | 0.019 | Plasmodium falciparum | ring-infected erythrocyte surface antigen precursor. |
| CONTIG2501 | 25672306_f3_3 | 300 | 14403 | 297 | 99 | P39083 | 171 | 1.0(10)-11 | Saccharomyces cerevisiae | rho-type gtpase activating protein rga1/dbm1. |
| CONTIG3656 | 30195212_c3_8 | 301 | 14404 | 1827 | 609 | P16664 | 119 | 2.6(10)-9 | Saccharomyces cerevisiae | reduced growth phenotype protein (rgp1 protein). |
| CONTIG5773 | 26603932_f3_17 | 302 | 14405 | 2133 | 711 | P16664 | 101 | 0.097 | Saccharomyces cerevisiae | reduced growth phenotype protein (rgp1 protein). |
| CONTIG5255 | 25426061_f1_1 | 303 | 14406 | 495 | 165 | P32445 | 129 | 1.3(10)-8 | Saccharomyces cerevisiae | mitochondrial single-stranded dna-binding protein rim1 precursor. |
| b1x13632.x | 4297187_c2_2 | 304 | 14407 | 486 | 162 | P11894 | 96 | 7.5(10)-5 | Pisum sativum | 50s ribosomal protein 19, chloroplast precursor (e113). |
| CONTIG4506 | 24222750_c1_14 | 305 | 14408 | 321 | 107 | P35996 | 133 | 4.7(10)-9 | Saccharomyces cerevisiae | mitochondrial 60s ribosomal protein 138 (yml38). |
| CONTIG2246 | 25578538_f3_1 | 306 | 14409 | 726 | 242 | Q03586 | 90 | 0.20999 | Thermoplasma acidophilum | dna-directed rna polymerase subunit a" (ec 2.7.7.6). |
| CONTIG5115 | 32603135_c2_15 | 307 | 14410 | 1611 | 537 | P14248 | 100 | 0.23999 | Plasmodium falciparum | dna-directed rna polymerase ii largest subunit (ec 2.7.7.6). |
| CONTIG5699 | 34382302_f2_13 | 308 | 14411 | 336 | 112 | P40422 | 224 | 1.1(10)-18 | Saccharomyces cerevisiae | dna-directed rna polymerases i, ii, and iii 7.7 kd polypeptide (abc10-alpha). |
| CONTIG4406 | 12581969_c1_3 | 309 | 14412 | 612 | 204 | P43332 | 290 | 1.1(10)-25 | Drosophila melanogaster | u1 small nuclear ribonucleoprotein a (u1 snrpp a protein) (sex determination protein snf). |
| CONTIG3563 | 12679588_c3_12 | 310 | 14413 | 192 | 64 | P22470 | 120 | 1.5(10)-6 | Saccharomyces cerevisiae | san1 protein. |
| CONTIG1198 | 6644592_c1_2 | 311 | 14414 | 882 | 294 | P43612 | 195 | 2.7(10)-14 | Saccharomyces cerevisiae | sit4-associating protein sap155. |
| CONTIG904 | 16484682_c2_3 | 312 | 14415 | 744 | 248 | P40856 | 97 | 0.062 | Saccharomyces cerevisiae | sit4-associating protein sap185. |
| CONTIG5203 | 29859687_f1_2 | 313 | 14416 | 912 | 304 | P34732 | 1361 | 3.6(10)-139 | Candida albicans | vesicular-fusium protein sec18. |
| CONTIG4696 | 4741260_c3_10 | 314 | 14417 | 1266 | 422 | P40075 | 335 | 1.8(10)-30 | Saccharomyces cerevisiae | scs2 protein. |
| CONTIG5771 | 26798553_c1_35 | 315 | 14418 | 2652 | 884 | P53009 | 480 | 5.7(10)-64 | Saccharomyces cerevisiae | scy1 prutein. |
| CONTIG5771 | 4842_c3_45 | 316 | 14419 | 249 | 83 | P53009 | 106 | 6.9(10)-5 | Saccharomyces cerevisiae | scy1 protein. |
| CONTIG1564 | 16460150_c3_7 | 317 | 14420 | 1245 | 415 | P11075 | 1003 | 6.0(10)-100 | Saccharomyces cerevisiae | protein transport protein sec7. |
| CONTIG4576 | 23836088_f1_1 | 318 | 14421 | 1476 | 492 | P11075 | 593 | 1.2(10)-99 | Saccharomyces cerevisiae | protein transport protein sec7. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x13e73.x | 23828931_c1_2 | 319 | 14422 | 699 | 233 | P11075 | 497 | 5.0(10)-46 | *Saccharomyces cerevisiae* | protein transport protein sec7. |
| CONTIG622 | 22267763_c2_1 | 320 | 14423 | 657 | 219 | P07856 | 100 | 0.0071 | *Bombyx mori* | sericin precursor. |
| CONTIG4510 | 5937751_fl_1 | 321 | 14424 | 372 | 124 | P43682 | 123 | 5.5(10)-8 | *Saccharomyces cerevisiae* | sft1 protein (p14). |
| CONTIG2934 | 15678317_f3_1 | 322 | 14425 | 705 | 235 | P51534 | 194 | 2.6(10)-14 | *Saccharomyces cerevisiae* | she4 protein. |
| CONTIG3277 | 25394788_fl_1 | 323 | 14426 | 1458 | 486 | P51534 | 220 | 2.0(10)-16 | *Saccharomyces cerevisiae* | she4 protein. |
| CONTIG5610 | 10547257_f3_6 | 324 | 14427 | 2658 | 886 | P40537 | 479 | 2.2(10)-42 | *Saccharomyces cerevisiae* | smt4 protein. |
| CONTIG4849 | 23650260_c2_6 | 325 | 14428 | 210 | 70 | P40204 | 147 | 1.6(10)-10 | *Saccharomyces cerevisiae* | small nuclear ribonucleoprotein e homolog snp2. |
| CONTIG2959 | 29382327_fl_1 | 326 | 14429 | 597 | 199 | P54705 | 91 | 0.13 | *Dictyostelium discoideum* | snwa protein. |
| CONTIG5167 | 14093817_c3_18 | 327 | 14430 | 978 | 326 | P24706 | 117 | 1.1(10)-6 | *Onchocerca volvulus* | superoxide dismutase (cu-zn)(ec 1.15.1.1). |
| b1x17876.y | 25578211_c2_2 | 328 | 14431 | 516 | 172 | P08866 | 836 | 1.5(10)-83 | *Escherichia coli* | sopa protein (protein a). |
| b1x11226.x | 21540701_c2_6 | 329 | 14432 | 483 | 161 | P08866 | 715 | 1.0(10)-70 | *Escherichia coli* | sopa protein (protein a). |
| b1x11226.x | 32619052_c1_5 | 330 | 14433 | 309 | 103 | P08867 | 436 | 3.7(10)-41 | *Escherichia coli* | sopb protein (protein b). |
| CONTIG5433 | 14570176_c2_10 | 331 | 14434 | 1107 | 369 | Q10088 | 763 | 8.3(10)-76 | *Schizosaccharomyces pombe* | putative agmatinase precursor (ec 3.5.3.11) (agmatine ureohydrolase) (auh). |
| CONTIG5672 | 26251313_c2_19 | 332 | 14435 | 1269 | 423 | Q10088 | 663 | 3.2(10)-65 | *Schizosaccharomyces pombe* | putative agmatinase precursor (ec 3.5.3.11) (agmatine ureohydrolase) (auh). |
| CONTIG3618 | 24509438_f2_2 | 333 | 14436 | 1065 | 355 | P38789 | 410 | 2.1(10)-38 | *Saccharomyces cerevisiae* | ssf1 protein. |
| CONTIG5811 | 13836588_f2_12 | 334 | 14437 | 1437 | 479 | P25344 | 290 | 2.7(10)-25 | *Saccharomyces cerevisiae* | ste50 protein. |
| CONTIG4795 | 23718818_c1_5 | 335 | 14438 | 1380 | 460 | P15705 | 1349 | 6.7(10)-138 | *Saccharomyces cerevisiae* | heat shock protein sti1. |
| CONTIG5567 | 14158153_f3_7 | 336 | 14439 | 1653 | 551 | P33300 | 809 | 1.1(10)-80 | *Saccharomyces cerevisiae* | sur1 protein. |
| CONTIG5164 | 2535912_c2_12 | 337 | 14440 | 588 | 196 | P35189 | 362 | 2.6(10)-33 | *Saccharomyces cerevisiae* | transcription initiation factor tfiif small subunit (transcription factor g 30 kd subunit) (anc1 protein). |
| CONTIG3505 | 554676_c3_5 | 338 | 14441 | 837 | 279 | P50273 | 106 | 0.00689 | *Saccharomyces cerevisiae* | tcm10 protein. |
| CONTIG2133 | 24414693_f2_2 | 339 | 14442 | 591 | 197 | P35691 | 618 | 1.8(10)-60 | *Saccharomyces cerevisiae* | translationally controlled tumor protein homolog (tctp). |
| CONTIG2919 | 12276817_c1_6 | 340 | 14443 | 1074 | 358 | P43072 | 1461 | 9.0(10)-150 | *Candida albicans* | transcription factor (tfiiib) (b-related factor) (brf). |
| CONTIG909 | 14648575_c2_4 | 341 | 14444 | 435 | 145 | P43072 | 507 | 1.1(10)-48 | *Candida albicans* | transcription factor (tfiiib) (b-related factor) (brf). |
| CONTIG5805 | 33594561_c1_28 | 342 | 14445 | 849 | 283 | Q07141 | 97 | 0.07499 | *Rattus norvegicus* | transducin-like enhancer protein 4 (esp2 protein). |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3813 | 1375450_f2_1 | 343 | 14446 | 813 | 271 | P50616 | 93 | 0.05099 | Homo sapiens | tob protein. |
| CONTIG1976 | 1054752_c1_2 | 344 | 14447 | 765 | 255 | P54006 | 357 | 8.8(10)-33 | Cochliobolus carbonum | toxd protein. |
| CONTIG4613 | 35803575_f3_2 | 345 | 14448 | 2082 | 694 | P52494 | 3512 | 0 | Candida albicans | neutral trehalase(ec 3.2.1.28) (alpha,alpha-trehalase) (alpha,alpha trehalose glucohydrolase). |
| b1x1814.2.y | 12131382_c1_3 | 346 | 14449 | 426 | 142 | P52494 | 378 | 6.2(10)-34 | Candida albicans | neutral trehalase(ec 3.2.1.28) (alpha,alpha-trehalase) (alpha,atpha trehalose glucohydrolase). |
| CONTIG4017 | 5164063_f1_1 | 347 | 14450 | 276 | 92 | P05476 | 162 | 4.0(10)-12 | Kluyveromyces lactis | dna-binding protein trf1 (terminal region recognition factor 1). |
| b2x11191.x | 24062515_c1_1 | 348 | 14451 | 585 | 195 | P43075 | 864 | 1.7(10)-86 | Candida albicans | tma ligase (ec 6.5.1.3). |
| CONTIG1170 | 6837803_f2_2 | 349 | 14452 | 381 | 127 | P43073 | 495 | 2.1(10)-47 | Candida albicans | n-(5'-phosphoribosyl)anthranilate isomerase (ec 5.3.1.24) (prai). |
| CONTIG2981 | 13065655_f2_2 | 350 | 14453 | 471 | 157 | P43073 | 552 | 1.8(10)-53 | Candida albicans | n-(5'-phosphoribosyl)anthranilate isomerase (ec 5.3.1.24) (prai). |
| CONTIG2310 | 12344063_c1_1 | 351 | 14454 | 1083 | 361 | P38069 | 452 | 7.5(10)-43 | Saccharomyces cerevisiae | ttp1 protein. |
| CONTIG3129 | 15785956_f2_1 | 352 | 14455 | 1242 | 414 | P38069 | 382 | 4.7(10)-35 | Saccharomyces cerevisiae | ttp1 protein. |
| CONTIG3321 | 4117760_c2_4 | 353 | 14456 | 699 | 233 | P38069 | 105 | 0.0038 | Saccharomyces cerevisiae | ttp1 protein. |
| CONTIG4184 | 22253500_c1_3 | 354 | 14457 | 1791 | 597 | P38069 | 614 | 5.0(10)-60 | Saccharomyces cerevisiae | ttp1 protein. |
| CONTIG5269 | 36363428_c2_10 | 355 | 14458 | 1776 | 592 | P38069 | 608 | 2.2(10)-59 | Saccharomyces cerevisiae | ttp1 protein. |
| b3x17645.y | 22861952_f2_1 | 356 | 14459 | 504 | 168 | P38069 | 238 | 2.8(10)-19 | Saccharomyces cerevisiae | ttp1 protein. |
| CONTIG5026 | 4172555_f3_5 | 357 | 14460 | 1965 | 655 | P36629 | 200 | 7.5(10)-13 | Schizosaccharomyces pombe | splicing factor u2af large subunit. |
| CONTIG1886 | 390875_c2_4 | 358 | 14461 | 852 | 284 | P48777 | 670 | 6.0(10)-66 | Emericella nidulans | purine permease. |
| CONTIG4810 | 24491437_c1_5 | 359 | 14462 | 1269 | 423 | P50101 | 602 | 1.2(10)-57 | Saccharomyces cerevisiae | putative ubiquitin carboxyl-terminal hydrolase ym9952.06 (ec 3.1.2.15) (ubiquitin thiolesterase) (ubiquitin-specific processing protease) (deubiquitinating enzyme). |
| CONTIG5048 | 6683068_c2_8 | 360 | 14463 | 1866 | 622 | P50101 | 312 | 2.7(10)-33 | Saccharomyces cerevisiae | putative ubiquitin carboxyl-terminal hydrolase ym9952.06 (ec 3.1.2.15) (ubiquitin thiolesterase) (ubiquitin-specific processing protease) (deubiquitinating enzyme). |
| CONTIG574 | 33492067_f2_1 | 361 | 14464 | 465 | 155 | P50101 | 280 | 3.2(10)-23 | Saccharomyces cerevisiae | putative ubiquitin carboxyl-terminal hydrolase ym9952.06 (ec 3.1.2.15) (ubiquitin-specific processing |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG67 | 23907956_c2_5 | 362 | 14465 | 753 | 251 | P50101 | 215 | 2.7(10)-16 | *Saccharomyces cerevisiae* | putative ubiquitin carboxyl-terminal hydrolase ym9952.06 (ec 3.1.2.15) (ubiquitin thiolesterase) (ubiquitin-specific processing protease) (deubiquitinating enzyme). |
| b9x11n21.y | 511450_f2_1 | 363 | 14466 | 600 | 200 | P50101 | 703 | 1.6(10)-68 | *Saccharomyces cerevisiae* | putative ubiquitin carboxyl-terminal hydrolase ym9952.06 (ec 3.1.2.15) (ubiquitin thiolesterase) (ubiquitin-specific processing protease) (deubiquitinating enzyme). |
| CONTIG1897 | 24492177_c3_3 | 364 | 14467 | 600 | 200 | P53874 | 476 | 9.5(10)-45 | *Saccharomyces cerevisiae* | putative ubiquitin carboxyl-terminal hydrolase ynl186w (ec 3.1.2.15) (ubiquitin thiolesterase) (ubiquitin-specific processing protease) (deubiquitinating enzyme). |
| CONTIG1897 | 25601635_c2_2 | 365 | 14468 | 708 | 236 | P53874 | 555 | 1.1(10)-53 | *Saccharomyces cerevisiae* | putative ubiquitin carboxyl-terminal hydrolase ynl186w (ec 3.1.2.15) (ubiquitin thiolesterase) (ubiquitin-specific processing protease) (deubiquitinating enzyme). |
| CONTIG3015 | 36125410_f3_3 | 366 | 14469 | 228 | 76 | P37299 | 131 | 7.7(10)-9 | *Saccharomyces cerevisiae* | ubiquinol-cytochrome c reductase complex 8.5 kd protein (ec 1.10.2.2) (complex iii polypeptide x). |
| CONTIG493 | 32119080_c3_5 | 367 | 14470 | 798 | 266 | P21374 | 170 | 5.7(10)-13 | *Saccharomyces cerevisiae* | utr3 protein (unknown transcript 3 protein). |
| CONTIG4116 | 12542632_f3_2 | 368 | 14471 | 942 | 314 | P40389 | 288 | 1.8(10)-25 | *Schizosaccharomyces pombe* | uv-induced protein uvi22. |
| CONTIG5568 | 14570138_c2_15 | 369 | 14472 | 1782 | 594 | Q01222 | 90 | 0.59999 | *Vaccinia virus* | protein b18. |
| CONTIG4594 | 34454133_c2_8 | 370 | 14473 | 1743 | 581 | P03739 | 96 | 0.016 | coliphage T4 | receptor recognizing protein (protein gp38). |
| CONTIG5422 | 6678576_c3_21 | 371 | 14474 | 1752 | 584 | Q00154 | 90 | 0.45 | Ictalurid herpesvirus I | hypothetical gene 66 protein. |
| CONTIG5558 | 20001260_f2_4 | 372 | 14475 | 813 | 271 | P28968 | 100 | 0.00479 | Equine herpesvirus I | glycoprotein x precursor. |
| CONTIG5313 | 20504025_c1_9 | 373 | 14476 | 369 | 123 | P02845 | 111 | 5.2(10)-5 | *Gallus gallus* | vitellogenin ii precursor (contains: lipovitellin; phosvitin). |
| CONTIG4187 | 22384417_c2_9 | 374 | 14477 | 414 | 138 | P48836 | 225 | 8.5(10)-19 | *Saccharomyces cerevisiae* | vacuolar atp synthase subunit m16 (ec 3.6.1.34) (v-atpase 13 kd subunit). |
| CONTIG2626 | 24023287_f2_1 | 375 | 14478 | 231 | 77 | P43074 | 161 | 5.2(10)-12 | *Candida albicans* | white colony protein wh11. |
| CONTIG2482 | 14462501_f2_1 | 376 | 14479 | 570 | 190 | P12611 | 239 | 1.3(10)-19 | *Saccharomyces cerevisiae* | growth regulation protein. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4814 | 245650_f3_8 | 377 | 14480 | 1227 | 409 | P34761 | 372 | 1.1(10)-33 | Saccharomyces cerevisiae | whi3 protein. |
| CONTIG3043 | 2243837_c3_12 | 378 | 14481 | 921 | 307 | Q09697 | 103 | 0.014 | Schizosaccharomyces pombe | hypothetical 88.2 kd protein c217.18c in chromosome i. |
| b1x17717.y | 1206528_f3_1 | 379 | 14482 | 600 | 200 | Q09710 | 92 | 0.07199 | Schizosaccharomyces pombe | hypothetical 49.6 kd protein c18b11.03c in chromosome i. |
| CONTIG5676 | 12192155_c3_24 | 380 | 14483 | 909 | 303 | Q09725 | 162 | 1.3(10)-8 | Schizosaccharomyces pombe | hypothetical 180.2 kd protein c31a2.05c in chromosome |
| CONTIG3055 | 281425_c3_4 | 381 | 14484 | 1500 | 500 | Q09731 | 317 | 5.4(10)-26 | Schizosaccharomyces pombe | hypothetical trp-asp repeats containing protein c31a2.14 in chromosome i. |
| CONTIG3735 | 13792302_f2_5 | 382 | 14485 | 783 | 261 | Q09739 | 126 | 2.2(10)-6 | Schizosaccharomyces pombe | hypothetical 24.2 kd protein c13a11.03 in chromosome i. |
| CONTIG2846 | 6127280_f1_1 | 383 | 14486 | 1143 | 381 | Q09764 | 389 | 4.5(10)-35 | Schizosaccharomyces pombe | hypothetical 107.1 kd protein c24h6.11c in chromosome i. |
| CONTIG3265 | 4860177_c1_1 | 384 | 14487 | 1281 | 427 | Q09766 | 553 | 4.4(10)-66 | Schizosaccharomyces pombe | hypothetical 98.4 kd protein c24h6.13 in chromosome i. |
| b1x11338.x | 2239043_f1_1 | 385 | 14488 | 807 | 269 | Q09766 | 560 | 9.0(10)-54 | Schizosaccharomyces pombe | hypothetical 98.4 kd protein c24h6.13 in chromosome i. |
| CONTIG4316 | 26370187_c3_8 | 386 | 14489 | 1815 | 605 | Q09778 | 187 | 5.9(10)-11 | Schizosaccharomyces pombe | hypothetical 103.4 kd protein c22f3.13 in chromosome i. |
| CONTIG3575 | 11734755_c3_8 | 387 | 14490 | 1533 | 511 | Q09795 | 458 | 1.7(10)-43 | Schizosaccharomyces pombe | hypothetical protein c22g7.01c in chromosome i (fragment). |
| CONTIG5448 | 14656328_c3_20 | 388 | 14491 | 1137 | 379 | P31381 | 274 | 1.8(10)-33 | Saccharomyces cerevisiae | hypothetical 58.3 kd protein in pmt2-ccr4 intergenic region. |
| CONTIG4740 | 19546930_c1_12 | 389 | 14492 | 2001 | 667 | P39730 | 1076 | 1.5(10)-114 | Saccharomyces cerevisiae | 112.3 kd protein in pyk1-snc1 intergenic region. |
| b3x19243.x | 12144380_f3_3 | 390 | 14493 | 888 | 296 | P39730 | 496 | 1.6(10)-46 | Saccharomyces cerevisiae | 112.3 kd protein in pyk1-snc1 intergenic region. |
| CONTIG5803 | 32454376_c2_27 | 391 | 14494 | 1773 | 591 | Q09833 | 610 | 1.3(10)-59 | Schizosaccharomyces pombe | hypothetical 59.6 kd protein c4g8.07c in chromosome i. |
| CONTIG5514 | 30111260_f1_1 | 392 | 14495 | 954 | 318 | Q09731 | 208 | 5.4(10)-17 | Saccharomyces cerevisiae | hypothetical 33.2 kd protein in pyk1-snc1 intergenic region. |
| CONTIG2478 | 3925307_c2_5 | 393 | 14496 | 1023 | 341 | P39727 | 560 | 2.7(10)-54 | Saccharomyces cerevisiae | hypothetical 46.3 kd protein in pta1-cdc24 intergenic region. |
| CONTIG5040 | 2382188_f1_3 | 394 | 14497 | 642 | 214 | P39727 | 319 | 9.4(10)-29 | Saccharomyces cerevisiae | hypothetical 46.3 kd protein in pta1-cdc24 intergenic region. |
| CONTIG5405 | 26367963_f2_1 | 395 | 14498 | 240 | 80 | P39727 | 249 | 5.7(10)-21 | Saccharomyces cerevisiae | hypothetical 46.3 kd protein in pta1-cdc24 intergenic region. |
| CONTIG64366 | 32225063_f1_1 | 396 | 14499 | 1542 | 514 | P39722 | 1001 | 2.7(10)-145 | Saccharomyces cerevisiae | hypothetical 75.2 kd protein in pta1-cdc24 intergenic region. |
| CONTIG3023 | 35156567_c2_3 | 397 | 14500 | 657 | 219 | P39721 | 621 | 9.3(10)-61 | Saccharomyces cerevisiae | hypothetical 27.1 kd protein in acs1-gcv3 intergenic region. |
| CONTIG3635 | 993925_c3_5 | 398 | 14501 | 756 | 252 | P39721 | 642 | 5.5(10)-63 | Saccharomyces cerevisiae | hypothetical 27.1 kd protein in acs1-gcv3 intergenic region. |
| CONTIG5064 | 7056255_f3_3 | 399 | 14502 | 1503 | 501 | P39719 | 759 | 5.7(10)-88 | Saccharomyces cerevisiae | hypothetical 87.5 kd protein in acs1-gcv3 intergenic region. |
| CONTIG5747 | 4507828_c1_32 | 400 | 14503 | 4209 | 1403 | Q09863 | 132 | 7.5(10)-15 | Schizosaccharomyces cerevisiae | hypothetical 122.9 kd protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5058 | 25431575_c1_4 | 401 | 14504 | 837 | 279 | Q09875 | 205 | 5.7(10)-22 | Schizosaccharomyces pombe | hypothetical 35.8kd protein c12g12.12 in chromosome i. |
| CONTIG4920 | 21883432_c3_12 | 402 | 14505 | 711 | 237 | Q09876 | 329 | 2.0(10)-28 | Schizosaccharomyces pombe | hypothetical 143.3 kd trp-asp repeats containing protein c12g12.13c in chromosome i. |
| CONTIG612 | 35253213_c2_3 | 403 | 14506 | 915 | 305 | P39705 | 104 | 0.00719 | Saccharomyces cerevisiae | hypothetical 59.0 kd protein in 1fc3-rfa1 intergenic region. |
| CONTIG1201 | 3257650_f2_1 | 404 | 14507 | 852 | 284 | Q09885 | 548 | 5.0(10)-53 | Schizosaccharomyces pombe | hypothetical 43.0 kd protein c8a4.09c in chromosome i. |
| CONTIG4243 | 10632925_f2_1 | 405 | 14508 | 1122 | 374 | Q09887 | 690 | 4.5(10)-68 | Schizosaccharomyces pombe | hypothetical amino-acid permease c8a4.11. |
| CONTIG5363 | 24259527_c2_21 | 406 | 14509 | 1647 | 549 | P27637 | 138 | 6.9(10)-11 | Saccharomyces cerevisiae | hypothetical 78.3 kd protein in rfa1 ade1 intergenic region. |
| CONTIG3920 | 23476535_f3_2 | 407 | 14510 | 702 | 234 | P46683 | 354 | 1.8(10)-32 | Saccharomyces cerevisiae | ankyrin repeat-containing protein yar1. |
| CONTIG4130 | 14100652_c1_7 | 408 | 14511 | 1275 | 425 | Q10138 | 165 | 1.3(10)-9 | Schizosaccharomyces pombe | hypothetical 51.5 kd protein c5h8.02 in chromosome i. |
| CONTIG5576 | 10970251_c2_19 | 409 | 14512 | 1830 | 610 | P18634 | 120 | 0.00044 | Saccharomyces cerevisiae | hypothetical 24.4 kd protein in atp10 region. |
| CONTIG5790 | 2109436_f3_15 | 410 | 14513 | 732 | 244 | Q10154 | 184 | 1.8(10)-14 | Schizosaccharomyces pombe | hypothetical 27.1 kd protcili c1d4.09c in chromosome i. |
| CONTIG3744 | 4875077_f3_5 | 411 | 14514 | 225 | 75 | Q10167 | 159 | 8.4(10)-12 | Schizosaccharomyces pombe | hypothetical 8.2 kd protein c26a1.14c in chromosome i. |
| CONTIG1323 | 2239550_c3_8 | 412 | 14515 | 1098 | 366 | Q10168 | 114 | 0.0006 | Schizosaccharomyces pombe | hypothetical 60.7 kd protein c26a3.15c in chromosome i. |
| CONTIG5342 | 1069015_c2_19 | 413 | 14516 | 534 | 178 | Q10191 | 242 | 2.2(10)-20 | Schizosaccharomyces pombe | hypothetical 44.5 kd protein c3f10.17 in chromosome i. |
| CONTIG5042 | 10554561_f1_1 | 414 | 14517 | 744 | 248 | Q10193 | 92 | 0.00048 | Schizosaccharomyces pombe | hypothetical protein c13f4.01c in chromosome i (fragment). |
| CONTIG68 | 24081533_f3_1 | 415 | 14518 | 333 | 111 | Q10220 | 91 | 0.00013 | Schizosaccharomyces pombe | hypothetical 10.1 kd protein c4h3.13 in chromosome i. |
| CONTIG5080 | 21675012_f2_3 | 416 | 14519 | 321 | 107 | Q10225 | 145 | 2.5(10)-9 | Schizosaccharomyces pombe | hypothetical 60.5 kd protein c13d6.04c in chromosome i. |
| b2x17307.y | 24398337_f2_1 | 417 | 14520 | 498 | 166 | P38281 | 154 | 9.1(10)-11 | Saccharomyces cerevisiae | hypothetical 35.8 kd protein in ysw1-rib7 intergenic region. |
| b9x13n27.y | 11191300_f1_1 | 418 | 14521 | 819 | 273 | P38285 | 119 | 7.2(10)-5 | Saccharomyces cerevisiae | hypothetical 62.7 kd protein in rpb5-cdc28 intergenic region. |
| CONTIG2095 | 22298932_c1_2 | 419 | 14522 | 1110 | 370 | P38288 | 286 | 3.6(10)-50 | Saccharomyces cerevisiae | hypothetical 48.0 kd protein in cdc28-ar11 intergenic region precursor. |
| b1x14474.y | 4900756_f2_1 | 420 | 14523 | 342 | 114 | P38288 | 163 | 2.2(10)-11 | Saccharomyces cerevisiae | hypothetical 48.0 kd protein in cdc28-ar11 intergenic region precursor. |
| CONTIG5404 | 3939136_f2_4 | 421 | 14524 | 717 | 239 | P38289 | 129 | 7.0(10)-6 | Saccharomyces cerevisiae | hypothetical 67.6 kd protein in cdc28-ar11 intergenic region. |
| CONTIG5404 | 24064718_f3_5 | 422 | 14525 | 1230 | 410 | P38289 | 378 | 1.1(10)-34 | Saccharomyces cerevisiae | hypothetical 67.6 kd protein in cdc28-ar11 intergenic region. |
| CONTIG498 | 14554632_f1_1 | 423 | 14526 | 540 | 180 | P38291 | 187 | 9.0(10)-15 | Saccharomyces cerevisiae | hypothetical 15.8 kd protein in tyr1- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5571 | 6915705_f1_3 | 424 | 14527 | 447 | 149 | P38293 | 343 | 2.7(10)-31 | Saccharomyces cerevisiae | hypothetical 16.8 kd protein in sse2 intergenic region. |
| CONTIG5613 | 4861502_c3_23 | 425 | 14528 | 1296 | 432 | P38295 | 573 | 1.1(10)-55 | Saccharomyces cerevisiae | hypothetical 51.3 kd protein in smy2-rps101 intergenic region. |
| CONTIG4141 | 4296930_f1_1 | 426 | 14529 | 2109 | 703 | P38297 | 1015 | 5.5(10)-113 | Saccharomyces cerevisiae | hypothetical 978 kd protein in smy2-rps101 intergenic region. |
| CONTIG4848 | 10172502_c2_6 | 427 | 14530 | 969 | 323 | P38301 | 497 | 1.3(10)-47 | Saccharomyces cerevisiae | hypothetical 30.3 kd protein in mba1-rps13 intergenic region. |
| CONTIG1093 | 4085177_c3_4 | 428 | 14531 | 732 | 244 | P38304 | 263 | 8.0(10)-23 | Saccharomyces cerevisiae | hypothetical 25.3 kd protein in rim2-msi1 intergenic region. |
| CONTIG2021 | 55413_c1_3 | 429 | 14532 | 381 | 127 | P38310 | 183 | 1.6(10)-13 | Saccharomyces cerevisiae | hypothetical 51.5 kd protein in ktr3-dur1,2 intergenic region. |
| CONTIG2021 | 4323579_c1_2 | 430 | 14533 | 300 | 100 | P38310 | 292 | 1.3(10)-25 | Saccharomyces cerevisiae | hypothetical 51.5 kd protein in ktr3-dur1,2 intergenic region. |
| CONTIG3770 | 14853256_f1_1 | 431 | 14534 | 1560 | 520 | P38310 | 539 | 4.9(10)-62 | Saccharomyces cerevisiae | hypothetical 51.5 kd protein in ktr3-dur1,2 intergenic region. |
| CONTIG4869 | 36379191_f1_1 | 432 | 14535 | 1890 | 630 | P38314 | 748 | 3.2(11))-74 | Saccharomyces cerevisiae | hypothetical 57.2 kd protein in met8-hpc2 intergenic region. |
| CONTIG5078 | 10253375_f1_2 | 433 | 14536 | 1374 | 458 | P38315 | 230 | 3.7(10)-28 | Saccharomyces cerevisiae | hypothetical 77.7 kd protein in hpc2-pyc2 intergenic region. |
| CONTIG5078 | 10972792_c2_9 | 434 | 14537 | 501 | 167 | P38316 | 210 | 3.2(10)-17 | Saccharomyces cerevisiae | hypothetical 21.1 kd protein in hpc2-pyc2 intergenic region. |
| CONTIG2756 | 4081257_c1_3 | 435 | 14538 | 849 | 283 | P38318 | 516 | 1.2(10)-49 | Saccharomyces cerevisiae | hypothetical 63.0 kd protein in pyc2-pdb1 intergenic region. |
| CONTIG5462 | 23632937_c1_9 | 436 | 14539 | 909 | 303 | P38324 | 371 | 1.2(10)-39 | Saccharomyces cerevisiae | hypothetical 35.9 kd protein in pcs60-abd1 intergenic region. |
| CONTIG5481 | 34567136_c3_17 | 437 | 14540 | 1038 | 346 | P38326 | 261 | 1.3(10)-22 | Saccharomyces cerevisiae | hypothetical 34.3 kd protein in pcs60-abd1 intergenic region. |
| CONTIG4802 | 1432318_f1_1 | 438 | 14541 | 1200 | 400 | P38355 | 954 | 4.7(10)-96 | Saccharomyces cerevisiae | hypothetical 47.5 kd protein in ape3-apm3 intergenic region. |
| CONTIG5783 | 33367952_c2_32 | 439 | 14542 | 1341 | 447 | P38355 | 1025 | 1.3(10)-103 | Saccharomyces cerevisiae | hypothetical 47.5 kd protein in ape3-apm3 intergenic region. |
| CONTIG4478 | 26363125_f2_3 | 440 | 14543 | 261 | 87 | P38331 | 174 | 2.2(10)-13 | Saccharomyces cerevisiae | hypothetical 27.6 kd protein in prp5-alg7 intergenic region. |
| CONTIG4214 | 1190687_c3_12 | 441 | 14544 | 1080 | 360 | P38332 | 479 | 4.9(10)-68 | Saccharomyces cerevisiae | hypothetical 43.3 kd protein in alg7-emp1 intergenic region. |
| CONTIG5028 | 24885077_c2_13 | 442 | 14545 | 1323 | 441 | P38335 | 211 | 3.3(10)-14 | Saccharomyces cerevisiae | hypothetical 79.0 kd protein in srb6-rib5 intergenic region. |
| CONTIG5469 | 33753201_c1_9 | 443 | 14546 | 327 | 109 | P38336 | 129 | 4.0(10)-8 | Saccharomyces cerevisiae | hypothetical 32.9 kd protein in rib5 shm1 intergenic region. |
| CONTIG3946 | 34085811_f2_1 | 444 | 14547 | 825 | 275 | P38337 | 93 | 0.00389 | Saccharomyces cerevisiae | hypothetical 16.4 kd protein in rib5 shm1 intergenic region. |
| CONTIG3003 | 14148263_f1_2 | 445 | 14548 | 723 | 241 | P38339 | 329 | 5.4(10)-29 | Saccharomyces cerevisiae | hypothetical 74.6 kd protein in rib5 shm1 intergenic region. |
| CONTIG3946 | 36620632_c1_4 | 446 | 14549 | 510 | 170 | P38339 | 279 | 1.3(10)-23 | Saccharomyces cerevisiae | hypothetical 74.6 kd protein in rib5 shm1 intergenic region. |
| CONTIG3946 | 34687_c3_5 | 447 | 14550 | 939 | 313 | P38339 | 229 | 1.0(10)-24 | Saccharomyces cerevisiae | hypothetical 74.6 kd protein in rib5 shm1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4811 | 16900307_f1_1 | 448 | 14551 | 735 | 245 | P38340 | 660 | 6.9(10)-65 | Saccharomyces cerevisiae | hypothetical 26.1 kd protein in rib5-shm1 intergenic region. |
| CONTIG5801 | 4297816_c1_26 | 449 | 14552 | 969 | 323 | P38342 | 458 | 1.7(10)-43 | Saccharomyces cerevisiae | hypothetical 36.0 kd protein in shm1-mrpl37 intergenic region. |
| CONTIG2744 | 7159681_f1_1 | 450 | 14553 | 1356 | 452 | P38344 | 558 | 4.4(10)-54 | Saccharomyces cerevisiae | 34.7 kd protein in shm1-mrpl37 intergenic region. |
| CONTIG5819 | 4406952_f3_18 | 451 | 14554 | 420 | 140 | P38345 | 226 | 6.7(10)-19 | Saccharomyces cerevisiae | hypothetical 14.6 kd protein in mrpl37-rif1 intergenic region. |
| CONTIG4670 | 898581_f1_3 | 452 | 14555 | 1053 | 351 | P38348 | 114 | 0.00071 | Saccharomyces cerevisiae | hypothetical 55.5 kd protein in mrpl37-rif1 intergenic region. |
| CONTIG3998 | 34022010_f1_1 | 453 | 14556 | 1290 | 430 | P38349 | 331 | 5.0(10)-30 | Saccharomyces cerevisiae | hypothetical 50.0 kd protein in mrpl37-rif1 intergenic region. |
| CONTIG5423 | 10839692_c1_8 | 454 | 14557 | 183 | 61 | P38149 | 147 | 3.2(10)-9 | Saccharomyces cerevisiae | hypothetical trp-asp repeats containing protein in paf1-mrpl27 intergenic region. |
| CONTIG5423 | 556313_c2_13 | 455 | 14558 | 285 | 95 | P38149 | 106 | 7.7(10)-5 | Saccharomyces cerevisiae | hypothetical trp-asp repeats containing protein in paf1-mrpl27 intergenic region. |
| CONTIG5423 | 25584437_c3_14 | 456 | 14559 | 1038 | 346 | P38149 | 568 | 1.2(10)-54 | Saccharomyces cerevisiae | hypothetical trp-asp repeats containing protein in paf1-mrpl27 intergenic region. |
| CONTIG5423 | 19550376_c1_7 | 457 | 14560 | 1857 | 619 | P38149 | 276 | 8.5(10)-43 | Saccharomyces cerevisiae | hypothetical trp-asp repeats containing protein in paf1-mrpl27 intergenic region. |
| CONTIG1240 | 6642128_f1_1 | 458 | 14561 | 969 | 323 | P35194 | 229 | 2.1(10)-17 | Saccharomyces cerevisiae | hypothetical 287.5 kd protein in pdr3-hta2 intergenic region. |
| CONTIG3591 | 189089_f1_1 | 459 | 14562 | 1788 | 596 | P35194 | 697 | 3.7(10)-67 | Saccharomyces cerevisiae | hypothetical 287.5 kd protein in pdr3-hta2 intergenic region. |
| CONTIG5173 | 24423500_c3_5 | 460 | 14563 | 3699 | 1233 | P35194 | 2065 | 4.2(10)-243 | Saccharomyces cerevisiae | hypothetical 287.5 kd protein in pdr3-hta2 intergenic region. |
| CONTIG3222 | 24414042_c2_10 | 461 | 14564 | 1089 | 363 | P38207 | 531 | 3.2(10)-51 | Saccharomyces cerevisiae | hypothetical 59.4 kd protein in rft1-pep1 intergenic region. |
| CONTIG4194 | 26370812_c1_6 | 462 | 14565 | 996 | 332 | P38201 | 160 | 2.5(10)-9 | Saccharomyces cerevisiae | hypothetical 42.6 kd protein in aac2-rpl19 intergenic region. |
| CONTIG3680 | 33214025_f3_4 | 463 | 14566 | 807 | 269 | P38197 | 596 | 4.2(10)-58 | Saccharomyces cerevisiae | hypothetical 29.1 kd protein in ura7-pol12 intergenic region. |
| b1x18501.y | 23719125_c2_2 | 464 | 14567 | 483 | 161 | P39519 | 382 | 2.0(10)-35 | Saccharomyces cerevisiae | hypothetical protein in bdf1 5'region (orf1) (fragment). |
| CONTIG3776 | 26298305_c3_7 | 465 | 14568 | 1425 | 475 | P34216 | 284 | 1.1(10)-22 | Saccharomyces cerevisiae | hypothetical 150.8 kd protein in sec17-qcr1 intergenic region. |
| CONTIG5621 | 14475260_c1_15 | 466 | 14569 | 1335 | 445 | P34216 | 621 | 1.5(10)-59 | Saccharomyces cerevisiae | hypothetical 150.8 kd protein in sec17-qcr1 intergenic region. |
| CONTIG5677 | 1382888_c2_23 | 467 | 14570 | 435 | 145 | P34216 | 200 | 1.3(10)-14 | Saccharomyces cerevisiae | hypothetical 150.8 kd protein in sec17-qcr1 intergenic region. |
| CONTIG2781 | 4331300_c3_3 | 468 | 14571 | 726 | 242 | P38191 | 191 | 3.3(10)-15 | Saccharomyces cerevisiae | hypothetical 16.1 kd protein in sec17-qcr1 intergenic region. |
| CONTIG2936 | 20370436_f3_8 | 469 | 14572 | 1050 | 350 | P34217 | 284 | 4.0(10)-24 | Saccharomyces cerevisiae | hypothetical 73.8 kd protein in shp1-sec17 intergenic region. |
| b9x12z33.y | 5313175_c2_1 | 470 | 14573 | 525 | 175 | P34222 | 282 | 7.7(10)-25 | Saccharomyces cerevisiae | hypothetical 23.1 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5255 | 35406261_c1_6 | 471 | 14574 | 402 | 134 | P38182 | 463 | 5.2(10)-44 | Saccharomyces cerevisiae | hypothetical 13.6 kd protein in shp1-sec17 intergenic region. |
| CONTIG3087 | 33414832_c2_5 | 472 | 14575 | 1026 | 342 | P38177 | 103 | 1.7(10)-9 | Saccharomyces cerevisiae | hypothetical 52.0 kd protein in nup170-ils1 intergenic region. |
| CONTIG3872 | 13678753_f2_3 | 473 | 14576 | 603 | 201 | P38175 | 139 | 1.1(10)-9 | Saccharomyces cerevisiae | hypothetical 20.4 kd protein in rpl17a-bob1 intergenic region. |
| CONTIG1584 | 11171932_f3_4 | 474 | 14577 | 525 | 175 | P53716 | 208 | 5.4(10)-17 | Candida albicans | hypothetical protein in map2-tel1 intergenic region. |
| CONTIG4974 | 26550_c1_11 | 475 | 14578 | 1983 | 661 | P38170 | 358 | 13(10)-60 | Saccharomyces cerevisiae | hypothetical 83.0 kd protein in whs11 5'region (fragment). |
| CONTIG4344 | 34581312_c2_9 | 476 | 14579 | 1443 | 481 | P38169 | 1094 | 7.0(10)-111 | Saccharomyces cerevisiae | hypothetical 52.4 kd protein in atp1-rox3 intergenic region precursor. |
| CONTIG3397 | 1415962_c1_3 | 477 | 14580 | 762 | 254 | P38167 | 128 | 2.6(10)-5 | Saccharomyces cerevisiae | hypothetical 119.3 kd protein in sft2-atp1 intergenic region. |
| CONTIG717 | 24251437_c3_3 | 478 | 14581 | 213 | 71 | P38167 | 128 | 4.4(10)-7 | Saccharomyces cerevisiae | hypothetical 119.3 kd protein in sft2-atp1 intergenic region. |
| CONTIG5740 | 9765625_f1_5 | 479 | 14582 | 1719 | 573 | P38164 | 357 | 5.5(10)-46 | Saccharomyces cerevisiae | hypothetical 104.7 kd protein in pkc1-rtg3 intergenic region. |
| CONTIG4783 | 34432691_f2_2 | 480 | 14583 | 1338 | 446 | P38163 | 410 | 2.8(10)-37 | Saccharomyces cerevisiae | hypothetical 111.7 kd protein in pkc1 5'region. |
| b3x16024.y | 25985783_c2_4 | 481 | 14584 | 588 | 196 | P38163 | 192 | 6.0(10)-14 | Saccharomyces cerevisiae | hypothetical 111.7 kd protein in pkc1 5'region. |
| CONTIG5780 | 4429752_f3_22 | 482 | 14585 | 555 | 185 | P38162 | 212 | 2.0(10)-17 | Saccharomyces cerevisiae | hypothetical 23.0 kd protein in pkc1 5'region. |
| CONTIG2040 | 32476457_f2_2 | 483 | 14586 | 393 | 131 | P38211 | 238 | 1.2(10)-19 | Saccharomyces cerevisiae | hypothetical 50.8 kd protein ii coq1-hhf1 intergenic region precursor. |
| CONTIG2045 | 19565750_c1_2 | 484 | 14587 | 729 | 243 | P38212 | 231 | 2.0(10)-19 | Saccharomyces cerevisiae | hypothetical 23.9 kd protein in coq1-hhf1 intergenic region. |
| CONTIG1288 | 23558305_c2_2 | 485 | 14588 | 603 | 201 | P38213 | 93 | 0.00012 | Saccharomyces cerevisiae | hypothetical 82.4 kd protein in coq1-hhf1 intergenic region. |
| CONTIG5357 | 2460390_c1_17 | 486 | 14589 | 564 | 188 | P38218 | 191 | 1.3(10)-25 | Saccharomyces cerevisiae | hypothetical 19.9 kd protein in fur4-chs3 intergenic region. |
| CONTIG334 | 4884687_c2_1 | 487 | 14590 | 801 | 267 | P38219 | 819 | 9.6(10)-82 | Saccharomyces cerevisiae | hypothetical 44.2 kd protein in sco2-mrf1 intergenic region. |
| CONTIG5653 | 10946932_c1_14 | 488 | 14591 | 1227 | 409 | P38222 | 249 | 4.5(10)-19 | Saccharomyces cerevisiae | hypothetical 62.6 kd protein in cds1-rp12 intergenic region. |
| b9x11364.x | 157830_c2_1 | 489 | 14592 | 594 | 198 | P38235 | 121 | 1.0(10)-11 | Saccharomyces cerevisiae | hypothetical 40.3 kd protein in reb1-yro2 intergenic region. |
| CONTIG4967 | 24296902_c1_9 | 490 | 14593 | 585 | 195 | P38239 | 169 | 7.4(10)-13 | Saccharomyces cerevisiae | hypothetical 13.2 kd protein in orc2-tip1 intergenic region. |
| CONTIG5566 | 2346901_c1_24 | 491 | 14594 | 927 | 309 | P38241 | 213 | 3.6(10)-17 | Saccharomyces cerevisiae | hypothetical 40.9 kd protein in orc2-tip1 intergenic region. |
| CONTIG5501 | 4788913_c3_33 | 492 | 14595 | 828 | 276 | P38244 | 278 | 4.7(10)-37 | Saccharomyces cerevisiae | hypothetical 47.8 kd protein in hsp26-sec18 intergenic region |
| CONTIG2050 | 21964140_c3_8 | 493 | 14596 | 624 | 208 | P38245 | 173 | 1.8(10)-12 | Saccharomyces cerevisiae | hypothetical 51.6 kd protein in hsp26-sec18 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG215 | 26611657_c3_6 | 494 | 14597 | 561 | 187 | P38245 | 109 | 0.0002 | Saccharomyces cerevisiae | hypothetical 51.6 kd protein in hsp26-sec18 intergenic region. |
| CONTIG5460 | 30553265_c1_18 | 495 | 14598 | 306 | 102 | P38245 | 98 | 0.00024 | Saccharomyces cerevisiae | hypothetical 51.6 kd protein in hsp26-sec18 intergenic region. |
| CONTIG5687 | 10632066_c1_16 | 496 | 14599 | 645 | 215 | P38245 | 140 | 2.3(10)-11 | Saccharomyces cerevisiae | hypothetical 51.6 kd protein in hsp26-sec18 intergenic region. |
| CONTIG4124 | 12207001_f1_2 | 497 | 14600 | 1158 | 386 | P38249 | 517 | 7.5(10)-78 | Saccharomyces cerevisiae | hypothetical 110.3 kd protein in hsp26-sec18 intergenic region. |
| CONTIG4124 | 24650176_f2_4 | 498 | 14601 | 918 | 306 | P38249 | 210 | 6.7(10)-16 | Saccharomyces cerevisiae | hypothetical 110.3 kd protein in hsp26-sec18 intergenic region. |
| CONTIG2716 | 24648467_c3_6 | 499 | 14602 | 750 | 250 | P38249 | 239 | 5.4(10)-19 | Saccharomyces cerevisiae | hypothetical 110.3 kd protein in hsp26-sec18 intergenic region. |
| CONTIG424 | 10973926_c3_3 | 500 | 14603 | 780 | 260 | P38254 | 570 | 2.3(10)-55 | Saccharomyces cerevisiae | hypothetical 86.4 kd protein in pho5-vps15 intergenic region. |
| CONTIG3278 | 3916250_c3_6 | 501 | 14604 | 783 | 261 | P38256 | 395 | 8.3(10)-37 | Saccharomyces cerevisiae | hypothetical 27.1 kd protein in pho5-vps15 intergenic region. |
| CONTIG3786 | 26679002_c2_2 | 502 | 14605 | 423 | 141 | P38260 | 108 | 9.1(10)-6 | Saccharomyces cerevisiae | hypothetical 32.6 kd protein in vps15-ymc2 intergenic region. |
| CONTIG3316 | 26428175_c3_4 | 503 | 14606 | 1848 | 616 | P38261 | 223 | 2.8(10)-25 | Saccharomyces cerevisiae | hypothetical 85.5 kd protein in vps15-ymc2 intergenic region. |
| CONTIG4278 | 22351430_f3_5 | 504 | 14607 | 1428 | 476 | P38263 | 222 | 2.2(10)-20 | Saccharomyces cerevisiae | hypothetical 41.2 kd protein in ymc2-cmd1 intergenic region. |
| CONTIG3715 | 9866261_c3_6 | 505 | 14608 | 597 | 199 | P38264 | 563 | 1.3(10)-54 | Saccharomyces cerevisiae | hypothetical 21.1 kd protein in ymc2-cmd1 intergenic region. |
| CONTIG4986 | 477290_f3_5 | 506 | 14609 | 225 | 75 | P38276 | 158 | 1.1(10)-11 | Saccharomyces cerevisiae | hypothetical 20.5 kd protein in csr1-ira1 intergenic region. |
| CONTIG3089 | 9765718_f3_2 | 507 | 14610 | 753 | 251 | P38278 | 388 | 4.5(10)-36 | Saccharomyces cerevisiae | hypothetical 38.5 kd protein in mak5 intergenic region. |
| CONTIG2092 | 2734652_f1_1 | 508 | 14611 | 1020 | 340 | P38279 | 617 | 2.5(10)-60 | Saccharomyces cerevisiae | hypothetical 33.5 kd protein in mrps9-ysw1 intergenic region. |
| CONTIG4650 | 23648387_c2_9 | 509 | 14612 | 1068 | 356 | P38279 | 226 | 5.2(10)-28 | Saccharomyces cerevisiae | hypothetical 33.5 kd protein in mrps9-ysw1 intergenic region. |
| CONTIG1652 | 6664067_f1_1 | 510 | 14613 | 297 | 99 | P38279 | 117 | 1.1(10)-6 | Saccharomyces cerevisiae | hypothetical 35.8 kd protein in nfs1-bud3 intergenic region. |
| CONTIG3851 | 12531386_f1_3 | 511 | 14614 | 498 | 166 | P25559 | 115 | 1.8(10)-5 | Saccharomyces cerevisiae | hypothetical 35.8 kd protein in nfs1-bud3 intergenic region. |
| CONTIG5085 | 4697052_f3_5 | 512 | 14615 | 870 | 290 | P25559 | 391 | 2.2(10)-36 | Saccharomyces cerevisiae | hypothetical 34.5 kd protein in ste50-his4 intergenic region. |
| CONTIG5025 | 5267050_f3_4 | 513 | 14616 | 1410 | 470 | P25368 | 177 | 4.7(10)-13 | Saccharomyces cerevisiae | hypothetical 23.6 kd protein in glk1-ste50 intergenic region. |
| CONTIG4432 | 393750_c3_13 | 514 | 14617 | 1131 | 377 | P25369 | 254 | 9.4(10)-35 | Saccharomyces cerevisiae | hypothetical 64.9 kd protein in glk1-ste50 intergenic region. |
| CONTIG5231 | 5159507_f1_2 | 515 | 14618 | 945 | 315 | P25370 | 205 | 2.2(10)-18 | Saccharomyces cerevisiae | hypothetical 64.9 kd protein in glk1-ste50 intergenic region. |
| CONTIG4053 | 13867194_c1_5 | 516 | 14619 | 1176 | 392 | P25573 | 106 | 0.0064 | Saccharomyces cerevisiae | hypothetical 47.2 kd protein in pdi1 5'region. |
| blx12128.x | 10650307_f1_1 | 517 | 14620 | 537 | 179 | P25586 | 796 | 2.7(10)79 | Saccharomyces cerevisiae | hypothetical 37.2 kd protein in cha1-apa1/dtp intergenic region. |
| CONTIG1235 | 30367630_c3_5 | 518 | 14621 | 285 | 95 | P25600 | 127 | 8.4(10)-8 | Saccharomyces cerevisiae | transposon ty5-1 34.5 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4104 | 26571875_f2_5 | 519 | 14622 | 591 | 197 | P25614 | 537 | 7.4(10)-52 | *Saccharomyces cerevisiae* | hypothetical protein. |
| CONTIG2428 | 25839455_c3_7 | 520 | 14623 | 771 | 257 | P25616 | 194 | 2.7(10)-15 | *Saccharomyces cerevisiae* | very hypothetical 22.8 kd protein in pgk1 region. |
| CONTIG2517 | 19569002_f2_1 | 521 | 14624 | 1107 | 369 | P25618 | 956 | 3.0(10)-96 | *Saccharomyces cerevisiae* | hypothetical 36.3 kd protein in pol4-srd1 intergenic region. |
| b3x19615.x | 26289182_f3_2 | 522 | 14625 | 822 | 274 | P25618 | 321 | 8.9(10)-28 | *Saccharomyces cerevisiae* | hypothetical 107.9 kd protein in pol4-srd1 intergenic region. |
| CONTIG4131 | 9805133_c2_8 | 523 | 14626 | 927 | 309 | P25353 | 216 | 1.0(10)-16 | *Saccharomyces cerevisiae* | hypothetical 107.9 kd protein in pol4-srd1 intergenic region. |
| CONTIG5716 | 12265875_f2_5 | 524 | 14627 | 1179 | 393 | P25359 | 297 | 2.6(10)-47 | *Saccharomyces cerevisiae* | hypothetical 84.9 kd protein in pmp1-rim1 intergenic region. |
| CONTIG453 | 569427_c3_3 | 525 | 14628 | 354 | 118 | P25625 | 158 | 3.5(10)-15 | *Saccharomyces cerevisiae* | hypothetical 44.1 kd protein in gns1-rbk1 intergenic region. |
| CONTIG5633 | 9970281_c1_11 | 526 | 14629 | 717 | 239 | P25625 | 325 | 2.2(10)-29 | *Saccharomyces cerevisiae* | hypothetical 42.5 kd protein in tsm1-are1 intergenic region. |
| CONTIG5573 | 2117811_c3_17 | 527 | 14630 | 717 | 239 | P25631 | 329 | 8.1(10)-30 | *Saccharomyces cerevisiae* | hypothetical 42.5 kd protein in tsm1-are1 intergenic region. |
| CONTIG5366 | 2032593_c2_5 | 528 | 14631 | 1554 | 518 | P25355 | 237 | 1.1(10)-23 | *Saccharomyces cerevisiae* | hypothetical 24.7 kd protein in thr4 intergenic region. |
| CONTIG1960 | 25491692_f3_4 | 529 | 14632 | 411 | 137 | P25637 | 239 | 2.7(10)-20 | *Saccharomyces cerevisiae* | hypothetical 65.2 kd protein in pwp2 intergenic region. |
| CONTIG1960 | 4964437_f1_1 | 530 | 14633 | 366 | 122 | P25637 | 191 | 3.3(10)-15 | *Saccharomyces cerevisiae* | hypothetical 29.0 kd protein in pwp2-sup61 intergenic region. |
| b4x10153.x | 36510253_f1_1 | 531 | 14634 | 645 | 215 | P25639 | 180 | 5.0(10)-13 | *Saccharomyces cerevisiae* | hypothetical 29.0 kd protein in pwp2-sup61 intergenic region. |
| CONTIG2339 | 35445252_f3_1 | 532 | 14635 | 888 | 296 | P25363 | 324 | 2.7(10)-29 | *Saccharomyces cerevisiae* | hypothetical 65.0 kd protein in pwp2-sup61 intergenic region. |
| CONTIG3075 | 22032568_f2_1 | 533 | 14636 | 438 | 146 | P25642 | 141 | 6.7(10)-10 | *Saccharomyces cerevisiae* | hypothetical 13.8 kd protein in pwp2-sup61 intergenic region. |
| CONTIG2389 | 9786562_c2_2 | 534 | 14637 | 1038 | 346 | P25646 | 316 | 6.7(10)-41 | *Saccharomyces cerevisiae* | hypothetical 13.6 kd protein in cpr4-sol2 intergenic region. |
| CONTIG5343 | 3915637_f3_9 | 535 | 14638 | 774 | 258 | P25651 | 139 | 1.7(10)-9 | *Saccharomyces cerevisiae* | hypothetical 48.5 kd protein in ers1-stb8 intergenic region. |
| CONTIG4878 | 13707750_c3_6 | 536 | 14639 | 612 | 204 | P25654 | 212 | 2.0(10)-17 | *Saccharomyces cerevisiae* | hypothetical 21.7 kd protein in tup1-abp1 intergenic region. |
| CONTIG5585 | 13953186_f1_3 | 537 | 14640 | 483 | 161 | P25656 | 306 | 2.2(10)-27 | *Saccharomyces cerevisiae* | hypothetical 20.7 kd protein in kin82 5'region. |
| CONTIG5585 | 476162_f3_13 | 538 | 14641 | 804 | 268 | P25656 | 621 | 9.3(10)-61 | *Saccharomyces cerevisiae* | hypothetical 45.0 kd protein in not1/cdc39-hmr intergenic region. |
| CONTIG5697 | 4803755_f3_7 | 539 | 14642 | 1290 | 430 | P25366 | 214 | 6.4(10)-20 | *Saccharomyces cerevisiae* | hypothetical 45.0 kd protein in not1/cdc39-hmr intergenic region. |
| CONTIG2699 | 10737811_f3_3 | 540 | 14643 | 834 | 278 | Q10235 | 181 | 4.4(10)-23 | *Schizosaccharomyces pombe* | hypothetical 41.6 kd protein in hmr 5'region. |
| CONTIG847 | 859567_f1_1 | 541 | 14644 | 801 | 267 | Q10236 | 629 | 1.3(10)-61 | *Schizosaccharomyces pombe* | hypothetical 26.7 kd protein c4g9.01 in chromosome i. |
| CONTIG3654 | 1064780_f1_1 | 542 | 14645 | 1230 | 410 | Q10250 | 570 | 2.8(10)-79 | *Schizosaccharomyces pombe* | hypothetical 36.8 kd protein c4g9.02 in chromosome i. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3654 | 24650300_f2_2 | 543 | 14646 | 858 | 286 | Q10250 | 455 | 9.8(10)-42 | Schizosaccharomyces pombe | hypothetical 170.7 kd protein c56f8.02 in chromosome i. |
| CONTIG4736 | 35318780_c1_9 | 544 | 14647 | 951 | 317 | Q10250 | 257 | 1.2(10)-20 | Schizosaccharomyces pombe | hypothetical 170.7 kd protein c56f8.02 in chromosome i. |
| CONTIG5596 | 23609626_f1_3 | 545 | 14648 | 1500 | 500 | Q10299 | 558 | 4.4(10)-54 | Schizosaccharomyces pombe | hypothetical 50.5 kd protein c22h10.05c in chromosome i. |
| CONTIG5587 | 4689135_f2_7 | 546 | 14649 | 1494 | 498 | P38961 | 878 | 5.4(10)-88 | Saccharomyces cerevisiae | hypothetical 47.2 kd protein in pdc2-afr1 intergenic region. |
| CONTIG2667 | 1961627_c1_4 | 547 | 14650 | 837 | 279 | P38962 | 124 | 2.3(10)-13 | Saccharomyces cerevisiae | hypothetical 23.1 kd protein in pdc2-afr1 intergenic region. |
| CONTIG1729 | 20523262_f2_1 | 548 | 14651 | 873 | 291 | P35178 | 362 | 2.6(10)-33 | Saccharomyces cerevisiae | hypothetical 33.2 kd protein in sss1-slu7 intergenic region. |
| CONTIG5257 | 2910127_c3_10 | 549 | 14652 | 1551 | 517 | P38966 | 126 | 4.2(10)-9 | Saccharomyces cerevisiae | hypothetical 18.9 kd protein in slu7 3'region. |
| CONTIG4200 | 24422805_f3_4 | 550 | 14653 | 678 | 226 | Q02354 | 213 | 7.2(10)-17 | Saccharomyces cerevisiae | hypothetical 52.2 kd protein in ada2 3'region. |
| b2x15202.y | 4332253_c3_2 | 551 | 14654 | 531 | 177 | Q1035 | 204 | 1.2(10)-16 | Schizosaccharomyces pombe | hypothetical protein c22e12.01 in chromoxome i (fragment). |
| b2x14806.x | 9957175_c3_2 | 552 | 14655 | 528 | 176 | P48569 | 259 | 2.1(10)-22 | Saccharomyces cerevisiae | hypothetical 37.0 kd protein in rpl41a-inh1 intergenic region. |
| CONTIG3986 | 19566052_c2_9 | 553 | 14656 | 468 | 156 | Q10448 | 96 | 0.00048 | Schizosaccharomyces pombe | hypothetical 16.9 kd protein c12b10.15c in chromosome i. |
| CONTIG4653 | 31266406_f1_4 | 554 | 14657 | 696 | 232 | Q10449 | 224 | 6.7(10)-18 | Schizosaccharomyces pombe | hypothetical 57.2 kd protein c12b10.16c in chromosome i. |
| CONTIG4684 | 5352182_c2_6 | 555 | 14658 | 1305 | 435 | Q10449 | 950 | 1.3(10)-95 | Schizosaccharomyces pombe | hypothetical 57.2 kd protein c12b10.16c in chromosome i. |
| b2x14975.x | 15814068_f1_1 | 556 | 14659 | 798 | 266 | Q10495 | 92 | 0.28999 | Schizosaccharomyces pombe | hypothetical 111.4 kd protein c2f1.08c in chromosome i. |
| CONTIG4094 | 25567802_f2_4 | 557 | 14660 | 411 | 137 | P32643 | 121 | 3.6(10)-7 | Saccharomyces cerevisiae | hypothetical 34.8 kd protein in rad24-bmh1 intergenic region. |
| CONTIG5442 | 883577_c2_15 | 558 | 14661 | 375 | 125 | P32643 | 218 | 4.7(10)-18 | Saccharomyces cerevisiae | hypothetical 34.8 kd protein in rad24-bmh1 intergenic region. |
| CONTIG1671 | 24645437_f2_2 | 559 | 14662 | 462 | 154 | P40098 | 164 | 2.5(10)-12 | Saccharomyces cerevisiae | hypothetical 27.7 kd protein in isc10 3'region. |
| CONTIG4226 | 21907010_c2_10 | 560 | 14663 | 660 | 220 | P40098 | 164 | 2.5(10)-12 | Saccharomyces cerevisiae | hypothetical 27.7 kd protein in isc10 3'region. |
| CONTIG4923 | 24414193_c1_7 | 561 | 14664 | 975 | 325 | P40098 | 252 | 1.2(10)-21 | Saccharomyces cerevisiae | hypothetical 27.7 kd protein in isc10 3'region. |
| CONTIG237 | 12189437_f3_1 | 562 | 14665 | 420 | 140 | P40006 | 92 | 0.00032 | Saccharomyces cerevisiae | hypothetical 25.0 kd protein in wbp1-mnn1 intergenic region precursor. |
| CONTIG4491 | 12304650_c3_5 | 563 | 14666 | 483 | 161 | P40006 | 106 | 8.5(10)-6 | Saccharomyces cerevisiae | hypothetical 25.0 kd protein in wbp1-mnn1 intergenic region precursor. |
| CONTIG4412 | 6694056_f3_2 | 564 | 14667 | 408 | 136 | P40005 | 170 | 5.7(10)-13 | Saccharomyces cerevisiae | hypothetical 14.3 kd protein in gen4-wbp1 intergenic region. |
| CONTIG4862 | 23525308_f2_3 | 565 | 14668 | 816 | 272 | P40002 | 283 | 1.1(10)-28 | Saccharomyces cerevisiae | hypothetical 72.5 kd protein in gen4-wpb1 intergenic region. |
| CONTIG1147 | 22445186_c2_5 | 566 | 14669 | 753 | 251 | P39968 | 798 | 1.6(10)-79 | Saccharomyces cerevisiae | hypothetical 64.0 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3040 | 191556_c1_3 | 567 | 14670 | 864 | 288 | P39998 | 183 | 1.3(10)-19 | Saccharomyces cerevisiae | hypothetical 61.3 kd protein in mms21-ubc8 intergenic region. |
| CONTIG4603 | 24070302_f3_6 | 568 | 14671 | 1293 | 431 | P39997 | 468 | 1.5(10)-44 | Saccharomyces cerevisiae | hypothetical 57.4 kd protein in mms21-ubc8 intergenic region. |
| CONTIG5740 | 26344178_c2_19 | 569 | 14672 | 1242 | 414 | P39992 | 370 | 7.0(10)-70 | Saccharomyces cerevisiae | hypothetical 78.3 kd protein in rip1-ura3 intergenic region. |
| CONTIG5740 | 1259633_c1_14 | 570 | 14673 | 441 | 147 | P39992 | 288 | 1.6(10)-24 | Saccharomyces cerevisiae | hypothetical 78.3 kd protein in rip1-ura3 intergenic region. |
| CONTIG4276 | 4296937_c1_2 | 571 | 14674 | 1164 | 388 | P39988 | 492 | 4.4(10)-47 | Saccharomyces cerevisiae | hypothetical 35.6 kd protein in mcm3-vma3 intergenic region. |
| CONTIG2682 | 16509687_c1_5 | 572 | 14675 | 648 | 216 | P32618 | 91 | 0.23 | Saccharomyces cerevisiae | hypothetical 106.1 kd protein in gly1-gda1 intergenic region. |
| CONTIG248 | 32314768_f2_1 | 573 | 14676 | 258 | 86 | P32617 | 232 | 1.6(10)-19 | Saccharomyces cerevisiae | hypothetical 18.5 kd protein in gly1-gda1 intergenic region. |
| CONTIG5058 | 2520166_f2_2 | 574 | 14677 | 459 | 153 | P32617 | 255 | 5.7(10)-22 | Saccharomyces cerevisiae | hypothetical 18.5 kd protein in gly1-gda1 intergenic region. |
| CONTIG5797 | 21500125_f1_2 | 575 | 14678 | 1665 | 555 | P32615 | 775 | 4.5(10)-77 | Saccharomyces cerevisiae | hypothetical 50.8 kd protein in pau2-gly1 intergenic region. |
| CONTIG4125 | 24433500_c2_10 | 576 | 14679 | 1101 | 367 | P39988 | 222 | 3.0(10)-20 | Saccharomyces cerevisiae | hypothetical 115.9 kd protein in pcm1-rpl15b intergenic region. |
| CONTIG4125 | 23485912_c2_9 | 577 | 14680 | 735 | 245 | P39985 | 118 | 0.0017 | Saccharomyces cerevisiae | hypothetical 115.9 kd protein in pcm1-rpl15b intergenic region. |
| CONTIG4125 | 182912_c2_8 | 578 | 14681 | 951 | 317 | P39985 | 194 | 1.3(10)-27 | Saccharomyces cerevisiae | hypothetical 115.9 kd protein in pcm1-rpl15b intergenic region. |
| CONTIG2947 | 36224092_c1_7 | 579 | 14682 | 630 | 210 | P39979 | 344 | 201(10)-31 | Saccharomyces cerevisiae | hypothetical 20.7 kd protein in hxt8-can1 intergenic region. |
| CONTIG4619 | 24786376_f1_2 | 580 | 14683 | 966 | 322 | P39975 | 99 | 4.7(10)-7 | Saccharomyces cerevisiae | hypothetical 26.8 kd protein in hxt8 5'region. |
| CONTIG3418 | 10736090_c3_2 | 581 | 14684 | 540 | 180 | P40007 | 342 | 303(10)-31 | Saccharomyces cerevisiae | hypothetical 26.9 kd protein in mnn1-pmi40 intergenic region. |
| CONTIG5678 | 10650812_c3_16 | 582 | 14685 | 750 | 250 | P40011 | 550 | 3.1(10)-53 | Saccharomyces cerevisiae | hypothetical 25.6 kd protein in ntf2-srp1 intergenic region. |
| CONTIG1606 | 21485925_f3_1 | 583 | 14686 | 759 | 253 | P40015 | 412 | 1.3(10)-38 | Saccharomyces cerevisiae | hypothetical 53.9 kd protein in afg3-seb2 intergenic region. |
| b9x13d54.x | 2228442_f2_1 | 584 | 14687 | 552 | 184 | P40015 | 534 | 1.5(10)-51 | Saccharomyces cerevisiae | hypothetical 53.9 kd protein in afg3-seb2 intergenic region. |
| CONTIG1396 | 35162537_c2_3 | 585 | 14688 | 285 | 95 | P40018 | 131 | 7.7(10)-9 | Saccharomyces cerevisiae | hypothetical 22.4 kd protein in gal83-ypt8 intergenic region. |
| CONTIG3465 | 23945377_c3_4 | 586 | 14689 | 591 | 197 | P40019 | 112 | 8.0(10)-7 | Saccharomyces cerevisiae | hypothetical 18.3 kd protein in gal83-ypt8 intergenic region. |
| CONTIG1149 | 33790917_c3_2 | 587 | 14690 | 450 | 150 | P25992 | 95 | 0.00129 | Drosophila melanogaster | yemanuclein-alpha. |
| CONTIG3595 | 2645926_f3_3 | 588 | 14691 | 480 | 160 | P25992 | 90 | 0.00459 | Drosophila melanogaster | yemanuclein-alpha. |
| CONTIG5289 | 24804687_f1_1 | 589 | 14692 | 489 | 166 | P40030 | 397 | 5.0(10)-37 | Saccharomyces cerevisiae | hypothetical 17.1 kd protein in sah1-mei4 intergenic region. |
| CONTIG4774 | 34663177_f3_3 | 590 | 14693 | 1446 | 482 | P39955 | 115 | 0.002 | Saccharomyces cerevisiae | hypothetical 100.3 kd protein in met4-caj1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2302 | 26460063_c3_9 | 591 | 14694 | 309 | 103 | P40032 | 183 | 2.8(10)-13 | Saccharomyces cerevisiae | hypothetical 74.0 kd protein in hom3 intergenic region. |
| CONTIG2302 | 9787682_c2_7 | 592 | 14695 | 1422 | 474 | P40032 | 896 | 6.7(10)-90 | Saccharomyces cerevisiae | hypothetical 74.0 kd protein in hom3 intergenic region. |
| CONTIG2013 | 35273405_c3_6 | 593 | 14696 | 888 | 296 | P40034 | 211 | 5.2(10)-21 | Saccharomyces cerevisiae | hypothetical 56.5 kd protein in hom3 intergenic region. |
| CONTIG4315 | 22478433_f2_4 | 594 | 14697 | 819 | 273 | P40041 | 234 | 8.4(10)-24 | Saccharomyces cerevisiae | hypothetical 56.6 kd protein in gep2-icl1 intergenic region. |
| CONTIG4019 | 15648937_f3_3 | 595 | 14698 | 288 | 96 | P40046 | 171 | 4.5(10)-13 | Saccharomyces cerevisiae | hypothetical 14.4 kd protein in ald3 intergenic region. |
| b1x15658.x | 24219818_c3_2 | 596 | 14699 | 564 | 188 | P40050 | 145 | 3.7(10)-9 | Saccharomyces cerevisiae | hypothetical 79.5 kd protein in rps24ea-ilv1 intergenic region. |
| CONTIG4767 | 24425938_c3_6 | 597 | 14700 | 633 | 211 | P40053 | 487 | 1.5(10)-46 | Saccharomyces cerevisiae | hypothetical 72.4 kd protein in rps24ea-ilv1 intergenic region. |
| CONTIG5081 | 10157813_f3_6 | 598 | 14701 | 630 | 210 | P40053 | 199 | 5.2(10)-15 | Saccharomyces cerevisiae | hypothetical 72.4 kd protein in rps24ea-ilv1 intergenic region. |
| CONTIG5805 | 917040_f3_19 | 599 | 14702 | 1632 | 544 | P40055 | 1483 | 4.2(10)-152 | Saccharomyces cerevisiae | hypothetical 62.3 kd protein in rps24ea-ilv1 intergenic region. |
| CONTIG5805 | 20484767_c3_45 | 600 | 14703 | 948 | 316 | P40056 | 110 | 0.00069 | Saccharomyces cerevisiae | hypothetical 33.9 kd protein in rps24ea-ilv1 intergenic region. |
| CONTIG4712 | 26343942_c1_5 | 601 | 14704 | 2478 | 826 | P40061 | 443 | 3.2(10)-48 | Saccharomyces cerevisiae | hypothetical 164.4 kd protein in met6-pup3 intergenic region. |
| CONTIG4758 | 23457193_c3_7 | 602 | 14705 | 915 | 305 | P40071 | 617 | 2.5(10)-60 | Saccharomyces cerevisiae | hypothetical 81.5 kd protein in uss1-bcb1 intergenic region. |
| CONTIG5744 | 10571050_f1_6 | 603 | 14706 | 801 | 267 | P40078 | 1127 | 2.2(10)-114 | Saccharomyces cerevisiae | hypothetical 29.7 kd protein in rsp5-pak1 intergenic region. |
| b3x16061.y | 33625061_f1_1 | 604 | 14707 | 300 | 100 | P40078 | 310 | 8.4(10)-28 | Saccharomyces cerevisiae | hypothetical 29.7 kd protein in rsp5-pak1 intergenic region. |
| CONTIG5744 | 3620514 2_c2_24 | 605 | 14708 | 1257 | 419 | P40079 | 406 | 5.7(10)-38 | Saccharomyces cerevisiae | hypothetical 40.8 kd protein in rsp5-pak1 intergenic region. |
| CONTIG1683 | 6662635_f1_1 | 606 | 14709 | 624 | 208 | P40080 | 122 | 7.7(10)-11 | Saccharomyces cerevisiae | hypothetical 23.5 kd protein in rsp5-pak1 intergenic region. |
| CONTIG197 | 6662635_c1_1 | 607 | 14710 | 375 | 125 | P40080 | 126 | 2.6(10)-8 | Saccharomyces cerevisiae | hypothetical 23.5 kd protein in rsp5-pak1 intergenic region. |
| CONTIG4059 | 19804043_c3_4 | 608 | 14711 | 1656 | 552 | P32634 | 272 | 3.2(10)-35 | Saccharomyces cerevisiae | hypothetical 195.4 kd protein in rps26b-glc7 intergenic region. |
| CONTIG5596 | 6125175_c3_29 | 609 | 14712 | 558 | 186 | P40081 | 314 | 3.2(10)-28 | Saccharomyces cerevisiae | hypothetical 20.4 kd protein in glc7-gdi1 intergenic region. |
| CONTIG4470 | 4022126_f2_1 | 610 | 14713 | 456 | 152 | P40083 | 112 | 8.0(10)-7 | Saccharomyces cerevisiae | hypothetical 16.6 kd protein in gdi1-cox15 intergenic region. |
| CONTIG5806 | 10752150_f2_10 | 611 | 14714 | 900 | 300 | P40084 | 154 | 1.7(10)-14 | Saccharomyces cerevisiae | hypothetical 26.2 kd protein in gdi1-cox15 intergenic region. |
| CONTIG5806 | 23878186_c3_42 | 612 | 14715 | 2064 | 688 | P40085 | 615 | 2.2(10)-64 | Saccharomyces cerevisiae | hypothetical 64.8 kd protein in gdi1-cox15 intergenic region. |
| CONTIG3542 | 6753888_c2_8 | 613 | 14716 | 243 | 81 | P40087 | 146 | 1.3(10)-9 | Saccharomyces cerevisiae | hypothetical 47.4 kd protein in mag1-ubp5 intergenic region. |
| CONTIG3193 | 30583281_f3_5 | 614 | 14717 | 657 | 219 | P40088 | 586 | 4.7(10)-57 | Saccharomyces cerevisiae | hypothetical 45.7 kd protein in ubp-5-spt15 intergenic region. |
| CONTIG4266 | 783432_f3_3 | 615 | 14718 | 753 | 251 | P40088 | 736 | 6.0(10)-73 | Saccharomyces cerevisiae | hypothetical 45.7 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4827 | 4803182_c1_9 | 616 | 14719 | 366 | 122 | P40088 | 395 | 8.3(10-37) | Saccharomyces cerevisiae | hypothetical 45.7 kd protein in ubp5-spt15 intergenic region. |
| CONTIG5193 | 22461088_c1_5 | 617 | 14720 | 213 | 71 | P40088 | 94 | 0.00054 | Saccharomyces cerevisiae | hypothetical 45.7 kd protein in ubp5-spt15 intergenic region. |
| CONTIG4547 | 9975078_f1_1 | 618 | 14721 | 1170 | 390 | P10356 | 885 | 9.9(10-89) | Saccharomyces cerevisiae | hypothetical 49.5 kd protein in ubp3-pet122 intergenic region. |
| CONTIG579 | 10312507_f3_1 | 619 | 14722 | 867 | 289 | P10356 | 596 | 4.2(10-58) | Saccharomyces cerevisiae | hypothetical 49.5 kd protein in ubp3-pet122 intergenic region. |
| CONTIG1031 | 203790_f3_2 | 620 | 14723 | 210 | 70 | P40093 | 208 | 9.0(10-17) | Saccharomyces cerevisiae | hypothetical 38.2 kd protein in bem2-spt2 intergenic region. |
| CONTIG1657 | 20503405_c1_2 | 621 | 14724 | 1113 | 371 | P40094 | 365 | 1.2(10-39) | Saccharomyces cerevisiae | hypothetical 92.5 kd protein in bem2-spt2 intergenic region. |
| CONTIG3413 | 24647192_f1_1 | 622 | 14725 | 534 | 178 | P43585 | 380 | 3.0(10-34) | Saccharomyces cerevisiae | hypothetical 95.4 kd protein in sec4-msh4 intergenic region. |
| CONTIG2625 | 2944467_c1_4 | 623 | 14726 | 1059 | 353 | P43584 | 345 | 1.6(10-31) | Saccharomyces cerevisiae | hypothetical 28.8 kd protein in smc1-sec4 intergenic region. |
| CONTIG4411 | 3207837_c1_8 | 624 | 14727 | 534 | 178 | P43583 | 200 | 1.8(10-14) | Saccharomyces cerevisiae | hypothetical 207.6 kd protein in smc1-sec4 intergenic region. |
| CONTIG4411 | 25598900_c1_7 | 625 | 14728 | 2469 | 823 | P43583 | 689 | 2.1(10-86) | Saccharomyces cerevisiae | hypothetical 207.6 kd protein in smc1-sec4 intergenic region. |
| CONTIG4411 | 1458318_c1_6 | 626 | 14729 | 777 | 259 | P43583 | 253 | 4.0(10-20) | Saccharomyces cerevisiae | hypothetical 207.6 kd protein in smc1-sec4 intergenic region. |
| CONTIG737 | 10242915_f3_2 | 627 | 14730 | 1230 | 410 | P43583 | 336 | 6.0(10-29) | Saccharomyces cerevisiae | hypothetical 207.6 kd protein in smc1-sec4 intergenic region. |
| CONTIG5119 | 34412805_c1_5 | 628 | 14731 | 1074 | 358 | P43579 | 239 | 1.8(10-26) | Saccharomyces cerevisiae | hypothetical 78.8 kd protein in hsp12-hxt10 intergenic region. |
| CONTIG4849 | 32134430_f2_3 | 629 | 14732 | 468 | 156 | P43577 | 320 | 7.2(10-29) | Saccharomyces cerevisiae | hypothetical 18.1 kd protein in snp2-mdj1 intergenic region. |
| CONTIG5773 | 16829826_c2_29 | 630 | 14733 | 2268 | 756 | P43572 | 307 | 1.2(10-44) | Saccharomyces cerevisiae | hypothetical 96.7 kd protein in fis2 intergenic region. |
| CONTIG1740 | 6728457_c3_5 | 631 | 14734 | 888 | 296 | P43570 | 113 | 0.00042 | Saccharomyces cerevisiae | hypothetical 57.6 kd protein in cad1-ste2 intergenic region. |
| CONTIG3935 | 31484410_c3_9 | 632 | 14735 | 1071 | 357 | P43570 | 113 | 3.2(10-5) | Saccharomyces cerevisiae | hypothetical 57.6 kd protein in cak1-ste2 intergenic region. |
| CONTIG5007 | 2117067_f2_1 | 633 | 14736 | 2271 | 757 | P43564 | 1132 | 1.5(10-136) | Saccharomyces cerevisiae | hypothetical 119.5 kd protein in rpo41-hac1 intergenic region. |
| CONTIG3136 | 87801_f2_2 | 634 | 14737 | 945 | 315 | P43563 | 762 | 1.1(10-75) | Saccharomyces cerevisiae | hypothetical 30.1 kd protein in rpo41-hac1 intergenic region. |
| CONTIG3527 | 14629387_c1_5 | 635 | 14738 | 1014 | 338 | P43558 | 423 | 8.9(10-40) | Saccharomyces cerevisiae | hypothetical 33.5 kd protein in sec53-act1 intergenic region. |
| CONTIG4698 | 9774142_c3_6 | 636 | 14739 | 495 | 165 | P43557 | 431 | 1.3(10-40) | Saccharomyces cerevisiae | hypothetical 24.0 kd protein in emp47-sec53 intergenic region. |
| CONTIG4417 | 31490962_c1_7 | 637 | 14740 | 1812 | 604 | P43556 | 156 | 8.1(10-8) | Saccharomyces cerevisiae | hypothetical 82.2 kd protein in emp47-sec53 intergenic region. |
| CONTIG5679 | 24410411_c3_21 | 638 | 14741 | 2727 | 909 | P43556 | 1002 | 3.5(10-113) | Saccharomyces cerevisiae | hypothetical 82.2 kd protein in emp47-sec53 intergenic region. |
| CONTIG5734 | 4331313_c3_20 | 639 | 14742 | 699 | 233 | P43543 | 648 | 1.3(10-63) | Saccharomyces cerevisiae | hypothetical 25.2 kd protein in 5'region and in rpd3 5'region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5811 | 19531250_c2_33 | 640 | 14743 | 279 | 93 | P43586 | 91 | 0.00033 | Saccharomyces cerevisiae | hypothetical 23.6 kd protein in deg1-nic96 intergenic region. |
| CONTIG5811 | 3613612_c3_39 | 641 | 14744 | 210 | 70 | P43586 | 185 | 1.2(10)-14 | Saccharomyces cerevisiae | hypothetical 23.6 kd protein in deg1-nic96 intergenic region. |
| CONTIG5104 | 4953287_c1_7 | 642 | 14745 | 384 | 128 | P43587 | 145 | 2.6(10)-10 | Saccharomyces cerevisiae | hypothetical 18.2 kd protein in nic96-mpr1 intergenic region. |
| CONTIG3151 | 10938578_c2_5 | 643 | 14746 | 504 | 168 | P43597 | 277 | 6.7(10)-23 | Saccharomyces cerevisiae | hypothetical 137.7 kd protein in ugs1-fab1 intergenic region. |
| CONTIG5105 | 23437500_c3_16 | 644 | 14747 | 2706 | 902 | P43597 | 277 | 1.6(10)-20 | Saccharomyces cerevisiae | hypothetical 137.7 kd protein in ugs1-fab1 intergenic region. |
| CONTIG4942 | 34098376_c1_18 | 645 | 14748 | 1362 | 454 | P43601 | 310 | 4.0(10)-26 | Saccharomyces cerevisiae | hypothetical 55.1 kd protein in fab1-pes4 intergenic region. |
| CONTIG5385 | 6663901_c3_13 | 646 | 14749 | 1137 | 379 | P43601 | 332 | 4.0(10)-52 | Saccharomyces cerevisiae | hypothetical 55.1 kd protein in fab1-pes4 intergenic region. |
| CONTIG5385 | 3162756_c1_10 | 647 | 14750 | 492 | 164 | P43601 | 326 | 3.0(10)-29 | Saccharomyces cerevisiae | hypothetical 55.1 kd protein in fab1-pes4 intergenic region. |
| CONTIG4937 | 4876638_f2_2 | 648 | 14751 | 792 | 264 | P43605 | 319 | 9.4(10)-29 | Saccharomyces cerevisiae | hypothetical 31.8 kd protein in cdc14 intergenic region. |
| CONTIG5120 | 4876635_f2_2 | 649 | 14752 | 792 | 264 | P43605 | 321 | 5.7(10)-29 | Saccharomyces cerevisiae | hypothetical 31.8 kd protein in cdc14 intergenic region. |
| CONTIG5749 | 1457775_c2_20 | 650 | 14753 | 2367 | 789 | P43606 | 282 | 2.2(10)-40 | Saccharomyces cerevisiae | hypothetical 76.3 kd protein in cdc14-met10 intergenic region. |
| CONTIG3584 | 5355206_c1_5 | 651 | 14754 | 867 | 289 | P43607 | 146 | 8.5(10)-14 | Saccharomyces cerevisiae | hypothetical 31.9 kd protein in rpl5b-qcr6 intergenic region. |
| CONTIG4260 | 21602157_f3_3 | 652 | 14755 | 1479 | 493 | P43616 | 1705 | 1.3(10)-175 | Saccharomyces cerevisiae | hypothetical 52.9 kd protein in sat1ss-ymr31 intergenic region. |
| CONTIG2711 | 33486292_f1_1 | 653 | 14756 | 504 | 168 | P43620 | 104 | 8.9(10)-5 | Saccharomyces cerevisiae | hypothetical 75.9 kd protein in sat1ss-ymr31 intergenic region. |
| b9x13e61.x | 601375_c1_2 | 654 | 14757 | 366 | 122 | P43620 | 246 | 5.0(10)-20 | Saccharomyces cerevisiae | hypothetical 75.9 kd protein in sat1ss-ymr31 intergenic region. |
| CONTIG5393 | 3906630_f1_4 | 655 | 14758 | 693 | 231 | P53200 | 272 | 9.0(10)-24 | Saccharomyces cerevisiae | hypothetical 22.2 kd protein in pmc1-tfg2 intergenic region. |
| b9x10b27.y | 3129561_c1_3 | 656 | 14759 | 309 | 103 | P53201 | 139 | 9.5(10)-9 | Saccharomyces cerevisiae | hypothetical 55.2 kd protein in pmc1-tfg2 intergenic region. |
| CONTIG5688 | 878137_f3_11 | 657 | 14760 | 267 | 89 | P53203 | 103 | 7.0(10)-5 | Saccharomyces cerevisiae | hypothetical 52.9 kd protein in pmc1-tfg2 intergenic region. |
| CONTIG1105 | 35807791_f1_1 | 658 | 14761 | 984 | 328 | P53207 | 148 | 1.3(10)-7 | Saccharomyces cerevisiae | hypothetical 71.4 kd protein in sec9-msb2 intergenic region. |
| CONTIG4835 | 390687_f1_1 | 659 | 14762 | 570 | 190 | P53210 | 162 | 9.4(10)-12 | Saccharomyces cerevisiae | hypothetical 34.7 kd protein in msb2-uga1 intergenic region. |
| CONTIG3627 | 13093786_c1_6 | 660 | 14763 | 1188 | 396 | P53214 | 104 | 0.014 | Saccharomyces cerevisiae | hypothetical 57.5 kd protein in vma7-rps31a intergenic region. |
| CONTIG2939 | 22443767_c2_7 | 661 | 14764 | 879 | 293 | P53215 | 646 | 2.1(10)-63 | Saccharomyces cerevisiae | hypothetical 27.8 kd protein in vma7-rps31a intergenic region. |
| CONTIG2811 | 9853430_f2_1 | 662 | 14765 | 792 | 264 | P53217 | 172 | 4.7(10)-13 | Saccharomyces cerevisiae | hypothetical 33.3 kd protein in vma7-rps31a intergenic region. |
| CONTIG4609 | 24251567_c3_19 | 663 | 14766 | 408 | 136 | P53219 | 268 | 2.3(10)-23 | Saccharomyces cerevisiae | hypothetical 38.5 kd protein in erv1-gls2 intergenic region. |
| CONTIG3168 | 784761_c2_3 | 664 | 14767 | 495 | 165 | P53220 | 207 | 6.9(10)-17 | Saccharomyces cerevisiae | hypothetical 27.2 kd protein in gls2- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1693 | 21644025_f3_2 | 665 | 14768 | 747 | 249 | P53223 | 280 | 1.3(10)-24 | Saccharomyces cerevisiae | rpl26b intergenic region. hypothetical 27.6 kd protein in rpl26b intergenic region. |
| b3x19755.y | 14881550_c3_2 | 666 | 14769 | 672 | 224 | P53224 | 365 | 1.2(10)-33 | Saccharomyces cerevisiae | hypothetical 25.2 kd protein in rpl26b-acb1 intergenic region. |
| CONTIG3063 | 26204932_c3_4 | 667 | 14770 | 900 | 300 | P53230 | 253 | 1.2(10)-21 | Saccharomyces cerevisiae | hypothetical 44.2 kd protein in acb1-kss1 intergenic region. |
| CONTIG4403 | 6817152_c3_18 | 668 | 14771 | 1443 | 481 | P53235 | 664 | 9.6(10)-82 | Saccharomyces cerevisiae | hypothetical 71.3 kd protein in rme1-tfc4 intergenic region. |
| CONTIG3899 | 25439825_c3_11 | 669 | 14772 | 1134 | 378 | P53236 | 414 | 8.8(10)-38 | Saccharomyces cerevisiae | hypothetical 106.7 kd protein in scm4-mup1 intergenic region. |
| CONTIG3899 | 25478382_c1_6 | 670 | 14773 | 1281 | 427 | P53236 | 650 | 1.1(10)-63 | Saccharomyces cerevisiae | hypothetical 106.7 kd protein in mup1-spr3 intergenic region. |
| CONTIG3812 | 14882056_c1_5 | 671 | 14774 | 819 | 273 | P53237 | 127 | 9.9(10)-14 | Saccharomyces cerevisiae | hypothetical 28.6 kd protein in mup1-spr3 intergenic region. |
| CONTIG2127 | 11836180_c3_8 | 672 | 14775 | 1038 | 346 | P53252 | 948 | 2.1(10)-95 | Saccharomyces cerevisiae | hypothetical 38.3 kd protein in rpl16b-pdc6 intergenic region. |
| CONTIG5575 | 4328376_c1_12 | 673 | 14776 | 936 | 312 | P3252 | 1038 | 6.0(10)-105 | Saccharomyces cerevisiae | hypothetical 38.3 kd protein in rpl16b-pdc6 intergenic region. |
| CONTIG1333 | 24353387_f1_1 | 674 | 14777 | 528 | 176 | P53254 | 181 | 1.2(10)-12 | Saccharomyces cerevisiae | hypothetical 140.5 kd protein in ctt1-prp31 intergenic region. |
| CONTIG4138 | 24407651_f3_2 | 675 | 14778 | 1086 | 362 | P53254 | 657 | 1.5(10)-63 | Saccharomyces cerevisiae | hypothetical 140.5 kd protein in ctt1-prp31 intergenic region. |
| CONTIG4138 | 34550010_f2_1 | 676 | 14779 | 1737 | 579 | P53254 | 1120 | 3.3(10)-145 | Saccharomyces cerevisiae | hypothetical 140.5 kd protein in ctt1-prp31 intergenic region. |
| CONTIG5586 | 12673377_f3_13 | 677 | 14780 | 1509 | 503 | P53255 | 681 | 4.0(10)-67 | Saccharomyces cerevisiae | hypothetical 58.2 kd protein in dbf2-vas1 intergenic region. |
| b1x18864.x | 11020455_f3_1 | 678 | 14781 | 414 | 138 | P53256 | 136 | 4.9(10)-9 | Saccharomyces cerevisiae | hypothetical 28.3 kd protein in vas1-ask10 intergenic region. |
| CONTIG5811 | 11728431_f3_14 | 679 | 14782 | 987 | 329 | P53259 | 443 | 6.7(10)-42 | Saccharomyces cerevisiae | hypothetical 38.8 kd protein in mic1-srb5 intergenic region. |
| CONTIG5789 | 10744037_f2_9 | 680 | 14783 | 501 | 167 | P53260 | 123 | 5.5(10)-8 | Saccharomyces cerevisiae | hypothetical 20.8 kd protein in mic1-srb5 intergenic region. |
| CONTIG5789 | 29319426_f3_14 | 681 | 14784 | 1737 | 579 | P53261 | 970 | 7.0(10)-145 | Saccharomyces cerevisiae | hypothetical 69.9 kd protein in mic1-srb5 intergenic region. |
| CONTIG1910 | 1196902_c3_6 | 682 | 14785 | 900 | 300 | P53264 | 303 | 4.7(10)-27 | Saccharomyces cerevisiae | hypothetical 52.0 kd protein in clb6-spt6 intergenic region. |
| CONTIG3957 | 24501663_c1_5 | 683 | 14786 | 1203 | 401 | P53264 | 235 | 8.0(10)-38 | Saccharomyces cerevisiae | hypothetical 52.0 kd protein in clb6-spt6 intergenic region. |
| CONTIG5726 | 25553192_f1_3 | 684 | 14787 | 1416 | 472 | P53264 | 627 | 2.2(10)-61 | Saccharomyces cerevisiae | hypothetical 52.0 kd protein in clb6-spt6 intergenic region. |
| b9x12862.x | 14163125_c2_3 | 685 | 14788 | 519 | 173 | P53265 | 113 | 1.3(10)-11 | Saccharomyces cerevisiae | hypothetical 46.7 kd protein in clb6-spt6 intergenic region. |
| CONTIG5805 | 1382056_f1_1 | 686 | 14789 | 777 | 259 | P53266 | 456 | 2.7(10)-43 | Saccharomyces cerevisiae | hypothetical 45.1 kd protein in clb6-spt6 intergenic region. |
| CONTIG3478 | 12117316_f1_1 | 687 | 14790 | 813 | 271 | P53271 | 96 | 0.01499 | Saccharomyces cerevisiae | hypothetical 31.8 kd protein in nup57-mep1 intergenic region. |
| CONTIG1322 | 25992067_c1_3 | 688 | 14791 | 843 | 281 | P53273 | 368 | 9.6(10)-33 | Saccharomyces cerevisiae | hypothetical 117.0 kd protein in asn2-phb1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11v18.x | 4332587_f1_1 | 689 | 14792 | 264 | 88 | P53273 | 175 | 4.0(10)-12 | Saccharomyces cerevisiae | hypothetical 117.0 kd protein in asn2-phb1 intergenic region. |
| b9x11v18.x | 896883_f1_2 | 690 | 14793 | 402 | 134 | P53273 | 387 | 8.9(10)-35 | Saccharomyces cerevisiae | hypothetical 117.0 kd protein in asn2-phb1 intergenic region. |
| CONTIG4839 | 22460927_f1_2 | 691 | 14794 | 330 | 110 | P53275 | 164 | 6.7(10)-12 | Saccharomyces cerevisiae | hypothetical 35.7 kd protein in asn2-phb1 intergenic region. |
| CONTIG5498 | 26376953_f3_4 | 692 | 14795 | 552 | 184 | P53275 | 155 | 6.7(10)-11 | Saccharomyces cerevisiae | hypothetical 35.7 kd protein in asn2-phb1 intergenic region. |
| CONTIG5140 | 35798416_c3_11 | 693 | 14796 | 1431 | 477 | P53276 | 236 | 9.6(10)-17 | Saccharomyces cerevisiae | hypothetical 80.2 kd protein in asn2-phb1 intergenic region. |
| CONTIG4916 | 35197837_f3_4 | 694 | 14797 | 2475 | 825 | P53280 | 322 | 3.2(10)-25 | Saccharomyces cerevisiae | hypothetical 128.8 kd protein in pas2-prs5 intergenic region. |
| CONTIG3062 | 24746053_c1_4 | 695 | 14798 | 1245 | 415 | P53285 | 839 | 7.4(10)-84 | Saccharomyces cerevisiae | hypothetical 54.5 kd protein in cbf2-skn1 intergenic region. |
| CONTIG4419 | 932_c1_7 | 696 | 14799 | 2271 | 757 | P48234 | 1655 | 1.3(10)-196 | Saccharomyces cerevisiae | hypothetical 81.7 kd protein in mol1-nat2 intergenic region. |
| CONTIG3140 | 19921961_c3_5 | 697 | 14800 | 342 | 114 | P48236 | 180 | 2.7(10)-13 | Saccharomyces cerevisiae | hypothetical 51.6 kd protein in rpl30b-rsr1 intergenic region. |
| CONTIG5415 | 4085330_c3_18 | 698 | 14801 | 741 | 247 | P48236 | 453 | 5.9(10)-43 | Saccharomyces cerevisiae | hypothetical 51.6 kd protein in rpl30b-rsr1 intergenic region. |
| CONTIG4736 | 26589027_f3_5 | 699 | 14802 | 1737 | 579 | P48237 | 155 | 3.2(10)-17 | Saccharomyces cerevisiae | hypothetical 101.4 kd protein in rpl30b-rsr1 intergenic region. |
| CONTIG1495 | 4020005_f1_1 | 700 | 14803 | 681 | 227 | P53289 | 114 | 1.5(10)-6 | Saccharomyces cerevisiae | hypothetical 29.3 kd protein in nsr1-tif4631 intergenic region. |
| CONTIG4106 | 24031312_c2_8 | 701 | 14804 | 1152 | 384 | P53290 | 982 | 8.5(10)-106 | Saccharomyces cerevisiae | hypothetical 38.6 kd protein in tif4631-kre11 intergenic region. |
| CONTIG2374 | 3938811_f2_1 | 702 | 14805 | 516 | 172 | P53292 | 199 | 1.1(10)-15 | Saccharomyces cerevisiae | hypothetical 39.6 kd protein in tif4631-kre11 intergenic region. |
| CONTIG2163 | 24020392_c3_13 | 703 | 14806 | 645 | 215 | P53297 | 263 | 6.5(10)-32 | Saccharomyces cerevisiae | hypothetical 78.8 kd protein in erg1-rnr4 intergenic region. |
| CONTIG5528 | 19648387_c3_16 | 704 | 14807 | 1581 | 527 | P53301 | 626 | 2.7(10)-61 | Saccharomyces cerevisiae | hypothetical 52.8 kd protein in bub1-hip1 intergenic region. |
| CONTIG5731 | 14270312_c1_17 | 705 | 14808 | 1389 | 463 | P53301 | 861 | 3.3(10)-86 | Saccharomyces cerevisiae | hypothetical 52.8 kd protein in bub1-hip1 intergenic region. |
| CONTIG4320 | 20742136_c1_7 | 706 | 14809 | 1176 | 392 | P42826 | 676 | 1.3(10)-66 | Saccharomyces cerevisiae | hypothetical 68.3 kd protein in pdx1-sng1 intergenic region. |
| CONTIG4562 | 9796938_f2_1 | 707 | 14810 | 645 | 215 | P42826 | 211 | 2.3(10)-16 | Saccharomyces cerevisiae | hypothetical 68.3 kd protein in pdx1-sng1 intergenic region. |
| CONTIG1773 | 23647503_c1_2 | 708 | 14811 | 1059 | 353 | P46951 | 141 | 1.6(10)-6 | Saccharomyces cerevisiae | hypothetical 95.4 kd protein in sng1-pmt6 intergenic region. |
| CONTIG2260 | 1929700_c1_3 | 709 | 14812 | 897 | 299 | P42935 | 646 | 2.1(10)-63 | Saccharomyces cerevisiae | hypothetical trp-asp repeats containing protein in pmt6-pct1 intergenic region. |
| CONTIG4027 | 4787686_f3_5 | 710 | 14813 | 915 | 305 | P42935 | 614 | 5.0(10)-60 | Saccharomyces cerevisiae | hypothetical trp-asp repeats containing protein in pmt6-pct1 intergenic region. |
| b9x13p32.y | 25586700_c2_3 | 711 | 14814 | 627 | 209 | P42938 | 167 | 1.1(10)-18 | Saccharomyces cerevisiae | hypothetical 33.3 kd protein in ade3-ser2 intergenic region. |
| CONTIG5354 | 54807_c3_10 | 712 | 14815 | 471 | 157 | P42942 | 192 | 2.7(10)-26 | Saccharomyces cerevisiae | hypothetical 45.2 kd gtp-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | protein in trx1-rta1 intergenic region. |
| CONTIG372 | 24006652_c2_3 | 713 | 14816 | 1035 | 345 | P53303 | 934 | 6.2(10)-94 | Saccharomyces cerevisiae | hypothetical 55.1 kd protein in rta1 intergenic region. |
| CONTIG5241 | 14720402_f3_4 | 714 | 14817 | 327 | 109 | P53305 | 149 | 9.6(10)-11 | Saccharomyces cerevisiae | hypothetical 12.4 kd protein in nab1a-crm1 intergenic region. |
| CONTIG2537 | 195812_f1_1 | 715 | 14818 | 729 | 243 | P50079 | 146 | 1.5(10)-9 | Saccharomyces cerevisiae | hypothetical 51.2 kd protein in pet54-die2 intergenic region. |
| CONTIG2537 | 4900305_f3_5 | 716 | 14819 | 756 | 252 | P50079 | 256 | 1.3(10)-21 | Saccharomyces cerevisiae | hypothetical 51.2 kd protein in pet54-die2 intergenic region. |
| CONTIG5563 | 14240928_f2_7 | 717 | 14820 | 453 | 151 | P50086 | 207 | 6.9(10)-17 | Saccharomyces cerevisiae | hypothetical 25.6 kd protein in smi1-pho81 intergenic region. |
| CONTIG4370 | 1427005_f2_3 | 718 | 14821 | 444 | 148 | P50087 | 92 | 0.00479 | Saccharomyces cerevisiae | hypothetical 26.9 kd protein in yhb1-pfk1 intergenic region. |
| CONTIG658 | 14144410_c1_5 | 719 | 14822 | 639 | 213 | P50087 | 124 | 2.8(10)-6 | Saccharomyces cerevisiae | hypothetical 26.9 kd protein in yhb1-pfk1 intergenic region. |
| CONTIG3329 | 13797751_c3_6 | 720 | 14823 | 639 | 213 | P50089 | 122 | 4.0(10)-5 | Saccharomyces cerevisiae | hypothetical 89.2 kd protein in yhb1-pfk1 intergenic region. |
| CONTIG4481 | 2087750_f3_7 | 721 | 14824 | 1971 | 657 | P50090 | 800 | 1.0(10)-79 | Saccharomyces cerevisiae | hypothetical 100.0 kd protein in yhb1-pfk1 intergenic region. |
| CONTIG2919 | 2376505_c1_7 | 722 | 14825 | 534 | 178 | P53313 | 345 | 4.2(10)-41 | Saccharomyces cerevisiae | hypothetical 86.6 kd protein in pfk1-tds4 intergenic region. |
| CONTIG4371 | 4079643_f1_1 | 723 | 14826 | 651 | 217 | P53313 | 486 | 6.0(10)-46 | Saccharomyces cerevisiae | hypothetical 86.6 kd protein in pfk1-tds4 intergenic region. |
| b3x16281.x | 3191000_f1_1 | 724 | 14827 | 774 | 258 | P53313 | 920 | 1.8(10)-92 | Saccharomyces cerevisiae | hypothetical 86.6 kd protein in pfk1-tds4 intergenic region. |
| CONTIG5580 | 6146938_f2_4 | 725 | 14828 | 744 | 248 | P53314 | 166 | 1.5(10)-24 | Saccharomyces cerevisiae | hypothetical 26.7 kd protein in mga1 intergenic region. |
| CONTIG3849 | 19703452_c3_13 | 726 | 14829 | 498 | 166 | P53317 | 100 | 2.7(10)-5 | Saccharomyces cerevisiae | hypothetical 22.3 kd protein in mga1-gen4 intergenic region. |
| CONTIG4091 | 25797125_c1_6 | 727 | 14830 | 1104 | 368 | P53320 | 620 | 1.2(10)-60 | Saccharomyces cerevisiae | putative mitochondrial carrier ygr257c. |
| CONTIG1658 | 29304217_c3_5 | 728 | 14831 | 654 | 218 | P53324 | 95 | 0.039 | Saccharomyces cerevisiae | hypothetical 48.5 kd protein in apl6-mes1 intergenic region. |
| CONTIG2484 | 3907500_f2_1 | 729 | 14832 | 1122 | 374 | P53324 | 123 | 6.7(10)-5 | Saccharomyces cerevisiae | hypothetical 48.5 kd protein in apl6-mes1 intergenic region. |
| CONTIG3380 | 21760000_c1_4 | 730 | 14833 | 1152 | 384 | P53324 | 190 | 2.3(10)-12 | Saccharomyces cerevisiae | hypothetical 48.5 kd protein in apl6-mes1 intergenic region. |
| CONTIG4490 | 23472215_f3_3 | 731 | 14834 | 1287 | 429 | P53324 | 181 | 3.7(10)-11 | Saccharomyces cerevisiae | hypothetical 48.5 kd protein in apl6-mes1 intergenic region. |
| CONTIG5554 | 9806587_f1_4 | 732 | 14835 | 1254 | 418 | P53324 | 180 | 4.4(10)-11 | Saccharomyces cerevisiae | hypothetical 48.5 kd protein in apl6-mes1 intergenic region. |
| CONTIG5727 | 6040627_f2_6 | 733 | 14836 | 1071 | 357 | P53324 | 177 | 6.7(10)-11 | Saccharomyces cerevisiae | hypothetical 48.5 kd protein in apl6-mes1 intergenic region. |
| CONTIG2072 | 4296877_f2_3 | 734 | 14837 | 963 | 321 | P53326 | 509 | 6.9(10)-49 | Saccharomyces cerevisiae | hypothetical 81.2 kd protein in mes1-fol2 intergenic region. |
| CONTIG3749 | 5119828_f1_1 | 735 | 14838 | 654 | 218 | P53326 | 318 | 9.5(10)-28 | Saccharomyces cerevisiae | hypothetical 81.2 kd protein in mes1-fol2 intergenic region. |
| CONTIG3849 | 4100692_f1_1 | 736 | 14839 | 396 | 132 | P40325 | 109 | 2.5(10)-6 | Saccharomyces cerevisiae | hypothetical 22.4 kd protein in fol2- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1015 | 16414137_f2_1 | 737 | 14840 | 867 | 289 | P53327 | 601 | 4.2(10)-57 | Saccharomyces cerevisiae | yta7 intergenic region. hypothetical 224.8 kd protein in yta7-taf145 intergenic region. |
| CONTIG1720 | 1072582_f2_1 | 738 | 14841 | 1008 | 336 | P53327 | 1356 | 4.5(10)-138 | Saccharomyces cerevisiae | hypothetical 224.8 kd protein in yta7-taf145 intergenic region. |
| CONTIG2182 | 4000876_f3_1 | 739 | 14842 | 810 | 270 | P53327 | 389 | 1.5(10)-34 | Saccharomyces cerevisiae | hypothetical 224.8 kd protein in yta7-taf145 intergenic region. |
| CONTIG4896 | 35187912_c1_7 | 740 | 14843 | 2811 | 937 | P53327 | 3340 | 0 | Saccharomyces cerevisiae | hypothetical 224.8 kd protein in yta7-taf145 intergenic region. |
| CONTIG3655 | 12922150_f3_3 | 741 | 14844 | 237 | 79 | P53328 | 102 | 9.3(10)-6 | Saccharomyces cerevisiae | hypothetical 17.9 kd protein in yta7-taf145 intergenic region. |
| CONTIG3655 | 912553_f3_4 | 742 | 14845 | 477 | 159 | P53328 | 168 | 9.4(10)-13 | Saccharomyces cerevisiae | hypothetical 17.9 kd protein in yta7-taf145 intergenic region. |
| CONTIG4340 | 15042160_f1_2 | 743 | 14846 | 1341 | 447 | P53331 | 358 | 1.3(10)-32 | Saccharomyces cerevisiae | hypothetical 62.8 kd protein in taf145-yor1 intergenic region. |
| CONTIG5048 | 9859381_f3_4 | 744 | 14847 | 1005 | 335 | P53332 | 366 | 9.8(10)-34 | Saccharomyces cerevisiae | hypothetical 34.3 kd protein in taf145-yor1 intergenic region. |
| CONTIG4274 | 31672540_f1_1 | 745 | 14848 | 1236 | 412 | P53334 | 653 | 3.7(10)-64 | Saccharomyces cerevisiae | hypothetical 40.2 kd protein in taf145-yor1 intergenic region. |
| CONTIG5393 | 35192158_c3_20 | 746 | 14849 | 189 | 63 | P53335 | 178 | 8.1(10)-14 | Saccharomyces cerevisiae | hypothetical 31.3 kd protein in taf145-yor1 intergenic region. |
| CONTIG3351 | 20320250_f2_2 | 747 | 14850 | 948 | 316 | P53337 | 505 | 1.8(10)-48 | Saccharomyces cerevisiae | hypothetical 35.0 kd protein in bgl2-zuo1 intergenic region. |
| CONTIG5245 | 22437652_f2_6 | 748 | 14851 | 702 | 234 | P53193 | 191 | 3.3(10)-15 | Saccharomyces cerevisiae | hypothetical 21.8 kd protein in ckb1-ate1 intergenic region. |
| CONTIG5245 | 30272885_f1_5 | 749 | 14852 | 375 | 125 | P53192 | 119 | 3.2(10)-7 | Saccharomyces cerevisiae | hypothetical 27.1 kd protein in alk1-ckb1 intergenic region. |
| CONTIG1957 | 22437936_c1_3 | 750 | 14853 | 993 | 331 | P53189 | 725 | 8.9(10)-72 | Saccharomyces cerevisiae | hypothetical 56.4 kd protein in rpl32-cwh41 intergenic region precursor. |
| CONTIG5688 | 1366302_f2_8 | 751 | 14854 | 534 | 178 | P53188 | 154 | 2.8(10)-11 | Saccharomyces cerevisiae | hypothetical 14.4 kd protein in rpl32-cwh41 intergenic region. |
| CONTIG5795 | 2831532_c1_32 | 752 | 14855 | 1881 | 627 | P53179 | 221 | 1.7(10)-17 | Saccharomyces cerevisiae | hypothetical 29.4 kd protein in sug1-rna15 intergenic region. |
| CONTIG4495 | 9859830_f2_1 | 753 | 14856 | 861 | 287 | P53177 | 517 | 9.8(10)-50 | Saccharomyces cerevisiae | hypothetical 30.8 kd protein in ole1-tif4632 intergenic region. |
| CONTIG4395 | 23626552_f2_4 | 754 | 14857 | 411 | 137 | P53173 | 429 | 2.1(10)-40 | Saccharomyces cerevisiae | hypothetical 15.9 kd protein in ole1-tif4632 intergenic region. |
| CONTIG4558 | 29306687_c1_8 | 755 | 14858 | 714 | 238 | P53169 | 97 | 0.04399 | Saccharomyces cerevisiae | hypothetical 73.1 kd protein in pyc1-ubc2 intergenic region. |
| CONTIG5171 | 12753942_c3_12 | 756 | 14859 | 1521 | 507 | P53165 | 217 | 2.2(10)-26 | Saccharomyces cerevisiae | hypothetical 72.9 kd protein in rpb9-alg2 intergenic region. |
| CONTIG1209 | 23605012_c3_1 | 757 | 14860 | 537 | 179 | P53164 | 160 | 3.2(10)-11 | Saccharomyces cerevisiae | hypothetical 43.5 kd protein in rpb9-alg2 intergenic region. |
| CONTIG2381 | 24067761_f2_3 | 758 | 14861 | 318 | 106 | P53164 | 101 | 8.8(10)-5 | Saccharomyces cerevisiae | hypothetical 43.5 kd protein in rpb9-alg2 intergenic region. |
| CONTIG4883 | 35802_f2_3 | 759 | 14862 | 495 | 165 | P53157 | 357 | 8.8(10)-33 | Saccharomyces cerevisiae | hypothetical 15.0 kd protein in syc1-hnm1 intergenic region. |
| CONTIG4386 | 9971000_c3_8 | 760 | 14863 | 1230 | 410 | P53154 | 1188 | 7.7(10)-121 | Saccharomyces cerevisiae | hypothetical 65.3 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4386 | 19728427_c3_7 | 761 | 14864 | 606 | 202 | P53154 | 310 | 3.5(10)-27 | Saccharomyces cerevisiae | hypothetical 65.3 kd protein in mad1-scy1 intergenic region. |
| CONTIG1247 | 23941552_c2_3 | 762 | 14865 | 741 | 247 | P53153 | 366 | 9.8(10)-34 | Saccharomyces cerevisiae | hypothetical 32.1 kd protein in mad1-scy1 intergenic region. |
| CONTIG4360 | 5104135_f2_1 | 763 | 14866 | 1911 | 637 | P53148 | 285 | 1.1(10)-21 | Saccharomyces cerevisiae | hypothetical 104.8 kd protein in pan2-nup145 intergenic region. |
| CONTIG4954 | 4020162_f3_7 | 764 | 14867 | 2064 | 688 | P53145 | 1597 | 1.1(10)-178 | Saccharomyces cerevisiae | hypothetical gtp-binding protein in sch1-prp20 intergenic region. |
| CONTIG4126 | 24882202_f1_3 | 765 | 14868 | 897 | 299 | P43343 | 90 | 0.033 | Serratia marcescens | hypothetical 17.8 kd protein in rpod 3'region. |
| CONTIG4478 | 2814032_f2_2 | 766 | 14869 | 705 | 235 | P53144 | 352 | 3.0(10)-32 | Saccharomyces cerevisiae | hypothetical 25.3 kd protein in cyh2-seh1 intergenic region. |
| CONTIG4787 | 24642158_c3_12 | 767 | 14870 | 1371 | 457 | P53137 | 312 | 3.1(10)-45 | Saccharomyces cerevisiae | hypothetical 72.0 kd protein in taf60-g4p1 intergenic region. |
| CONTIG5761 | 6837777_f3_14 | 768 | 14871 | 1224 | 408 | P53136 | 192 | 3.8(10)-20 | Saccharomyces cerevisiae | hypothetical 51.9 kd protein in taf60-g4p1 intergenic region. |
| CONTIG4476 | 4775285_c1_8 | 769 | 14872 | 1197 | 399 | P3135 | 93 | 0.28 | Saccharomyces cerevisiae | hypothetical 77.3 kd protein in snf4-taf60 intergenic region. |
| CONTIG2551 | 16422132_f1_1 | 770 | 14873 | 1365 | 455 | P53134 | 645 | 2.7(10)-63 | Saccharomyces cerevisiae | hypothetical 80.0 kd protein in snf4-taf60 intergenic region. |
| b1x18334.y | 35277300_c3_2 | 771 | 14874 | 348 | 116 | P53134 | 280 | 1.3(10)-23 | Saccharomyces cerevisiae | hypothetical 80.0 kd protein in snf4-taf60 intergenic region. |
| CONTIG5294 | 4453436_c2_11 | 772 | 14875 | 1929 | 643 | P53129 | 411 | 1.3(10)-36 | Saccharomyces cerevisiae | hypothetical 73.5 kd protein in scs3-sup44 intergenic region. |
| CONTIG3383 | 21909427_f2_1 | 773 | 14876 | 1059 | 353 | Q01163 | 242 | 6.4(10)-20 | Saccharomyces cerevisiae | hypothetical 55.6 kd protein in ceg1-soh1 intergenic region. |
| CONTIG4824 | 2386468_f2_3 | 774 | 14877 | 816 | 272 | P53127 | 327 | 3.7(10)-28 | Saccharomyces cerevisiae | hypothetical 163.2 kd protein in ssm1b-ceg1 intergenic region. |
| CONTIG4824 | 12343933_f3_6 | 775 | 14878 | 1500 | 500 | P53127 | 246 | 1.6(10)-25 | Saccharomyces cerevisiae | hypothetical 163.2 kd protein in ssm1b-ceg1 intergenic region. |
| CONTIG5110 | 10945140_c3_10 | 776 | 14879 | 849 | 283 | P53127 | 179 | 8.9(10)-11 | Saccharomyces cerevisiae | hypothetical 163.2 kd protein in ssm1b-ceg1 intergenic region. |
| CONTIG5110 | 21516391_c2_9 | 777 | 14880 | 243 | 81 | P53127 | 103 | 0.00027 | Saccharomyces cerevisiae | hypothetical 163.2 kd protein in ssm1b-ceg1 intergenic region. |
| CONTIG2152 | 9980192_f2_1 | 778 | 14881 | 744 | 248 | P53125 | 136 | 7.5(10)-8 | Saccharomyces cerevisiae | hypothetical 145.6 kd protein in ssm1b-ccg1 intergenic region. |
| CONTIG4593 | 22548377_f3_2 | 779 | 14882 | 1182 | 394 | P53123 | 169 | 2.7(10)-10 | Saccharomyces cerevisiae | hypothetical 37.4 kd protein in sec27-ssm1b intergenic region. |
| CONTIG2011 | 782252_c3_3 | 780 | 14883 | 1044 | 348 | P53121 | 957 | 2.2(10)-96 | Saccharomyces cerevisiae | hypothetical 90.8 kd protein in mrf1-sec27 intergenic region. |
| CONTIG4571 | 24020176_c3_8 | 781 | 14884 | 387 | 129 | P30777 | 136 | 3.0(10)-8 | Saccharomyces cerevisiae | hypothetical 72.6 kd protein in mrf1-sec27 intergenic region. |
| CONTIG4571 | 23929025_c2_6 | 782 | 14885 | 219 | 73 | P30777 | 105 | 6.2(10)-5 | Saccharomyces cerevisiae | hypothetical 72.6 kd protein in mrf1-sec27 intergenic region. |
| CONTIG5602 | 26587777_f2_6 | 783 | 14886 | 2253 | 751 | P53118 | 1220 | 3.1(10)-124 | Saccharomyces cerevisiae | hypothetical 78.1 kd protein in tip20-mrf1 intergenic region. |
| CONTIG5768 | 10157032_f2_9 | 784 | 14887 | 1131 | 377 | P53110 | 279 | 1.6(10)-24 | Saccharomyces cerevisiae | hypothetical 41.6 kd protein in sut1-rck1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4642 | 985817_f3_5 | 785 | 14888 | 531 | 177 | P53108 | 184 | 3.3(10)-14 | Saccharomyces cerevisiae | hypothetical 34.8 kd protein in sut1 rck1 intergenic region. |
| b9x11c30.y | 26375317_f2_1 | 786 | 14889 | 585 | 195 | P53107 | 198 | 9.3(10)-26 | Saccharomyces cerevisiae | hypothetical 50.3 kd protein in ace1-rad54 intergenic region. |
| CONTIG4768 | 10805312_c1_10 | 787 | 14890 | 2559 | 853 | P53094 | 259 | 1.1(10)-34 | Saccharomyces cerevisiae | hypothetical 167.1 kd protein in cmp24-gen1 intergenic region. |
| CONTIG2954 | 36582072_c1_5 | 788 | 14891 | 699 | 233 | P53088 | 535 | 3.0(10)-56 | Saccharomyces cerevisiae | hypothetical 21.9 kd protein in van7-ypl32 intergenic region. |
| CONTIG2816 | 15026907_c3_11 | 789 | 14892 | 798 | 266 | P53078 | 507 | 1.1(10)-48 | Saccharomyces cerevisiae | hypothetical 32.0 kd protein in gog5-clg1 intergenic region. |
| CONTIG5752 | 14948801_c2_19 | 790 | 14893 | 600 | 200 | P53073 | 260 | 1.7(10)-22 | Saccharomyces cerevisiae | hypothetical 21.5 kd protein in sec15-sap4 intergenic region. |
| CONTIG5752 | 4375000_f3_10 | 791 | 14894 | 864 | 288 | P53072 | 447 | 2.6(10)-42 | Saccharomyces cerevisiae | hypothetical 33.6 kd protein in sec15-sap4 intergenic region. |
| CONTIG4535 | 5109703_f2_2 | 792 | 14895 | 303 | 101 | P53070 | 112 | 1.3(10)-5 | Saccharomyces cerevisiae | hypothetical 75.4 kd protein in hap2-ade5,6 intergenic region. |
| CONTIG5017 | 25985663_c1_5 | 793 | 14896 | 231 | 77 | P53067 | 151 | 1.3(10)-9 | Saccharomyces cerevisiae | hypothetical 113.9 kd protein in pdc1-cse1 intergenic region. |
| CONTIG5402 | 14179201_f2_3 | 794 | 14897 | 708 | 236 | P53067 | 318 | 2.1(10)-27 | Saccharomyces cerevisiae | hypothetical 113.9 kd protein in pde1-cse1 intergenic region. |
| CONTIG5402 | 12320142_f1_2 | 795 | 14898 | 2028 | 676 | P53067 | 574 | 6.5(10)-65 | Saccharomyces cerevisiae | hypothetical 113.9 kd protein in pdc1-cse1 intergenic region. |
| CONTIG4913 | 81891_f2_2 | 796 | 14899 | 627 | 209 | P53066 | 412 | 1.3(10)-38 | Saccharomyces cerevisiae | hypothetical 20.1 kd protein in pde1-cse1 intergenic region. |
| CONTIG4301 | 29323575_f3_8 | 797 | 14900 | 573 | 191 | P53065 | 237 | 1.1(10)-19 | Saccharomyces cerevisiae | hypothetical 45.9 kd protein in pdc1-cse1 intergenic region. |
| CONTIG1060 | 4064135_f1_1 | 798 | 14901 | 699 | 233 | P53063 | 481 | 6.4(10)-46 | Saccharomyces cerevisiae | hypothetical 44.5 kd protein in pde1-cse1 intergenic region. |
| CONTIG4790 | 13876625_c2_11 | 799 | 14902 | 1026 | 342 | P53063 | 164 | 1.5(10)-9 | Saccharomyces cerevisiae | hypothetical 44.5 kd protein in pdc1-cse1 intergenic region. |
| CONTIG4126 | 5114032_c2_10 | 800 | 14903 | 933 | 311 | P53062 | 186 | 1.2(10)-14 | Saccharomyces cerevisiae | hypothetical 22.8 kd protein in pde1-cse1 intergenic region. |
| CONTIG5815 | 2063950_f1_7 | 801 | 14904 | 1224 | 408 | P38887 | 890 | 2.8(10)-89 | Saccharomyces cerevisiae | hypothetical 69.0 kd protein in ppx1-rps7a intergenic region. |
| CONTIG5815 | 24300062_f2_16 | 802 | 14905 | 588 | 196 | P38887 | 180 | 5.4(10)-13 | Saccharomyces cerevisiae | hypothetical 69.0 kd protein in ppx1-rps7a intergenic region. |
| CONTIG5154 | 24226087_c1_11 | 803 | 14906 | 612 | 204 | P38890 | 251 | 8.3(10)-21 | Saccharomyces cerevisiae | hypothetical 60.5 kd protein in skn7-twt1 intergenic region. |
| CONTIG5442 | 4102137_c2_14 | 804 | 14907 | 555 | 185 | P38892 | 319 | 9.4(10)-29 | Saccharomyces cerevisiae | hypothetical 33.8 kd protein in twt1-pho12 intergenic region. |
| b1x19728.x | 36335306_f1_1 | 805 | 14908 | 618 | 206 | P38892 | 108 | 0.00042 | Saccharomyces cerevisiae | hypothetical 33.8 kd protein in twt1-pho12 intergenic region. |
| b3x14382.x | 23831557_f3_1 | 806 | 14909 | 411 | 137 | P35649 | 177 | 1.1(10)-12 | Eikenella corrodens | hypothetical 66.3 kd protein in hag2 5'region. |
| CONTIG3285 | 23703430_f1_2 | 807 | 14910 | 1158 | 386 | P38753 | 657 | 1.3(10)-64 | Saccharomyces cerevisiae | hypothetical 51.2 kd protein in lag1-rpl14b intergenic region. |
| CONTIG3035 | 23472677_f2_2 | 808 | 14911 | 1215 | 405 | P38749 | 215 | 6.5(10)-16 | Saccharomyces cerevisiae | hypothetical 38.0 kd protein in prps4-ste20 intergenic region. |
| CONTIG5394 | 13477212_f1_2 | 809 | 14912 | 1248 | 416 | P38749 | 215 | 8.0(10)-16 | Saccharomyces cerevisiae | hypothetical 38.0 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5817 | 24792087_c2_51 | 810 | 14913 | 1479 | 493 | P38748 | 385 | 3.8(10)-66 | Saccharomyces cerevisiae | prps4-ste20 intergenic region. hypothetical 67.5 kd protein in prps4-ste20 intergenic region. |
| CONTIG5817 | 3938825_c3_61 | 811 | 14914 | 354 | 118 | P38748 | 122 | 8.8(10)-7 | Saccharomyces cerevisiae | hypothetical 67.5 kd protein in prps4-ste20 intergenic region. |
| CONTIG4867 | 33594062_f1_3 | 812 | 14915 | 1023 | 341 | P38747 | 491 | 5.5(10)-47 | Saccharomyces cerevisiae | hypothetical 36.1 kd protein in ylf2-prps4 intergenic region. |
| CONTIG2148 | 5895657_c3_8 | 813 | 14916 | 789 | 263 | P23180 | 216 | 4.0(10)-17 | Saccharomyces cerevisiae | hypothetical 53.1 kd protein in spo11-opi1 intergenic region. |
| CONTIG5234 | 6829777_c3_19 | 814 | 14917 | 1260 | 420 | P38742 | 163 | 2.5(10)-22 | Saccharomyces cerevisiae | hypothetical 130.0 kd protein in snf6-spo11 intergenic region. |
| CONTIG5598 | 15630010_f3_13 | 815 | 14918 | 1707 | 569 | P38741 | 420 | 8.0(10)-39 | Saccharomyces cerevisiae | hypothetical 80.1 kd protein in snf6-spo11 intergenic region. |
| CONTIG5079 | 29487677_c3_9 | 816 | 14919 | 1119 | 373 | P38738 | 171 | 4.7(10)-21 | Saccharomyces cerevisiae | hypothetical 77.8 kd protein in gut1-rim1 intergenic region. |
| CONTIG5683 | 210937_f1_6 | 817 | 14920 | 1119 | 373 | P38738 | 146 | 3.0(10)-15 | Saccharomyces cerevisiae | hypothetical 77.8 kd protein in gut1-rim1 intergenic region. |
| CONTIG5035 | 32610175_f1_1 | 818 | 14921 | 420 | 140 | P38737 | 98 | 0.00889 | Saccharomyces cerevisiae | hypothetical 210.4 kd protein in gut1-rim1 intergenic region. |
| CONTIG5683 | 19567257_c1_16 | 819 | 14922 | 1359 | 453 | P38737 | 438 | 8.8(10)-40 | Saccharomyces cerevisiae | hypothetical 210.4 kd protein in gut1-rim1 intergenic region. |
| b1x10655.y | 1178830_c1_4 | 820 | 14923 | 891 | 297 | P38737 | 627 | 6.5(10)-60 | Saccharomyces cerevisiae | hypothetical 210.4 kd protein in gut1-rim1 intergenic region. |
| CONTIG5155 | 10972531_c1_12 | 821 | 14924 | 681 | 227 | P38736 | 340 | 5.5(10)-31 | Saccharomyces cerevisiae | hypothetical 25.4 kd protein in gut1-rim1 intergenic region. |
| CONTIG3715 | 19538927_f3_1 | 822 | 14925 | 1758 | 586 | P38732 | 565 | 8.0(10)-55 | Saccharomyces cerevisiae | hypothetical 67.5 kd protein in cbp2 5'region. |
| CONTIG2855 | 12140933_c3_4 | 823 | 14926 | 909 | 303 | P38757 | 240 | 8.5(10)-40 | Saccharomyces cerevisiae | hypothetical 50.6 kd protein in rpl14b-gpa1 intergenic region. |
| CONTIG4553 | 137_f1_1 | 824 | 14927 | 1080 | 360 | P38758 | 278 | 4.5(10)-44 | Saccharomyces cerevisiae | hypothetical 57.0 kd protein in sod2-rpl27 intergenic region. |
| CONTIG2218 | 29416405_f2_1 | 825 | 14928 | 927 | 309 | P41907 | 120 | 8.5(10)-5 | Saccharomyces douglasii | hypothetical 44.4 kd protein in spo13-arg4 intergenic region. |
| CONTIG5342 | 24414687_c1_14 | 826 | 14929 | 978 | 326 | P38768 | 331 | 5.0(10)-30 | Saccharomyces cerevisiae | hypothetical 39.5 kd protein in slt2-put2 intergenic region. |
| CONTIG5174 | 24430287_f3_3 | 827 | 14930 | 1107 | 369 | P38770 | 105 | 0.0061 | Saccharomyces cerevisiae | hypothetical 53.4 kd protein in slt2-put2 intergenic region. |
| CONTIG3828 | 3134635_c3_6 | 828 | 14931 | 1023 | 341 | P45417 | 98 | 0.029 | Erwinia chrysanthemi | hypothetical 36.0 kd protein in kdgk 5'region (k1 orf). |
| CONTIG3991 | 2928552_c1_7 | 829 | 14932 | 831 | 277 | P38772 | 130 | 6.7(10)-10 | Saccharomyces cerevisiae | hypothetical 42.3 kd protein in put2-srb2 intergenic region. |
| CONTIG5727 | 12320437_c3_30 | 830 | 14933 | 1419 | 473 | P38775 | 184 | 6.2(10)-19 | Saccharomyces cerevisiae | hypothetical 62.7 kd protein in dog1-aap1 intergenic region. |
| CONTIG1837 | 24226377_f1_1 | 831 | 14934 | 453 | 151 | P38779 | 139 | 6.2(10)-9 | Saccharomyces cerevisiae | hypothetical 42.5 kd protein in cox6-cup1 intergenic region. |
| CONTIG3857 | 11754662_c1_6 | 832 | 14935 | 558 | 186 | P38786 | 112 | 1.3(10)-13 | Saccharomyces cerevisiae | hypothetical 32.2 kd protein in vma22-rrp3 intergenic region. |
| CONTIG2317 | 802018_f1_1 | 833 | 14936 | 819 | 273 | P38788 | 679 | 6.7(10)-67 | Saccharomyces cerevisiae | heat shock protein 70 homolog yhr064c. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4019 | 34621093_c2_8 | 834 | 14937 | 549 | 183 | P38790 | 138 | 3.8(10)-9 | Saccharomyces cerevisiae | hypothetical 33.1 kd protein in ssf1-dys1 intergenic region. |
| CONTIG1881 | 36507697_c3_3 | 835 | 14938 | 816 | 272 | P38792 | 798 | 2.3(10)-91 | Saccharomyces cerevisiae | hypothetical 39.4 kd protein in dys1-erg7 intergenic region. |
| CONTIG5727 | 468826_f1_2 | 836 | 14939 | 930 | 310 | P38794 | 133 | 3.8(10)-7 | Saccharomyces cerevisiae | hypothetical 26.5 kd protein in dys1-erg7 intergenic region. |
| CONTIG5718 | 23728436_f1_3 | 837 | 14940 | 2148 | 716 | P38795 | 2641 | 8.1(10)-275 | Saccharomyces cerevisiae | hypothetical 80.7 kd protein in erg7-nmd2 intergenic region. |
| CONTIG5718 | 9876910_c1_12 | 838 | 14941 | 1107 | 369 | P38796 | 403 | 1.2(10)-37 | Saccharomyces cerevisiae | hypothetical 44.9 kd protein in erg7-nmd2 intergenic region. |
| CONTIG3841 | 31453213_f3_3 | 839 | 14942 | 672 | 224 | P38797 | 557 | 5.5(10)-54 | Saccharomyces cerevisiae | hypothetical 41.2 kd protein in erg7-nmd2 intergenic region. |
| CONTIG5364 | 12923450_c1_9 | 840 | 14943 | 2217 | 739 | P38800 | 520 | 9.0(10)-49 | Saccharomyces cerevisiae | hypothetical 149.7 kd protein in ire1-ksp1 intergenic region. |
| CONTIG149 | 4098277_c3_4 | 841 | 14944 | 651 | 217 | P38801 | 144 | 3.2(10)-10 | Saccharomyces cerevisiae | hypothetical 21.0 kd protein in ksp1 intergenic region. |
| CONTIG1515 | 4313882_f3_5 | 842 | 14945 | 855 | 285 | P38803 | 209 | 1.5(10)-25 | Saccharomyces cerevisiae | hypothetical 37.9 kd protein in ste12-nam8 intergenic region. |
| CONTIG5603 | 22456507_f1_3 | 843 | 14946 | 402 | 134 | P38804 | 151 | 5.9(10)-11 | Saccharomyces cerevisiae | hypothetical 12.0 kd protein in nam8-gar1 intergenic region. |
| CONTIG5314 | 25836002_c3_15 | 844 | 14947 | 924 | 308 | P38805 | 808 | 1.3(10)-80 | Saccharomyces cerevisiae | hypothetical 35.1 kd protein in nam8-gar1 intergenic region. |
| CONTIG2603 | 19565967_f2_2 | 845 | 14948 | 300 | 100 | P38806 | 242 | 1.3(10)-20 | Saccharomyces cerevisiae | hypothetical 32.1 kd protein in gar1-msr1 intergenic region. |
| CONTIG1503 | 35287809_c1_2 | 846 | 14949 | 501 | 167 | P38809 | 121 | 5.4(10)-7 | Saccharomyces cerevisiae | hypothetical 40.7 kd protein in hxt5-nrk1 intergenic region. |
| CONTIG5260 | 21595180_f3_5 | 847 | 14950 | 2763 | 921 | P38810 | 764 | 3.8(10)-112 | Saccharomyces cerevisiae | hypothetical 104.0 kd protein in hxt5-nrk1 intergenic region. |
| CONTIG1273 | 9820388_f2_1 | 848 | 14951 | 1224 | 408 | P38811 | 725 | 7.4(10)-70 | Saccharomyces cerevisiae | hypothetical 433.2 kd protein in hxt5-nrk1 intergenic region. |
| CONTIG1273 | 4493903_f3_3 | 849 | 14952 | 192 | 64 | P38811 | 103 | 0.00077 | Saccharomyces cerevisiae | hypothetical 433.2 kd protein in hxt5-nrk1 intergenic region. |
| CONTIG5146 | 2932950_f1_3 | 850 | 14953 | 345 | 115 | P38811 | 196 | 1.1(10)-13 | Saccharomyces cerevisiae | hypothetical 433.2 kd protein in hxt5-nrk1 intergenic region. |
| CONTIG2684 | 975752_f3_2 | 851 | 14954 | 768 | 256 | P38811 | 442 | 8.1(10)-40 | Saccharomyces cerevisiae | hypothetical 433.2 kd protein in hxt5-nrk1 intergenic region. |
| CONTIG2684 | 22289681_f3_3 | 852 | 14955 | 414 | 138 | P38811 | 247 | 4.0(10)-19 | Saccharomyces cerevisiae | hypothetical 433.2 kd protein in hxt5-nrk1 intergenic region. |
| CONTIG2684 | 4790927_f1_1 | 853 | 14956 | 642 | 214 | P38811 | 479 | 9.5(10)-44 | Saccharomyces cerevisiae | hypothetical 433.2 kd protein in hxt5-nrk1 intergenic region. |
| CONTIG3275 | 31753138_c1_5 | 854 | 14957 | 1392 | 464 | P38811 | 1744 | 3.7(10)-178 | Saccharomyces cerevisiae | hypothetical 433.2 kd protein in hxt5-nrk1 intergenic region. |
| CONTIG5146 | 35208393_f3_8 | 855 | 14958 | 1824 | 608 | P38811 | 1291 | 1.2(10)-154 | Saccharomyces cerevisiae | hypothetical 433.2 kd protein in hxt5-nrk1 intergenic region. |
| CONTIG5146 | 24850936_c3_17 | 856 | 14959 | 402 | 134 | P38812 | 322 | 4.5(10)-29 | Saccharomyces cerevisiae | hypothetical 20.9 kd protein in hxt5-nrk1 intergenic region. |
| CONTIG5146 | 34072262_c3_16 | 857 | 14960 | 276 | 92 | P38812 | 164 | 2.5(10)-12 | Saccharomyces cerevisiae | hypothetical 20.9 kd protein in hxt5-nrk1 intergenic region. |
| CONTIG2312 | 25551701_f2_1 | 858 | 14961 | 1644 | 548 | P38814 | 114 | 0.0032 | Saccharomyces cerevisiae | hypothetical 96.4 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4805 | 33400307_f3_3 | 859 | 14962 | 507 | 169 | P38815 | 127 | 2.6(10)-8 | Saccharomyces cerevisiae | hypothetical 24.6 kd protein in nrk1-cdc12 intergenic region. |
| CONTIG3625 | 11025278_f3_1 | 860 | 14963 | 966 | 322 | P38817 | 819 | 9.6(10)-82 | Saccharomyces cerevisiae | hypothetical 64.3 kd protein in cdc12-orc6 intergenic region. |
| CONTIG4231 | 595950_c3_14 | 861 | 14964 | 681 | 227 | P38817 | 263 | 5.5(10)-22 | Saccharomyces cerevisiae | hypothetical 64.3 kd protein in cdc12-orc6 intergenic region. |
| CONTIG3444 | 4381300_f2_4 | 862 | 14965 | 822 | 274 | P38818 | 99 | 1.7(10)-5 | Saccharomyces cerevisiae | hypothetical 68.3 kd protein in cdc12-orc6 intergenic region. |
| CONTIG1329 | 970327_c2_3 | 863 | 14966 | 1101 | 367 | P38822 | 222 | 1.8(10)-17 | Saccharomyces cerevisiae | hypothetical 71.2 kd protein in cdc12-orc6 intergenic region. |
| CONTIG2212 | 14571875_c1_2 | 864 | 14967 | 648 | 216 | P38822 | 433 | 1.1(10)-40 | Saccharomyces cerevisiae | hypothetical 71.2 kd protein in cdc12-orc6 intergenic region. |
| CONTIG3703 | 3909375_f3_4 | 865 | 14968 | 492 | 164 | P38824 | 220 | 2.8(10)-18 | Saccharomyces cerevisiae | hypothetical 17.3 kd protein in cdc12-orc6 intergenic region. |
| CONTIG5029 | 4332753_f3_6 | 866 | 14969 | 687 | 229 | P38829 | 362 | 5.2(10)-37 | Saccharomyces cerevisiae | hypothetical 25.7 kd protein in msh1-cpl1 intergenic region. |
| CONTIG5332 | 23476587_c1_8 | 867 | 14970 | 477 | 159 | Q03000 | 167 | 4.0(10)-12 | Saccharomyces kluyveri | hypothetical protein in his3 3'region (fragment). |
| CONTIG4899 | 25562760_f2_3 | 868 | 14971 | 1557 | 519 | P38835 | 379 | 4.9(10)-39 | Saccharomyces cerevisiae | hypothetical 95.1 kd protein in act5-yck1 intergenic region. |
| CONTIG5061 | 25943801_f2_6 | 869 | 14972 | 678 | 226 | P38836 | 179 | 3.6(10)-13 | Saccharomyces cerevisiae | hypothetical 49.8 kd protein in act3-yck1 intergenic region precursor. |
| CONTIG5061 | 33492053_f1_2 | 870 | 14973 | 486 | 162 | P38836 | 469 | 1.2(10)-44 | Saccharomyces cerevisiae | hypothetical 49.8 kd protein in act3-yck1 intergenic region precursor. |
| CONTIG5616 | 3964061_c2_32 | 871 | 14974 | 930 | 310 | P38838 | 310 | 8.4(10)-28 | Saccharomyces cerevisiae | hypothetical 30.6 kd protein in act5-yck1 intergenic region. |
| CONTIG3240 | 93777_f1_1 | 872 | 14975 | 432 | 144 | P38841 | 103 | 7.2(10)-6 | Saccharomyces cerevisiae | hypothetical 12.8 kd protein in yck1-sps100 intergenic region precursor. |
| CONTIG4506 | 128_c1_13 | 873 | 14976 | 777 | 259 | P38842 | 199 | 4.9(10)-16 | Saccharomyces cerevisiae | hypothetical 27.0 kd protein in sps100-rpl44 intergenic region. |
| CONTIG3496 | 869052_f3_4 | 874 | 14977 | 855 | 285 | P38843 | 571 | 1.8(10)-55 | Saccharomyces cerevisiae | hypothetical 34.9 kd protein in rpl44-dcd1 intergenic region. |
| CONTIG5538 | 13782952_f1_1 | 875 | 14978 | 1197 | 399 | P38848 | 167 | 3.7(10)-16 | Saccharomyces cerevisiae | hypothetical 66.1 kd protein in mrpl6-spo12 intergenic region. |
| CONTIG5538 | 23834385_f2_7 | 876 | 14979 | 624 | 208 | P38848 | 193 | 2.0(10)-14 | Saccharomyces cerevisiae | hypothetical 66.1 kd protein in mrpl6-spo12 intergenic region. |
| CONTIG3910 | 9970912_f1_1 | 877 | 14980 | 1671 | 557 | P38849 | 310 | 8.3(10)-29 | Saccharomyces cerevisiae | hypothetical 59.8 kd protein in mrpl6-spo12 intergenic region. |
| CONTIG2384 | 24711087_c2_5 | 878 | 14981 | 795 | 265 | P38852 | 102 | 1.3(10)-6 | Saccharomyces cerevisiae | hypothetical 40.4 kd protein in spo16-rec104 intergenic region. |
| CONTIG5795 | 26270192_f1_1 | 879 | 14982 | 549 | 183 | P38853 | 112 | 2.0(10)-11 | Saccharomyces cerevisiae | hypothetical 131.1 kd protein in rec104-sol3 intergenic region. |
| CONTIG5584 | 4803175_f1_1 | 880 | 14983 | 1656 | 552 | P38860 | 834 | 2.5(10)-83 | Saccharomyces cerevisiae | hypothetical 55.5 kd gtp-binding protein in cdc23-nmd3 intergenic region. |
| CONTIG5333 | 20671805_f3_3 | 881 | 14984 | 1896 | 632 | P38862 | 1280 | 1.3(10)-130 | Saccharomyces cerevisiae | hypothetical 71.4 kd protein in nmd3-eno2 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5333 | 14235882_f3_4 | 882 | 14985 | 1761 | 587 | P38863 | 449 | 1.0(10)-41 | Saccharomyces cerevisiae | hypothetical 96.8 kd protein in nmd3-eno2 intergenic region. |
| CONTIG2653 | 16656413_f3_7 | 883 | 14986 | 300 | 100 | P38869 | 202 | 2.2(10)-16 | Saccharomyces cerevisiae | hypothetical 26.3 kd protein in oye2-gnd1 intergenic region. |
| CONTIG4499 | 14475780_c1_10 | 884 | 14987 | 3549 | 1183 | P38873 | 1475 | 2.2(10)-289 | Saccharomyces cerevisiae | hypothetical 175.8 kd protein in gnd1-erg9 intergenic region. |
| CONTIG4215 | 1953125_c3_8 | 885 | 14988 | 783 | 261 | P38874 | 420 | 1.8(10)-39 | Saccharomyces cerevisiae | hypothetical 35.2 kd protein in gnd1-erg9 intergenic region. |
| CONTIG3026 | 4964451_c3_4 | 886 | 14989 | 975 | 325 | P38875 | 689 | 5.7(10)-68 | Saccharomyces cerevisiae | hypothetical 67.8 kd protein in gnd1-erg9 intergenic region. |
| CONTIG4215 | 2386450_f2_2 | 887 | 14990 | 852 | 284 | P38875 | 520 | 4.7(10)-50 | Saccharomyces cerevisiae | hypothetical 67.8 kd protein in gnd1-erg9 intergenic region. |
| CONTIG1004 | 12931425_c1_3 | 888 | 14991 | 474 | 158 | P38880 | 351 | 1.2(10)-31 | Saccharomyces cerevisiae | hypothetical 66.7 kd protein in egd2-sun1 intergenic region. |
| CONTIG5696 | 10735952_f1_3 | 889 | 14992 | 1851 | 617 | P38880 | 250 | 2.5(10)-33 | Saccharomyces cerevisiae | hypothetical 66.7 kd protein in egd2-sun1 intergenic region. |
| CONTIG5786 | 6831313_fl_6 | 890 | 14993 | 1416 | 472 | P38880 | 956 | 3.0(10)-96 | Saccharomyces cerevisiae | hypothetical 66.7 kd protein in egd2-sun1 intergenic region. |
| CONTIG840 | 24617137_f3_1 | 891 | 14994 | 1086 | 362 | P38883 | 215 | 1.1(10)-17 | Saccharomyces cerevisiae | hypothetical 86.7 kd protein in egd2-sun1 intergenic region. |
| CONTIG5772 | 0_c2_35 | 892 | 14995 | 744 | 248 | P38884 | 293 | 6.5(10)-37 | Saccharomyces cerevisiae | hypothetical 36.5 kd protein in egd2-sun1 intergenic region. |
| CONTIG5080 | 19719002_f2_4 | 893 | 14996 | 1152 | 384 | P40560 | 276 | 1.3(10)-23 | Saccharomyces cerevisiae | hypothetical 59.7 kd protein in bet1-pan1 intergenic region. |
| CONTIG3418 | 21878768_f3_1 | 894 | 14997 | 1095 | 365 | P40558 | 791 | 9.0(10)-79 | Saccharomyces cerevisiae | hypothetical 31.9 kd protein in bet1-pan1 intergenic region. |
| CONTIG5305 | 14225302_f1_3 | 895 | 14998 | 726 | 242 | P40555 | 268 | 2.3(10)-23 | Saccharomyces cerevisiae | hypothetical 24.8 kd protein in faa3-bet1 intergenic region. |
| CONTIG5305 | 24824087_c2_12 | 896 | 14999 | 321 | 107 | P40554 | 300 | 9.6(10)-27 | Saccharomyces cerevisiae | hypothetical 11.0 kd protein in faa3-bet1 intergenic region. |
| CONTIG943 | 4882893_c3_4 | 897 | 15000 | 654 | 218 | P40553 | 347 | 1.0(10)-31 | Saccharomyces cerevisiae | hypothetical 24.1 kd protein in pdr11-faa3 intergenic region. |
| CONTIG5137 | 24397087_c1_11 | 898 | 15001 | 960 | 320 | P40546 | 350 | 6.0(10)-44 | Saccharomyces cerevisiae | hypothetical 38.9 kd protein in rpb3-rpl5a intergenic region. |
| CONTIG5137 | 31360692_f1_1 | 899 | 15002 | 885 | 295 | P40545 | 730 | 2.6(10)-72 | Saccharomyces cerevisiae | hypothetical 29.6 kd protein in rpb3-rpl5a intergenic region. |
| CONTIG4095 | 24491562_f1_1 | 900 | 15003 | 1524 | 508 | P40533 | 1000 | 6.4(10)-101 | Saccharomyces cerevisiae | hypothetical 54.9 kd protein in cbr5-not3 intergenic region. |
| CONTIG4049 | 2400285_f3_2 | 901 | 15004 | 576 | 192 | P40531 | 240 | 2.2(10)-20 | Saccharomyces cerevisiae | 36.7 kd protein in cbr5-not3 intergenic region. |
| CONTIG4902 | 3990802_c2_5 | 902 | 15005 | 1128 | 376 | P40531 | 223 | 5.5(10)-17 | Saccharomyces cerevisiae | 36.7 kd protein in cbr5-not3 intergenic region. |
| CONTIG5387 | 23828211_f1_2 | 903 | 15006 | 825 | 275 | P40526 | 237 | 4.5(10)-20 | Saccharomyces cerevisiae | hypothetical 30.3 kd protein in gpp1-syg1 intergenic region. |
| CONTIG4685 | 24466006_f1_1 | 904 | 15007 | 900 | 300 | P40522 | 146 | 2.0(10)-7 | Saccharomyces cerevisiae | hypothetical 71.4 kd protein in snp1-gpp1 intergenic region. |
| CONTIG5529 | 24413182_f3_7 | 905 | 15008 | 1431 | 477 | P25040 | 511 | 4.2(10)-49 | Saccharomyces cerevisiae | hypothetical protein in ifm1 3'region (fragment). |
| CONTIG4987 | 25973417_c1_4 | 906 | 15009 | 633 | 211 | P40518 | 332 | 3.8(10)-30 | Saccharomyces cerevisiae | hypothetical 17.1 kd protein in rm3- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4301 | 3939552_f2_6 | 907 | 15010 | 534 | 178 | P40515 | 282 | 7.7(10)-25 | Saccharomyces cerevisiae | hypothetical 17.7 kd protein in rnr3-snp1 intergenic region. |
| CONTIG4536 | 79432_f3_5 | 908 | 15011 | 1491 | 497 | P40514 | 959 | 1.3(10)-96 | Saccharomyces cerevisiae | hypothetical 75.5 kd protein in sec6-rnr3 intergenic region. |
| CONTIG4270 | 22375806_c2_6 | 909 | 15012 | 861 | 287 | P40513 | 306 | 2.2(10)-27 | Saccharomyces cerevisiae | hypothetical 30.1 kd protein in hop1-rps24eb intergenic region. |
| CONTIG4285 | 3929050_c3_9 | 910 | 15013 | 1863 | 621 | P40511 | 394 | 9.5(10)-34 | Saccharomyces cerevisiae | hypothetical 102.4 kd protein in sen3-hop1 intergenic region. |
| CONTIG4331 | 21683430_c2_6 | 911 | 15014 | 1077 | 359 | P40506 | 874 | 1.3(10)-87 | Saccharomyces cerevisiae | hypothetical 41.9 kd protein in sds3-ths1 intergenic region. |
| CONTIG5478 | 21673306_c1_10 | 912 | 15015 | 936 | 312 | P40496 | 532 | 2.5(10)-51 | Saccharomyces cerevisiae | hypothetical 30.5 kd protein in sgd1-sds3 intergenic region. |
| CONTIG5084 | 21988181_c2_12 | 913 | 15016 | 1104 | 368 | P40493 | 539 | 4.5(10)-52 | Saccharomyces cerevisiae | hypothetical 39.4 kd protein in sga1-sds3 intergenic region. |
| CONTIG5084 | 6829650_f2_4 | 914 | 15017 | 1080 | 360 | P40492 | 164 | 8.9(10)-22 | Saccharomyces cerevisiae | hypothetical 59.9 kd protein in sga1-sds3 intergenic region. |
| CONTIG5326 | 22298317_f3_5 | 915 | 15018 | 1497 | 499 | P40489 | 158 | 6.9(10)-11 | Saccharomyces cerevisiae | hypothetical 72.7 kd protein in pfk26-sga1 intergenic region. |
| CONTIG5169 | 4694051_f1_4 | 916 | 15019 | 945 | 315 | P40487 | 1041 | 2.8(10)-105 | Saccharomyces cerevisiae | hypothetical 48.3 kd protein in pfk26-sga1 intergenic region. |
| CONTIG5169 | 35959676_f1_5 | 917 | 15020 | 279 | 93 | P40487 | 345 | 1.6(10)-31 | Saccharomyces cerevisiae | hypothetical 48.3 kd protein in pfk26-sga1 intergenic region. |
| CONTIG5169 | 4890750_c2_9 | 918 | 15021 | 1593 | 531 | P40486 | 883 | 1.6(10)-88 | Saccharomyces cerevisiae | hypothetical 59.2 kd protein in pfk26-sga1 intergenic region. |
| CONTIG5169 | 29331302_c3_10 | 919 | 15022 | 870 | 290 | P40484 | 492 | 4.4(10)-47 | Saccharomyces cerevisiae | hypothetical 27.4 kd protein in pfk26-sga1 intergenic region. |
| CONTIG4700 | 10727160_c3_9 | 920 | 15023 | 2238 | 746 | P40483 | 1041 | 3.8(10)-112 | Saccharomyces cerevisiae | hypothetical zinc metalloproteinase yil108w (ec 3.4.24.-). |
| CONTIG4688 | 10001527_c2_23 | 921 | 15024 | 2328 | 776 | P40482 | 1576 | 5.9(10)-162 | Saccharomyces cerevisiae | hypothetical 103.6 kd protein in cox5b-pfk26 intergenic region. |
| CONTIG5768 | 796890_f1_1 | 922 | 15025 | 741 | 247 | P40481 | 224 | 2.3(10)-18 | Saccharomyces cerevisiae | hypothetical 42.5 kd protein in cox5b-ptk26 intergenic region. |
| CONTIG3740 | 25953452_f2_3 | 923 | 15026 | 3399 | 1133 | P40480 | 314 | 3.1(10)-24 | Saccharomyces cerevisiae | hypothetical 123.6 kd protein in nup159-cox5b intergenic region. |
| CONTIG5386 | 16287535_c2_3 | 924 | 15027 | 1035 | 345 | P40468 | 252 | 8.0(10)-43 | Saccharomyces cerevisiae | hypothetical 269.9 kd protein in fkh1-sth1 intergenic region. |
| CONTIG1610 | 16460202_c3_7 | 925 | 15028 | 3318 | 1106 | P40468 | 1864 | 1.8(10)-192 | Saccharomyces cerevisiae | hypothetical 269.9 kd protein in fkh1-sth1 intergenic region. |
| CONTIG4136 | 9923387_c1_5 | 926 | 15029 | 1830 | 610 | P40468 | 563 | 2.0(10)-55 | Saccharomyces cerevisiae | hypothetical 269.9 kd protein in fkh1-sth1 intergenic region. |
| CONTIG4486 | 24323425_c2_5 | 927 | 15030 | 1308 | 436 | P40462 | 151 | 2.2(10)-7 | Saccharomyces cerevisiae | hypothetical zinc aminopeptidase yil137c (ec 3.4.11.-). |
| CONTIG5256 | 15103811_c3_6 | 928 | 15031 | 1785 | 595 | P40462 | 540 | 2.2(10)-51 | Saccharomyces cerevisiae | hypothetical zinc aminopeptidase yil137c (ec 3.4.11.-). |
| CONTIG5256 | 970662_f3_3 | 929 | 15032 | 1017 | 339 | P40460 | 308 | 1.1(10)-26 | Saccharomyces cerevisiae | hypothetical 80.5 kd protein in sln1-rad25 intergenic region. |
| CONTIG3159 | 24413387_f1_3 | 930 | 15033 | 696 | 232 | P40452 | 243 | 1.1(10)-20 | Saccharomyces cerevisiae | hypothetical 22.0 kd protein in fox3-ubp7 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG803 | 16829663_c1_3 | 931 | 15034 | 738 | 246 | P53039 | 423 | 8.9(10)-40 | Saccharomyces cerevisiae | yip1 protein. |
| CONTIG2662 | 4688407_c2_4 | 932 | 15035 | 954 | 318 | P40562 | 376 | 2.3(10)-55 | Saccharomyces cerevisiae | putative atp-dependent rna helicase yir002c. |
| CONTIG5659 | 22301552_f2_9 | 933 | 15036 | 792 | 264 | P40562 | 467 | 2.1(10)-43 | Saccharomyces cerevisiae | putative atp-dependent rna helicase yir002c. |
| CONTIG2153 | 21756938_f3_2 | 934 | 15037 | 822 | 274 | P40563 | 144 | 1.8(10)-7 | Saccharomyces cerevisiae | hypothetical 74.8 kd protein in bet1-pan1 intergenic region. |
| CONTIG5798 | 11760077_c3_42 | 935 | 15038 | 2454 | 818 | P40566 | 786 | 9.3(10)-147 | Saccharomyces cerevisiae | hypothetical 87.0 kd protein in pan1-pri1 intergenic region. |
| CONTIG3976 | 12522826_f1_3 | 936 | 15039 | 1359 | 453 | P35184 | 803 | 4.7(10)-80 | Saccharomyces cerevisiae | hypothetical trp-asp repeats containing protein in dbf8-met28 intergenic region. |
| CONTIG4281 | 892267_f3_3 | 937 | 15040 | 465 | 155 | P40571 | 164 | 2.5(10)-12 | Saccharomyces cerevisiae | hypothetical 16.3 kd protein in dbf8-met28 intergenic region. |
| CONTIG13326 | 823751_c3_2 | 938 | 15041 | 723 | 241 | P40582 | 270 | 1.5(10)-23 | Saccharomyces cerevisiae | hypothetical 26.8 kd protein in hyr1 3'region. |
| CONTIG2294 | 33625186_f1_1 | 939 | 15042 | 762 | 254 | P40582 | 297 | 2.0(10)-26 | Saccharomyces cerevisiae | hypothetical 26.8 kd protein in hyr1 3'region. |
| CONTIG2427 | 22532250_c2_4 | 940 | 15043 | 771 | 257 | P40582 | 396 | 6.5(10)-37 | Saccharomyces cerevisiae | hypothetical 26.8 kd protein in hyr1 3'region. |
| CONTIG5612 | 15785801_c1_8 | 941 | 15044 | 777 | 259 | P40582 | 389 | 3.6(10)-36 | Saccharomyces cerevisiae | hypothetical 26.8 kd protein in hyr1 3'region. |
| b3x16023.y | 35807758_f1_1 | 942 | 15045 | 270 | 90 | P40586 | 195 | 1.3(10)-15 | Saccharomyces cerevisiae | hypothetical 27.4 kd protein in hyr1 3'region. |
| CONTIG5502 | 14878178_f3_5 | 943 | 15046 | 879 | 293 | P47104 | 347 | 3.7(10)-33 | Saccharomyces cerevisiae | hypothetical 154.9 kd protein in cpr7-pet191 intergenic region. |
| CONTIG5502 | 34273500_f2_2 | 944 | 15047 | 2853 | 951 | P47104 | 791 | 1.3(10)-92 | Saccharomyces cerevisiae | hypothetical 154.9 kd protein in cpr7-pet191 intergenic region. |
| CONTIG3806 | 29458057_c2_8 | 945 | 15048 | 1143 | 381 | P47108 | 327 | 2.8(10)-28 | Saccharomyces cerevisiae | hypothetical 135.1 kd protein in gef1-nup85 intergenic region. |
| CONTIG5258 | 6628_c2_10 | 946 | 15049 | 1464 | 488 | P47108 | 202 | 1.3(10)-12 | Saccharomyces cerevisiae | hypothetical 135.1 kd protein in gef1-nup85 intergenic region. |
| CONTIG5635 | 4804660_c1_15 | 947 | 15050 | 447 | 149 | P47111 | 215 | 9.8(10)-18 | Saccharomyces cerevisiae | hypothetical 15.7 kd protein in nup85-ssc1 intergenic region. |
| CONTIG2005 | 12553817_c1_3 | 948 | 15051 | 762 | 254 | P47112 | 107 | 0.003 | Saccharomyces cerevisiae | hypothetical 68.4 kd protein in ssc1-hyp1 intergenic region. |
| CONTIG3937 | 24485963_c1_4 | 949 | 15052 | 870 | 290 | P47114 | 307 | 4.2(10)-27 | Saccharomyces cerevisiae | hypothetical 57.5 kd protein in rad7-hit1 intergenic region. |
| CONTIG3045 | 21520312_f2_2 | 950 | 15053 | 741 | 247 | P47115 | 116 | 4.2(10)-5 | Saccharomyces cerevisiae | hypothetical 27.4 kd protein in hit1-cdc8 intergenic region. |
| CONTIG2275 | 198518_c1_3 | 951 | 15054 | 831 | 277 | P40355 | 388 | 5.5(10)-35 | Saccharomyces cerevisiae | hypothetical 108.4 kd protein in cbf1-nta1 intergenic region. |
| CONTIG4870 | 34096925_f3_2 | 952 | 15055 | 2463 | 821 | P40355 | 278 | 1.3(10)-20 | Saccharomyces cerevisiae | hypothetical 108.4 kd protein in cbf1-nta1 intergenic region. |
| CONTIG5230 | 24713967_c2_16 | 953 | 15056 | 645 | 215 | P47120 | 615 | 4.0(10)-60 | Saccharomyces cerevisiae | hypothetical 36.2 kd protein in ham1-pem2 intergenic region. |
| CONTIG4684 | 6673562_f2_2 | 954 | 15057 | 1377 | 459 | P47122 | 1246 | 5.5(10)-127 | Saccharomyces cerevisiae | hypothetical 43.2 kd protein in ham1-pem2 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1615 | 5897793_f3_1 | 955 | 15058 | 870 | 290 | P47127 | 115 | 0.00031 | Saccharomyces cerevisiae | hypothetical 44.4 kd protein in mir1-ste18 intergenic region. |
| CONTIG5777 | 33393927_f2_5 | 956 | 15059 | 549 | 183 | P47131 | 324 | 2.7(10)-29 | Saccharomyces cerevisiae | hypothetical 11.3 kd protein in mir1-ste18 intergenic region. |
| CONTIG5324 | 34175012_c2_13 | 957 | 15060 | 1197 | 399 | P47133 | 177 | 2.1(10)-11 | Saccharomyces cerevisiae | hypothetical 33.9 kd protein in ste18-grr1 intergenic region. |
| CONTIG3904 | 9878143_c1_4 | 958 | 15061 | 1053 | 351 | P47140 | 688 | 7.4(10)-68 | Saccharomyces cerevisiae | hypothetical 37.5 kd protein in yuh1-ura8 intergenic region. |
| CONTIG5491 | 13944376_c2_12 | 959 | 15062 | 822 | 274 | P47141 | 378 | 5.2(10)-35 | Saccharomyces cerevisiae | hypothetical 30.2 kd protein in yuh1-ura8 intergenic region. |
| CONTIG5324 | 10605055_f3_6 | 960 | 15063 | 489 | 163 | P47142 | 172 | 3.5(10)-13 | Saccharomyces cerevisiae | hypothetical 23.6 kd protein in yuh1-ura8 intergenic region. |
| CONTIG5244 | 23865930_c3_17 | 961 | 15064 | 1398 | 466 | P47147 | 406 | 1.3(10)-50 | Saccharomyces cerevisiae | hypothetical 80.2 kd protein in cpa2-atp2 intergenic region. |
| b2x15213.y | 16287662_f2_1 | 962 | 15065 | 525 | 175 | P47147 | 229 | 3.6(10)-18 | Saccharomyces cerevisiae | hypothetical 80.2 kd protein in cpa2-atp2 intergenic region. |
| CONTIG2502 | 6750802_f3_3 | 963 | 15066 | 396 | 132 | P47148 | 144 | 8.5(10)-10 | Saccharomyces cerevisiae | hypothetical 32.2 kd protein in cpa2-atp2 intergenic region. |
| CONTIG2644 | 11822557_f1_1 | 964 | 15067 | 1158 | 386 | P47148 | 180 | 1.3(10)-27 | Saccharomyces cerevisiae | hypothetical 32.2 kd protein in cpa2-atp2 intergenic region. |
| CONTIG2905 | 4397576_f3_6 | 965 | 15068 | 960 | 320 | P47153 | 352 | 3.0(10)-32 | Saccharomyces cerevisiae | hypothetical 32.0 kd protein in cpa2-atp2 intergenic region. |
| CONTIG5728 | 5128430_c2_21 | 966 | 15069 | 516 | 172 | P47155 | 247 | 4.0(10)-21 | Saccharomyces cerevisiae | hypothetical 23.6 kd protein in cpa2-atp2 intergenic region. |
| CONTIG3871 | 1875_c3_10 | 967 | 15070 | 1308 | 436 | P47160 | 512 | 3.2(10)-49 | Saccharomyces cerevisiae | hypothetical 45.1 kd protein in rps5-zms1 intergenic region. |
| CONTIG5774 | 13688382_c3_30 | 968 | 15071 | 984 | 328 | P47163 | 382 | 2.0(10)-35 | Saccharomyces cerevisiae | hypothetical 39.0 kd protein in zms1-mns1 intergenic region. |
| CONTIG5160 | 9939067_c3_13 | 969 | 15072 | 696 | 232 | P47170 | 656 | 3.7(10)-63 | Saccharomyces cerevisiae | hypothetical 182.0 kd protein in nmd5-hom6 intergenic region. |
| CONTIG5160 | 29039197_c1_9 | 970 | 15073 | 666 | 222 | P47170 | 356 | 3.7(10)-31 | Saccharomyces cerevisiae | hypothetical 182.0 kd protein in nmd5-hom6 intergenic region. |
| CONTIG5160 | 782937_c3_12 | 971 | 15074 | 2508 | 836 | P47170 | 855 | 6.4(10)-138 | Saccharomyces cerevisiae | hypothetical 182.0 kd protein in nmd5-hom6 intergenic region. |
| CONTIG5343 | 22070288_c1_10 | 972 | 15075 | 447 | 149 | P47081 | 267 | 3.0(10)-23 | Saccharomyces cerevisiae | hypothetical 14.1 kd protein in cyr1-ost1 intergenic region. |
| CONTIG4229 | 19537502_f3_4 | 973 | 15076 | 990 | 330 | P47077 | 531 | 3.2(10)-51 | Saccharomyces cerevisiae | hypothetical 77.7 kd protein in cct3-cct8 intergenic region. |
| CONTIG4972 | 4410650_f2_3 | 974 | 15077 | 324 | 108 | P47077 | 159 | 1.1(10)-10 | Saccharomyces cerevisiae | hypothetical 77.7 kd protein in cct3-cct8 intergenic region. |
| CONTIG5602 | 22835965_c1_11 | 975 | 15078 | 654 | 218 | P47076 | 164 | 1.8(10)-20 | Saccharomyces cerevisiae | hypothetical 18.6 kd protein in cct3-cct8 intergenic region. |
| CONTIG4122 | 35360913_f3_4 | 976 | 15079 | 1710 | 570 | P47075 | 1761 | 1.5(10)-181 | Saccharomyces cerevisiae | hypothetical 75.5 kd protein in cct3-cct8 intergenic region. |
| CONTIG2474 | 22381261_f3_1 | 977 | 15080 | 942 | 314 | P47067 | 252 | 1.2(10)-21 | Saccharomyces cerevisiae | hypothetical 41.2 kd protein in pet130-cct3 intergenic region. |
| CONTIG4611 | 142268930_f3_4 | 978 | 15081 | 1605 | 535 | P47057 | 310 | 8.4(10)-28 | Saccharomyces cerevisiae | hypothetical 49.0 kd protein in nsp1-kar2 intergenic region. |
| CONTIG2830 | 30710011_f3_2 | 979 | 15082 | 1176 | 392 | P47054 | 688 | 1.7(10)-66 | Saccharomyces cerevisiae | hypothetical 191.5 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3008 | 33361262_c1_3 | 980 | 15083 | 1131 | 377 | P47054 | 219 | 1.2(10)-14 | Saccharomyces cerevisiae | nsp1-kar2 intergenic region. hypothetical 191.5 kd protein in nsp1-kar2 intergenic region. |
| CONTIG5766 | 1032278_c1_25 | 981 | 15084 | 1062 | 354 | P47054 | 243 | 1.0(10)-17 | Saccharomyces cerevisiae | hypothetical 191.5 kd protein in nsp1-kar2 intergenic region. |
| CONTIG5656 | 21691067_f2_5 | 982 | 15085 | 711 | 237 | P48990 | 608 | 2.2(10)-59 | Candida albicans | hypothetical protein in dfr1 3'region (fragment). |
| CONTIG5656 | 2478538_f1_2 | 983 | 15086 | 663 | 221 | P47045 | 405 | 7.2(10)-38 | Saccharomyces cerevisiae | hypothetical 54.2 kd protein in nup82-pep8 intergenic region. |
| CONTIG5643 | 971886_c2_27 | 984 | 15087 | 699 | 233 | P47044 | 600 | 1.6(10)-58 | Saccharomyces cerevisiae | hypothetical 26.9 kd protein in nup82-pep8 intergenic region. |
| CONTIG4633 | 22445135_f1_1 | 985 | 15088 | 666 | 222 | P47040 | 390 | 2.7(10)-36 | Saccharomyces cerevisiae | hypothetical 46.4 kd protein in nup82-pep8 intergenic region. |
| CONTIG3670 | 16197575_c2_5 | 986 | 15089 | 2040 | 680 | P40367 | 730 | 2.2(10)-86 | Saccharomyces cerevisiae | hypothetical 94.9 kd protein in mrpl8-nup82 intergenic region. |
| CONTIG386 | 35634680_c3_2 | 987 | 15090 | 453 | 151 | P40367 | 260 | 2.3(10)-21 | Saccharomyces cerevisiae | hypothetical 94.9 kd protein in mrpl8-nup82 intergenic region. |
| CONTIG5635 | 10975930_c2_16 | 988 | 15091 | 975 | 325 | P40364 | 106 | 0.0015 | Saccharomyces cerevisiae | hypothetical 28.5 kd protein in scp160-mrpl8 intergenic region. |
| CONTIG2126 | 12533432_f3_2 | 989 | 15092 | 279 | 93 | P40359 | 218 | 4.7(10)-18 | Saccharomyces cerevisiae | hypothetical 25.1 kd protein in scp160-mrpl8 intergenic region. |
| CONTIG651 | 10051317_f3_2 | 990 | 15093 | 204 | 68 | P47033 | 154 | 5.7(10)-10 | Saccharomyces cerevisiae | hypothetical 89.2 kd protein in scp160-mrpl8 intergenic region. |
| CONTIG3566 | 32304537_c3_10 | 991 | 15094 | 420 | 140 | P47032 | 339 | 7.0(10)-31 | Saccharomyces cerevisiae | hypothetical 30.6 kd protein in scp160-mrpl8 intergenic region precursor. |
| CONTIG4531 | 21681887_c2_10 | 992 | 15095 | 879 | 293 | P47032 | 404 | 9.1(10)-38 | Saccharomyces cerevisiae | hypothetical 30.6 kd protein in scp160-mrpl8 intergenic region precursor. |
| CONTIG5762 | 34173578_f2_7 | 993 | 15096 | 990 | 330 | P47032 | 377 | 6.7(10)-35 | Saccharomyces cerevisiae | hypothetical 30.6 kd protein in scp160-mrpl8 intergenic region precursor. |
| CONTIG5762 | 2921882_f1_5 | 994 | 15097 | 1131 | 377 | P47032 | 373 | 1.8(10)-34 | Saccharomyces cerevisiae | hypothetical 30.6 kd protein in scp160-mrpl8 intergenic region precursor. |
| CONTIG5104 | 25567787_c1_6 | 995 | 15098 | 1668 | 556 | P47031 | 668 | 9.6(10)-66 | Saccharomyces cerevisiae | hypothetical 82.5 kd protein in trl1-act3 intergenic region. |
| CONTIG5193 | 25437785_c3_9 | 996 | 15099 | 882 | 294 | P47031 | 315 | 2.2(10)-27 | Saccharomyces cerevisiae | hypothetical 82.5 kd protein in trl1-act3 intergenic region. |
| CONTIG5629 | 24004557_c1_11 | 997 | 15100 | 3030 | 1010 | P47029 | 763 | 8.3(10)-76 | Saccharomyces cerevisiae | hypothetical 117.2 kd protein in trl1-act3 intergenic region. |
| CONTIG5797 | 4406628_c2_22 | 998 | 15101 | 1467 | 489 | P47026 | 911 | 1.7(10)-91 | Saccharomyces cerevisiae | hypothetical 56.4 kd protein in srs2-sip4 intergenic region. |
| CONTIG2654 | 4687627_c2_3 | 999 | 15102 | 465 | 155 | P40857 | 153 | 3.6(10)-11 | Saccharomyces cerevisiae | hypothetical 24.5 kd protein in sap185-bck1 intergenic region. |
| CONTIG4790 | 9875300_f1_1 | 1000 | 15103 | 384 | 128 | P40857 | 104 | 1.3(10)-5 | Saccharomyces cerevisiae | hypothetical 24.5 kd protein in sap185-bck1 intergenic region. |
| CONTIG2400 | 188500_f1_1 | 1001 | 15104 | 936 | 312 | P42951 | 285 | 2.5(10)-24 | Saccharomyces cerevisiae | hypothetical 70.2 kd protein in gsh1-chs6 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3866 | 6070325_f2_1 | 1002 | 15105 | 525 | 175 | P42951 | 164 | 9.5(10)-15 | Saccharomyces cerevisiae | hypothetical 70.2 kd protein in gsh1-chs6 intergenic region. |
| CONTIG5653 | 12500376_f3_13 | 1003 | 15106 | 384 | 128 | P42949 | 217 | 6.0(10)-18 | Saccharomyces cerevisiae | hypothetical 16.2 kd protein in sme1-mef2 intergenic region. |
| CONTIG4846 | 21532762_c2_10 | 1004 | 15107 | 2166 | 722 | P42945 | 917 | 6.2(10)-91 | Saccharomyces cerevisiae | hypothetical 200.0 kd protein in gzf3-sme1 intergenic region. |
| CONTIG5750 | 4410932_f1_7 | 1005 | 15108 | 603 | 201 | P42945 | 428 | 9.4(10)-39 | Saccharomyces cerevisiae | hypothetical 200.0 kd protein in gzf3-sme1 intergenic region. |
| CONTIG5750 | 35595218_f3_13 | 1006 | 15109 | 2268 | 756 | P42945 | 239 | 1.0(10)-32 | Saccharomyces cerevisiae | hypothetical 200.0 kd protein in gzf3-sme1 intergenic region. |
| CONTIG4913 | 13676013_f3_3 | 1007 | 15110 | 465 | 155 | P47019 | 136 | 2.2(10)-9 | Saccharomyces cerevisiae | hypothetical 19.3 kd protein in gcd14-pos18 intergenic region. |
| CONTIG414 | 22442756_c2_2 | 1008 | 15111 | 573 | 191 | P47018 | 113 | 3.3(10)-9 | Saccharomyces cerevisiae | hypothetical 53.5 kd protein in gcd14-pos18 intergenic region. |
| CONTIG5022 | 35332012_f1_1 | 1009 | 15112 | 504 | 168 | P47018 | 92 | 2.8(10)-10 | Saccharomyces cerevisiae | hypothetical 53.5 kd protein in gcd14-pos18 intergenic region. |
| CONTIG3363 | 23940910_c2_11 | 1010 | 15113 | 1317 | 439 | P47015 | 137 | 1.0(10)-6 | Saccharomyces cerevisiae | hypothetical 41.5 kd protein in mrs3-ura2 intergenic region. |
| CONTIG5461 | 34020907_c1_10 | 1011 | 15114 | 1512 | 504 | P47013 | 655 | 5.5(10)-69 | Saccharomyces cerevisiae | hypothetical 47.4 kd protein in rps25b-mrs3 intergenic region. |
| CONTIG1478 | 17080158_f2_1 | 1012 | 15115 | 1029 | 343 | P47008 | 496 | 1.6(10)-47 | Saccharomyces cerevisiae | hypothetical 34.4 kd protein in ids2-mpi2 intergenic region. |
| CONTIG5678 | 22297032_c1_10 | 1013 | 15116 | 675 | 225 | P47006 | 214 | 1.3(10)-17 | Saccharomyces cerevisiae | hypothetical 26.9 kd protein in ino1-ids2 intergenic region. |
| CONTIG5133 | 24508415_f3_3 | 1014 | 15117 | 834 | 278 | P47005 | 96 | 0.07399 | Saccharomyces cerevisiae | hypothetical 77.4 kd protein in ino1-ids2 intergenic region. |
| CONTIG5760 | 1350630_f2_10 | 1015 | 15118 | 1062 | 354 | P47002 | 163 | 4.2(10)-9 | Saccharomyces cerevisiae | hypothetical 76.2 kd protein in far1-fbp26 intergenic region. |
| CONTIG5760 | 162640_f2_11 | 1016 | 15119 | 1506 | 502 | P47002 | 298 | 1.8(10)-50 | Saccharomyces cerevisiae | hypothetical 76.2 kd protein in far1-fbp26 intergenic region. |
| CONTIG143 | 1063186_f3_2 | 1017 | 15120 | 387 | 129 | P47001 | 357 | 8.8(10)-33 | Saccharomyces cerevisiae | hypothetical 23.2 kd protein in tpk1-far1 intergenic region precursor. |
| CONTIG1284 | 564055_c3_5 | 1018 | 15121 | 852 | 284 | P47001 | 181 | 3.8(10)-14 | Saccharomyces cerevisiae | hypothetical 23.2 kd protein in tpk1-far1 intergenic region precursor. |
| CONTIG4099 | 10959692_c2_10 | 1019 | 15122 | 288 | 96 | P47001 | 121 | 1.7(10)-7 | Saccharomyces cerevisiae | hypothetical 23.2 kd protein in tpk1-far1 intergenic region precursor. |
| CONTIG3684 | 564055_f3_4 | 1020 | 15123 | 855 | 285 | P47001 | 181 | 3.8(10)-14 | Saccharomyces cerevisiae | hypothetical 23.2 kd protein in tpk1-far1 intergenic region precursor. |
| CONTIG4863 | 24641526_f1_1 | 1021 | 15124 | 762 | 254 | P47001 | 161 | 5.2(10)-12 | Saccharomyces cerevisiae | hypothetical 23.2 kd protein in tpk1-far1 intergenic region precursor. |
| CONTIG5065 | 3156525_c1_7 | 1022 | 15125 | 1044 | 348 | P47001 | 166 | 2.1(10)-12 | Saccharomyces cerevisiae | hypothetical 23.2 kd protein in tpk1-far1 intergenic region precursor. |
| CONTIG2862 | 4867317_f3_2 | 1023 | 15126 | 573 | 191 | P46996 | 170 | 5.5(10)-12 | Saccharomyces cerevisiae | hypothetical 61.5 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4188 | 24740692_c3_6 | 1024 | 15127 | 687 | 229 | P46995 | 144 | 5.2(10)-9 | Saccharomyces cerevisiae | tpk1-far1 intergenic region. hypothetical 84.5 kd protein in cps1-fpp1 intergenic region. |
| CONTIG4555 | 10972186_c1_1 | 1025 | 15128 | 1626 | 542 | P46995 | 932 | 1.8(10)-104 | Saccharomyces cerevisiae | hypothetical 84.5 kd protein in cps1-fpp1 intergenic region. |
| CONTIG5767 | 36136432_c3_48 | 1026 | 15129 | 1413 | 471 | P46992 | 936 | 3.8(10)-94 | Saccharomyces cerevisiae | hypothetical 43.0 kd protein in cps1-fpp1 intergenic region. |
| CONTIG3300 | 4484575_c2_9 | 1027 | 15130 | 795 | 265 | P46989 | 154 | 2.7(10)-18 | Saccharomyces cerevisiae | hypothetical 21.6 kd protein in atp12-swi3 intergenic region. |
| CONTIG2091 | 2166663_f1_1 | 1028 | 15131 | 822 | 274 | P46985 | 427 | 3.3(10)-40 | Saccharomyces cerevisiae | hypothetical 47.8 kd protein in swe1-atp12 intergenic region. |
| CONTIG445 | 4806325_f2_1 | 1029 | 15132 | 375 | 125 | P46984 | 157 | 1.3(10)-11 | Saccharomyces cerevisiae | hypothetical 13.6 kd protein in swc1-atp12 intergenic region. |
| CONTIG1444 | 187800_f3_1 | 1030 | 15133 | 783 | 261 | P32525 | 269 | 1.3(10)-22 | Saccharomyces cerevisiae | hypothetical 68.5 kd protein in prp21-ubp12 intergenic region. |
| b3x16402.x | 32936_f3_1 | 1031 | 15134 | 300 | 100 | P39531 | 125 | 4.9(10)-7 | Saccharomyces cerevisiae | hypothetical 97.5 kd protein in nuc1-prp21 intergenic region. |
| CONTIG2207 | 21884425_f3_2 | 1032 | 15135 | 1257 | 419 | P39526 | 292 | 3.2(10)-24 | Saccharomyces cerevisiae | hypothetical 229.9 kd protein in nuc1-prp21 intergenic region. |
| CONTIG2479 | 25604687_c3_4 | 1033 | 15136 | 1113 | 371 | P39526 | 170 | 3.0(10)-9 | Saccharomyces cerevisiae | hypothetical 229.9 kd protein in nuc1-prp21 intergenic region. |
| CONTIG2801 | 26775050_c2_11 | 1034 | 15137 | 792 | 264 | P47083 | 597 | 3.2(10)-58 | Saccharomyces cerevisiae | hypothetical 67.0 kd protein in pre3-sag1 intergenic region. |
| CONTIG2801 | 6767163_c2_10 | 1035 | 15138 | 195 | 65 | P47083 | 149 | 1.1(10)-9 | Saccharomyces cerevisiae | hypothetical 67.0 kd protein in pre3-sag1 intergenic region. |
| CONTIG5512 | 1364550_c3_12 | 1036 | 15139 | 462 | 154 | P47084 | 120 | 1.3(10)-6 | Saccharomyces cerevisiae | hypothetical 62.2 kd protein in pre3-sag1 intergenic region. |
| CONTIG4077 | 17000700_c3_8 | 1037 | 15140 | 1026 | 342 | P47085 | 509 | 6.9(10)-49 | Saccharomyces cerevisiae | hypothetical 38.5 kd protein in sui2-tdh2 intergenic region. |
| CONTIG2986 | 12_f2_2 | 1038 | 15141 | 1278 | 426 | P47088 | 564 | 1.0(10)-54 | Saccharomyces cerevisiae | hypothetical 35.6 kd protein in spc1-ilv3 intergenic region. |
| b1x14739.y | 10548463_f1_1 | 1039 | 15142 | 567 | 189 | P47089 | 178 | 8.1(10)-14 | Saccharomyces cerevisiae | hypothetical 22.5 kd protein in spc1-ilv3 intergenic region. |
| CONTIG5594 | 21890751_f3_9 | 1040 | 15143 | 855 | 285 | P47095 | 504 | 2.2(10)-48 | Saccharomyces cerevisiae | hypothetical 27.4 kd protein in mer2-cpr7 intergenic region. |
| CONTIG3052 | 30159715_f2_2 | 1041 | 15144 | 621 | 207 | P36119 | 212 | 1.5(10)-20 | Saccharomyces cerevisiae | hypothetical 60.8 kd protein in ypt52-gcn3 intergenic region. |
| CONTIG4950 | 25803180_f1_2 | 1042 | 15145 | 864 | 288 | P36121 | 222 | 1.8(10)-18 | Saccharomyces cerevisiae | hypothetical 32.1 kd protein in ypt52-gcn3 intergenic region. |
| b2x13889.y | 3132657_f3_1 | 1043 | 15146 | 603 | 201 | P36124 | 189 | 8.3(10)-14 | Saccharomyces cerevisiae | hypothetical 85.5 kd protein in sap190-spo14 intergenic region. |
| CONTIG3829 | 12116252_c1_4 | 1044 | 15147 | 315 | 105 | P36132 | 284 | 5.2(10)-25 | Saccharomyces cerevisiae | hypothetical 46.6 kd protein in dal80-gap1 intergenic region. |
| CONTIG2386 | 19954535_f3_2 | 1045 | 15148 | 1218 | 406 | P36142 | 578 | 3.3(10)-56 | Saccharomyces cerevisiae | hypothetical 48.8 kd protein in trk2-mrs4 intergenic region. |
| CONTIG1668 | 24301557_c1_1 | 1046 | 15149 | 690 | 230 | P36144 | 238 | 3.6(10)-20 | Saccharomyces cerevisiae | hypothetical 31.6 kd protein in tif1-ktr2 intergenic region. |
| CONTIG3207 | 2734562_c2_2 | 1047 | 15150 | 522 | 174 | P36147 | 172 | 3.5(10)-13 | Saccharomyces cerevisiae | hypothetical 22.0 kd protein in tas1-ccp1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x10747.x | 11222153_f3_2 | 1048 | 15151 | 198 | 66 | P36147 | 219 | 3.7(10)-18 | Saccharomyces cerevisiae | hypothetical 22.0 kd protein in tas1-ccp1 intergenic region. |
| CONTIG5077 | 3163377_c2_7 | 1049 | 15152 | 1203 | 401 | P36151 | 819 | 9.6(10)-82 | Saccharomyces cerevisiae | hypothetical 39.4 kd protein in ccp1-sis2 intergenic region. |
| CONTIG5097 | 5906912_c2_5 | 1050 | 15153 | 978 | 326 | P36151 | 365 | 1.2(10)-33 | Saccharomyces cerevisiae | hypothetical 39.4 kd protein in ccp1-sis2 intergenic region. |
| b9x13e10.x | 22461562_f1_1 | 1051 | 15154 | 522 | 174 | P36152 | 110 | 7.7(10)-6 | Saccharomyces cerevisiae | hypothetical 38.5 kd protein in ccp1-sis2 intergenic region. |
| CONTIG258 | 24416462_c3_1 | 1052 | 15155 | 204 | 68 | P36154 | 200 | 3.7(10)-16 | Saccharomyces cerevisiae | hypothetical 18.4 kd protein in sis2-mtd1 intergenic region. |
| CONTIG5720 | 285875_f3_10 | 1053 | 15156 | 2760 | 920 | P36159 | 704 | 1.8(10)-121 | Saccharomyces cerevisiae | hypothetical 96.8 kd protein in sis2-mtd1 intergenic region. |
| CONTIG1054 | 6057812_f3_3 | 1054 | 15157 | 210 | 70 | P36160 | 160 | 2.5(10)-11 | Saccharomyces cerevisiae | hypothetical 39.6 kd protein in mtd1-nup133 intergenic region. |
| CONTIG2222 | 1210187_f2_2 | 1055 | 15158 | 573 | 191 | P36160 | 558 | 4.4(10)-54 | Saccharomyces cerevisiae | hypothetical 39.6 kd protein in mtd1-nup133 intergenic region. |
| CONTIG2223 | 16583325_f2_1 | 1056 | 15159 | 423 | 141 | P36162 | 122 | 7.0(10)-8 | Saccharomyces cerevisiae | hypothetical 15.1 kd protein in nup133-hbs1 intergenic region. |
| CONTIG5330 | 24017193_c3_15 | 1057 | 15160 | 810 | 270 | P36163 | 348 | 7.9(10)-32 | Saccharomyces cerevisiae | hypothetical 35.8 kd protein in prp16-srp40 intergenic region. |
| CONTIG2650 | 12897750_c3_6 | 1058 | 15161 | 1092 | 364 | P36164 | 330 | 6.4(10)-30 | Saccharomyces cerevisiae | hypothetical 38.3 kd protein in prp16-srp40 intergenic region. |
| CONTIG4779 | 36140675_f2_2 | 1059 | 15162 | 1803 | 601 | P36165 | 510 | 3.5(10)-48 | Saccharomyces cerevisiae | hypothetical 102.7 kd protein in prp16-srp40 intergenic region. |
| CONTIG5720 | 34410955_c1_21 | 1060 | 15163 | 879 | 293 | P36165 | 531 | 1.8(10)-50 | Saccharomyces cerevisiae | hypothetical 102.7 kd protein in prp16-srp40 intergenic region. |
| CONTIG5763 | 859626_c3_22 | 1061 | 15164 | 3180 | 1060 | P36166 | 356 | 3.5(10)-32 | Saccharomyces cerevisiae | hypothetical 79.4 kd protein in prp16-srp40 intergenic region. |
| b2x18881.x | 35805418_f3_2 | 1062 | 15165 | 237 | 79 | P36108 | 140 | 8.6(10)-10 | Saccharomyces cerevisiae | hypothetical 16.7 kd protein mrp17-met14 intergenic region. |
| CONTIG1834 | 32476432_c3_3 | 1063 | 15166 | 1116 | 372 | P34241 | 241 | 7.4(10)-19 | Saccharomyces cerevisiae | hypothetical 203.3 kd protein in put3-cce1 intergenic region. |
| CONTIG2893 | 14964012_f2_2 | 1064 | 15167 | 1191 | 397 | P34241 | 154 | 1.3(10)-7 | Saccharomyces cerevisiae | hypothetical 203.3 kd protein in put3-cce1 intergenic region. |
| b2x16714.x | 24806465_f3_2 | 1065 | 15168 | 831 | 277 | P34241 | 271 | 4.7(10)-22 | Saccharomyces cerevisiae | hypothetical 203.3 kd protein in put3-cce1 intergenic region. |
| CONTIG4548 | 2116050_c2_6 | 1066 | 15169 | 1353 | 451 | P34243 | 91 | 0.42999 | Saccharomyces cerevisiae | hypothetical 78.3 kd protein in ram2-atp7 intergenic region. |
| CONTIG5762 | 4956500_f3_14 | 1067 | 15170 | 1281 | 427 | P34243 | 849 | 6.4(10)-85 | Saccharomyces cerevisiae | hypothetical 78.3 kd protein in ram2-atp7 intergenic region. |
| b9x12h43.y | 35439526_f1_1 | 1068 | 15171 | 675 | 225 | P36104 | 271 | 1.1(10)-23 | Saccharomyces cerevisiae | hypothetical 37.1 kd protein in ram2-atp7 intergenic region. |
| CONTIG3125 | 4728250_c1_5 | 1069 | 15172 | 1206 | 402 | P36097 | 99 | 0.11 | Saccharomyces cerevisiae | hypothetical 118.9 kd protein in ptm1-ixr1 intergenic region. |
| CONTIG3125 | 5208261_c3_8 | 1070 | 15173 | 714 | 238 | P36097 | 102 | 0.02 | Saccharomyces cerevisiae | hypothetical 118.9 kd protein in ptm1-ixr1 intergenic region. |
| b9x13h22.y | 34414092_f1_1 | 1071 | 15174 | 408 | 136 | P36097 | 170 | 1.3(10)-11 | Saccharomyces cerevisiae | hypothetical 118.9 kd protein in ptm1-ixr1 intergenic region. |
| CONTIG3440 | 24414088_c3_11 | 1072 | 15175 | 1428 | 476 | P36096 | 395 | 5.5(10)-36 | Saccharomyces cerevisiae | hypothetical 87.9 kd protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4145 | 4883452_c1_7 | 1073 | 15176 | 624 | 208 | P36095 | 215 | 9.8(10)-18 | Saccharomyces cerevisiae | precursor in ptm-ixr1 intergenic region. |
| CONTIG4611 | 25510756_f1_1 | 1074 | 15177 | 381 | 127 | P36091 | 224 | 4.7(10)-18 | Saccharomyces cerevisiae | hypothetical 26.2 kd protein in phd1-ptm1 intergenic region. hypothetical 49.6 kd protein precursor in elm1-pri2 intergenic region. |
| CONTIG5715 | 4100882_c3_24 | 1075 | 15178 | 948 | 316 | P35735 | 258 | 2.0(10)-52 | Saccharomyces cerevisiae | hypothetical 40.5 kd protein in nup120-cse4 intergenic region. |
| CONTIG5091 | 23516881_f2_6 | 1076 | 15179 | 645 | 215 | P35728 | 328 | 1.0(10)-29 | Saccharomyces cerevisiae | hypothetical 49.6 kd protein in fba1-toa2 intergenic region. |
| CONTIG5091 | 7054563_f1_3 | 1077 | 15180 | 852 | 284 | P35728 | 185 | 8.5(10)-14 | Saccharomyces cerevisiae | hypothetical 49.6 kd protein in fba1-toa2 intergenic region. |
| CONTIG5791 | 22460167_c1_22 | 1078 | 15181 | 555 | 185 | P36088 | 570 | 2.3(10)-55 | Saccharomyces cerevisiae | hypothetical 19.7 kd protein in lhs1-nup100 intergenic region. |
| CONTIG2635 | 2625307_f2_1 | 1079 | 15182 | 1182 | 394 | P36081 | 523 | 2.2(10)-50 | Saccharomyces cerevisiae | hypothetical 46.0 kd protein in smy1-mud2 intergenic region. |
| CONTIG4893 | 24236438_c2_9 | 1080 | 15183 | 1353 | 451 | P36080 | 309 | 7.5(10)-51 | Saccharomyces cerevisiae | hypothetical 50.5 kd protein in mdh1-vma5 intergenic region. |
| CONTIG2957 | 21991556_c3_7 | 1081 | 15184 | 456 | 152 | P36078 | 295 | 3.2(10)-26 | Saccharomyces cerevisiae | hypothetical 13.6 kd protein in mdh1-vma5 intergenic region. |
| CONTIG3598 | 4878207_f1_1 | 1082 | 15185 | 408 | 136 | P36077 | 342 | 3.3(10)-31 | Saccharomyces cerevisiae | hypothetical 13.9 kd protein in cyt2-mdh1 intergenic region. |
| CONTIG4216 | 14722812_f1_1 | 1083 | 15186 | 1539 | 513 | P36075 | 197 | 7.5(10)-13 | Saccharomyces cerevisiae | hypothetical 50.9 kd protein in bud2-mif2 intergenic region. |
| CONTIG3420 | 13790927_f1_1 | 1084 | 15187 | 918 | 306 | P28321 | 588 | 2.8(10)-57 | Saccharomyces cerevisiae | hypothetical 35.5 kd protein in cwp1-mbr1 intergenic region. |
| CONTIG3596 | 4484400_c1_5 | 1085 | 15188 | 1104 | 368 | P34246 | 93 | 0.12 | Saccharomyces cerevisiae | hypothetical 39.8 kd protein in ape1/lap4-cwp1 intergenic region. |
| CONTIG3052 | 6679662_c3_7 | 1086 | 15189 | 1113 | 371 | P34252 | 170 | 3.7(10)-10 | Saccharomyces cerevisiae | hypothetical 52.3 kd protein in hap4-aat1 intergenic region. |
| CONTIG4253 | 241703_f3_2 | 1087 | 15190 | 306 | 102 | P32343 | 106 | 4.5(10)-5 | Saccharomyces cerevisiae | hypothetical 65.1 kd protein in rrm3-srp21 intergenic region. |
| CONTIG3601 | 23938412_f1_1 | 1088 | 15191 | 414 | 138 | P36064 | 117 | 2.3(10)-7 | Saccharomyces cerevisiae | hypothetical 12.0 kd protein in mrpl31-apl2 intergenic region. |
| CONTIG1579 | 1178132_c2_3 | 1089 | 15192 | 369 | 123 | P36059 | 137 | 8.1(10)-9 | Saccharomyces cerevisiae | hypothetical 37.4 kd protein in gpm1-mcr1 intergenic region. |
| CONTIG5757 | 11726436_c1_12 | 1090 | 15193 | 330 | 110 | P36059 | 278 | 2.1(10)-24 | Saccharomyces cerevisiae | hypothetical 37.4 kd protein in gpm1-mcr1 intergenic region. |
| CONTIG1984 | 986383_c2_8 | 1091 | 15194 | 483 | 161 | P36056 | 231 | 1.8(10)-18 | Saccharomyces cerevisiae | hypothetical 72.2 kd protein in ape2-gpm1 intergenic region. |
| CONTIG4699 | 35831526_f1_1 | 1092 | 15195 | 591 | 197 | P36056 | 239 | 2.6(10)-19 | Saccharomyces cerevisiae | hypothetical 72.2 kd protein in ape2-gpm1 intergenic region. |
| CONTIG4522 | 4879652_c2_6 | 1093 | 15196 | 396 | 132 | P36053 | 291 | 8.6(10)-26 | Saccharomyces cerevisiae | hypothetical 16.2 kd protein in pir3-ape2 intergenic region. |
| CONTIG4442 | 16831551_f2_1 | 1094 | 15197 | 1287 | 429 | P36049 | 755 | 5.9(10)-75 | Saccharomyces cerevisiae | hypothetical 49.7 kd protein in gin2-ste3 intergenic region. |
| CONTIG2541 | 21988325_c2_2 | 1095 | 15198 | 1068 | 356 | P34240 | 118 | 2.5(10)-6 | Saccharomyces cerevisiae | hypothetical 55.4 kd protein in ste3-gin10 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3303 | 17135_f2_4 | 1096 | 15199 | 1587 | 529 | P28817 | 733 | 1.3(10)-72 | Saccharomyces cerevisiae | hypothetical protein in krs1 5'region (fragment). |
| CONTIG3824 | 3917163_f3_3 | 1097 | 15200 | 654 | 218 | P34234 | 94 | 0.027 | Saccharomyces cerevisiae | hypothetical 34.3 kd protein in ord1-fas1 intergenic region. |
| CONTIG3546 | 25596875_c1_6 | 1098 | 15201 | 273 | 91 | P32464 | 142 | 3.2(10)-9 | Saccharomyces cerevisiae | hypothetical 45.9 kd protein in cnb1-pat1 intergenic region. |
| CONTIG3546 | 16115628_c3_9 | 1099 | 15202 | 378 | 126 | P32464 | 183 | 1.1(10)-13 | Saccharomyces cerevisiae | hypothetical 45.9 kd protein in cnb1-pat1 intergenic region. |
| CONTIG5218 | 16620275_f1_1 | 1100 | 15203 | 261 | 87 | P36046 | 201 | 1.3(10)-15 | Saccharomyces cerevisiae | hypothetical 47.4 kd protein in pas1-mst1 intergenic region. |
| CONTIG1962 | 24416425_f2_2 | 1101 | 15204 | 234 | 78 | P36043 | 123 | 6.0(10)-7 | Saccharomyces cerevisiae | 64.6 kd protein in tor2-pas1 intergenic region. |
| CONTIG5056 | 10744037_c2_12 | 1102 | 15205 | 552 | 184 | P36040 | 185 | 1.5(10)-14 | Saccharomyces cerevisiae | hypothetical 30.7 kd protein in ste6-los1 intergenic region. |
| CONTIG4684 | 31679687_f1_1 | 1103 | 15206 | 600 | 200 | P36039 | 307 | 1.7(10)-27 | Saccharomyces cerevisiae | hypothetical 29.4 kd protein in ste6-los1 intergenic region. |
| CONTIG5781 | 6853455_c2_23 | 1104 | 15207 | 1089 | 363 | Q02202 | 98 | 0.025 | Saccharomyces cerevisiae | hypothetical 34.5 kd protein in pap1-mrpl13 intergenic region. |
| CONTIG3152 | 22001582_c1_5 | 1105 | 15208 | 348 | 116 | P36112 | 230 | 1.7(10)-18 | Saccharomyces cerevisiae | hypothetical 61.1 kd protein in ypt52-gcn3 intergenic region. |
| CONTIG4982 | 7303180_c2_16 | 1106 | 15209 | 1059 | 353 | P36112 | 95 | 0.07299 | Saccharomyces cerevisiae | hypothetical 61.1 kd protein in ypt52-gcn3 intergenic region. |
| CONTIG5653 | 39680_c3_20 | 1107 | 15210 | 696 | 232 | P36113 | 217 | 4.5(10)-17 | Saccharomyces cerevisiae | hypothetical 63.6 kd protein in ypt52-gcn3 intergenic region. |
| CONTIG5778 | 6048377_c2_28 | 1108 | 15211 | 1971 | 657 | P36115 | 232 | 4.5(10)-26 | Saccharomyces cerevisiae | hypothetical 68.9 kd protein in ypt52-gcn3 intergenic region. |
| CONTIG5245 | 4380280_c2_20 | 1109 | 15212 | 660 | 220 | P53769 | 381 | 2.5(10)-35 | Saccharomyces cerevisiae | hypothetical 29.7 kd protein in rec102-sfh1 intergenic region. |
| CONTIG4474 | 33832788_f1_1 | 1110 | 15213 | 966 | 322 | P34424 | 92 | 0.14999 | Caenorhabditis elegans | hypothetical 61.8 kd protein f44b9.3 in chromosome iii. |
| b9x10u41.y | 34114005_f2_1 | 1111 | 15214 | 456 | 152 | P34431 | 222 | 7.7(10)-17 | Caenorhabditis elegans | hypothetical protein f44e2.1 in chromosome iii (fragment). |
| CONTIG4985 | 30257200_c2_8 | 1112 | 15215 | 1371 | 457 | P54007 | 274 | 2.0(10)-23 | Saccharomyces cerevisiae | hypothetical 41.1 kd protein on cdc91-pau4 intergenic region. |
| CONTIG4826 | 15115952_f2_5 | 1113 | 15216 | 2058 | 686 | P40308 | 609 | 5.0(10)-98 | Saccharomyces cerevisiae | hypothetical 73.6 kd protein in glc8-pre5 intergenic region. |
| CONTIG3511 | 14304562_f3_1 | 1114 | 15217 | 1386 | 462 | P54730 | 125 | 5.4(10)-5 | Saccharomyces cerevisiae | hypothetical 47.0 kd protein in aep1-hms1 intergenic region. |
| CONTIG3734 | 25806892_f1_1 | 1115 | 15218 | 1428 | 476 | P49955 | 1232 | 1.7(10)-125 | Saccharomyces cerevisiae | hypothetical 110.0 kd protein ym8021.14. |
| CONTIG3470 | 1953500_f3_5 | 1116 | 15219 | 756 | 252 | P23797 | 140 | 1.0(10)-16 | Saccharomyces cerevisiae | hypothetical 35.4 kd protein in cat8-atp13 intergenic region (urf2). |
| CONTIG3854 | 4859630_c1_7 | 1117 | 15220 | 1563 | 521 | P40210 | 365 | 3.2(10)-45 | Saccharomyces cerevisiae | hypothetical 55.9 kd protein in mds1-swp1 intergenic region. |
| CONTIG5211 | 1979050_f1_2 | 1118 | 15221 | 882 | 294 | P49957 | 625 | 2.2(10)-76 | Saccharomyces cerevisiae | hypothetical 32.4 kd protein in ppz1-spt5 intergenic region. |
| CONTIG5820 | 283501_f1_11 | 1119 | 15222 | 315 | 105 | P03879 | 281 | 1.0(10)-24 | Saccharomyces cerevisiae | hypothetical cob intron 4 protein. |
| CONTIG2977 | 32219067_c1_4 | 1120 | 15223 | 207 | 69 | P54003 | 145 | 8.0(10)-10 | Saccharomyces cerevisiae | hypothetical 33.8 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG766 | 10831327_c3_4 | 1121 | 15224 | 618 | 206 | P54003 | 245 | 6.5(10)-21 | Saccharomyces cerevisiae | cyb2-gal80 intergenic region. hypothetical 33.8 kd protein in cyb2-gal80 intergenic region. |
| CONTIG3292 | 5906576_c2_5 | 1122 | 15225 | 321 | 107 | P53759 | 158 | 6.7(10)-11 | Saccharomyces cerevisiae | hypothetical 48.1 kd protein in tub1-cpr3 intergenic region. |
| CONTIG4228 | 3912512_f1_1 | 1123 | 15226 | 432 | 144 | P53759 | 371 | 2.8(10)-34 | Saccharomyces cerevisiae | hypothetical 48.1 kd protein in tub1-cpr3 intergenic region. |
| CONTIG5781 | 22397762_f1_1 | 1124 | 15227 | 795 | 265 | P53843 | 174 | 9.9(10)-26 | Saccharomyces cerevisiae | hypothetical 34.5 kd protein in pik1-pol2 intergenic region. |
| CONTIG3385 | 38892_c1_3 | 1125 | 15228 | 1665 | 555 | P53840 | 263 | 3.0(10)-19 | Saccharomyces cerevisiae | hypothetical 141.1 kd protein in met2-sec2 intergenic region. |
| CONTIG5684 | 11051261_f1_5 | 1126 | 15229 | 1755 | 585 | P53840 | 720 | 2.3(10)-70 | Saccharomyces cerevisiae | hypothetical 141.1 kd protein in met2-sec2 intergenic region. |
| CONTIG5352 | 33301007_c3_12 | 1127 | 15230 | 1713 | 571 | P53838 | 1225 | 9.1(10)-125 | Saccharomyces cerevisiae | hypothetical 65.0 kd protein in met2-sec2 intergenic region. |
| CONTIG5714 | 1210900_c1_13 | 1128 | 15231 | 2067 | 689 | P53836 | 242 | 5.5(10)-36 | Saccharomyces cerevisiae | hypothetical 118.3 kd protein in erg24-met2 intergenic region. |
| CONTIG3733 | 2736252_f2_1 | 1129 | 15232 | 1557 | 519 | P53835 | 198 | 2.1(10)-26 | Saccharomyces cerevisiae | hypothetical 73.4 kd protein in erg24-met2 intergenic region. |
| CONTIG5707 | 23478461_f2_7 | 1130 | 15233 | 447 | 149 | P53834 | 257 | 3.5(10)-22 | Saccharomyces cerevisiae | hypothetical 17.2 kd protein in mrpl10-erg24 intergenic region. |
| CONTIG2342 | 22445186_c3_3 | 1131 | 15234 | 726 | 242 | P53829 | 660 | 6.9(10)-65 | Saccharomyces cerevisiae | hypothetical 41.2 kd protein in plc1-sec21 intergenic region. |
| CONTIG5357 | 24485937_c1_15 | 1132 | 15235 | 1248 | 416 | P48567 | 805 | 3.0(10)-80 | Saccharomyces cerevisiae | hypothetical 45.3 kd protein in cla4-mid1 intergenic region. |
| CONTIG3763 | 14647262_f3_2 | 1133 | 15236 | 1056 | 352 | P48566 | 502 | 3.7(10)-48 | Saccharomyces cerevisiae | hypothetical 73.0 kd protein in cla4-mid1 intergenic region. |
| CONTIG2393 | 29853427_f1_1 | 1134 | 15237 | 1020 | 340 | P48565 | 221 | 1.6(10)-17 | Saccharomyces cerevisiae | hypothetical 61.5 kd protein in cla4-mid1 intergenic region. |
| CONTIG3204 | 33756536_c1_4 | 1135 | 15238 | 1557 | 519 | P48563 | 437 | 9.1(10)-40 | Saccharomyces cerevisiae | hypothetical 186.8 kd protein in cla4-mid1 intergenic region. |
| CONTIG5709 | 6292916_f3_9 | 1136 | 15239 | 2976 | 992 | P48563 | 740 | 3.0(10)-82 | Saccharomyces cerevisiae | hypothetical 186.8 kd protein in cla4-mid1 intergenic region. |
| CONTIG5496 | 10339012_c3_20 | 1137 | 15240 | 675 | 225 | P42847 | 394 | 1.1(10)-36 | Saccharomyces cerevisiae | hypothetical 24.6 kd protein in mck1-rp55b intergenic region. |
| CONTIG3348 | 956317_c2_7 | 1138 | 15241 | 1818 | 606 | P42842 | 1633 | 5.4(10)-168 | Saccharomyces cerevisiae | hypothetical 102.3 kd protein in dal82-rfa2 intergenic region. |
| CONTIG5051 | 24414058_f3_6 | 1139 | 15242 | 852 | 284 | P42842 | 188 | 1.3(10)-13 | Saccharomyces cerevisiae | hypothetical 102.3 kd protein in dal82-rfa2 intergenic region. |
| CONTIG4412 | 4023262_f2_1 | 1140 | 15243 | 900 | 300 | P42841 | 694 | 1.7(10)-68 | Saccharomyces cerevisiae | hypothetical trp-asp repeats containing protein in hxt14-pha2 intergenic region. |
| CONTIG4733 | 626953_c2_8 | 1141 | 15244 | 828 | 276 | P42840 | 623 | 5.7(10)-61 | Saccharomyces cerevisiae | hypothetical 32.3 kd protein in kre1-hxt14 intergenic region. |
| CONTIG5471 | 10048888_c3_27 | 1142 | 15245 | 2172 | 724 | P42839 | 1054 | 1.6(10)-162 | Saccharomyces cerevisiae | hypothetical 102.5 kd protein in kre1-hxt14 intergenic region. |
| CONTIG978 | 4884842_c1_4 | 1143 | 15246 | 705 | 235 | P42839 | 139 | 8.4(10)-7 | Saccharomyces cerevisiae | hypothetical 102.5 kd protein in kre1-hxt14 intergenic region. |
| CONTIG5583 | 2149086_f1_5 | 1144 | 15247 | 1041 | 347 | P42838 | 457 | 2.2(10)-43 | Saccharomyces cerevisiae | hypothetical 47.4 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5428 | 4062625_c2_15 | 1145 | 15248 | 1170 | 390 | P42836 | 452 | 2.1(10)-55 | Saccharomyces cerevisiae | hypothetical 39.2 kd protein in egt2-kre1 intergenic region. |
| CONTIG1533 | 191436_f3_1 | 1146 | 15249 | 447 | 149 | P42834 | 278 | 2.1(10)-24 | Saccharomyces cerevisiae | hypothetical 16.5 kd protein in pas8-egt2 intergenic region. |
| CONTIG5128 | 4491257_c1_8 | 1147 | 15250 | 2106 | 702 | P40345 | 1457 | 2.3(10)-149 | Saccharomyces cerevisiae | hypothetical 75.4 kd protein in vps27-cse2 intergenic region. |
| CONTIG5440 | 12600937_c3_16 | 1148 | 15251 | 1338 | 446 | P53720 | 729 | 3.2(10)-72 | Saccharomyces cerevisiae | hypothetical 42.8 kd protein in urk1-fas3 intergenic region. |
| CONTIG465 | 21757680_c1_3 | 1149 | 15252 | 591 | 197 | P53721 | 329 | 8.1(10)-30 | Saccharomyces cerevisiae | hypothetical 25.3 kd protein in tim23-arc2 intergenic region. |
| CONTIG594 | 27000305_c2_2 | 1150 | 15253 | 633 | 211 | P53721 | 310 | 8.4(10)-28 | Saccharomyces cerevisiae | hypothetical 25.3 kd protein in tim23-are2 intergenic region. |
| CONTIG4615 | 9804686_c3_10 | 1151 | 15254 | 792 | 264 | P53722 | 688 | 7.4(10)-68 | Saccharomyces cerevisiae | hypothetical 32.2 kd protein in are2-swp73 intergenic region. |
| CONTIG4775 | 3337567_f2_3 | 1152 | 15255 | 990 | 330 | P53723 | 158 | 3.1(10)-9 | Saccharomyces cerevisiae | hypothetical 47.1 kd protein in are2-swp73 intergenic region. |
| CONTIG4786 | 22464062_c1_5 | 1153 | 15256 | 921 | 307 | P53727 | 530 | 4.0(10)-51 | Saccharomyces cerevisiae | hypothetical 35.4 kd protein in sec12-ssk2 intergenic region. |
| CONTIG3533 | 26070926_f1_1 | 1154 | 15257 | 1047 | 349 | P53729 | 744 | 8.5(10)-74 | Saccharomyces cerevisiae | hypothetical 48.1 kd protein in sec12-ssk2 intergenic region. |
| CONTIG3533 | 1445337_c3_11 | 1155 | 15258 | 798 | 266 | P53730 | 219 | 2.2(10)-26 | Saccharomyces cerevisiae | hypothetical 62.7 kd protein in sec12-ssk2 intergenic region. |
| CONTIG3533 | 206877_c1_4 | 1156 | 15259 | 489 | 163 | P53730 | 287 | 1.1(10)-24 | Saccharomyces cerevisiae | hypothetical 62.7 kd protein in sec12-ssk2 intergenic region. |
| CONTIG878 | 24642811_c1_3 | 1157 | 15260 | 639 | 213 | P53730 | 109 | 0.00025 | Saccharomyces cerevisiae | hypothetical 62.7 kd protein in sec12-ssk2 intergenic region. |
| CONTIG1854 | 33672643_c2_3 | 1158 | 15261 | 186 | 62 | P53731 | 133 | 2.2(10)-8 | Saccharomyces cerevisiae | hypothetical 39.6 kd protein in sol1-coq2 intergenic region. |
| CONTIG4234 | 10581436_f2_2 | 1159 | 15262 | 378 | 126 | P53731 | 178 | 2.5(10)-13 | Saccharomyces cerevisiae | hypothetical 39.6 kd protein in sol1-coq2 intergenic region. |
| CONTIG3548 | 9774157_f1_1 | 1160 | 15263 | 1281 | 427 | P53734 | 604 | 5.9(10)-59 | Saccharomyces cerevisiae | putative atp-dependent rna helicase yn038w. |
| CONTIG5748 | 4766925_c1_17 | 1161 | 15264 | 2070 | 690 | P53735 | 338 | 2.7(10)-39 | Saccharomyces cerevisiae | hypothetical 67.5 kd protein in sol1-coq2 intergenic region. |
| CONTIG4829 | 9844140_c1_8 | 1162 | 15265 | 537 | 179 | P53738 | 441 | 1.1(10)-41 | Saccharomyces cerevisiae | hypothetical 15.1 kd protein in pet494-msol intergenic region. |
| CONTIG4892 | 12109750_c2_7 | 1163 | 15266 | 1899 | 633 | P53741 | 157 | 4.0(10)-20 | Saccharomyces cerevisiae | hypothetical 57.7 kd protein in lys9-pop2 intergenic region. |
| CONTIG3748 | 22464212_f1_1 | 1164 | 15267 | 1032 | 344 | P53742 | 1043 | 1.8(10)-105 | Saccharomyces cerevisiae | hypothetical gtp-binding protein in pop2-hol1 intergenic region. |
| CONTIG5585 | 35807757_c3_22 | 1165 | 15268 | 396 | 132 | P53742 | 231 | 1.0(10)-18 | Saccharomyces cerevisiae | hypothetical gtp-binding protein in pop2-hol1 intergenic region. |
| CONTIG1293 | 22445130_c1_3 | 1166 | 15269 | 222 | 74 | P53743 | 90 | 0.001 | Saccharomyces cerevisiae | hypothetical 36.4 kd protein in pop2-hol1 intergenic region. |
| CONTIG3486 | 6067576_c2_6 | 1167 | 15270 | 915 | 305 | P53743 | 421 | 1.5(10)-39 | Saccharomyces cerevisiae | hypothetical 36.4 kd protein in pop2-hol1 intergenic region. |
| CONTIG4659 | 20081903_f1_2 | 1168 | 15271 | 1065 | 355 | P53753 | 161 | 1.3(10)-10 | Saccharomyces cerevisiae | hypothetical 121.1 kd protein in bio3-hxt17 intergenic region |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4659 | 3143811_f2_4 | 1169 | 15272 | 426 | 142 | P53753 | 151 | 1.6(10)-9 | Saccharomyces cerevisiae | hypothetical 121.1 kd protein in bio3-hxt17 intergenic region precursor. |
| CONTIG5454 | 24489188_c2_9 | 1170 | 15273 | 2985 | 995 | P53753 | 1907 | 4.9(10)-197 | Saccharomyces cerevisiae | hypothetical 121.1 kd protein in bio3-hxt17 intergenic region precursor. |
| CONTIG3755 | 9875932_f1_1 | 1171 | 15274 | 282 | 94 | P41318 | 261 | 1.3(10)-22 | Saccharomyces cerevisiae | hypothetical trp-asp repeats containing protein in sis1-mrpl2 intergenic region. |
| CONTIG3666 | 21882817_c2_5 | 1172 | 15275 | 498 | 166 | P41318 | 681 | 4.0(10)-67 | Saccharomyces cerevisiae | hypothetical trp-asp repeats containing protein in sis1-mrpl2 intergenic region. |
| CONTIG970 | 14540932_c3_4 | 1173 | 15276 | 585 | 195 | P53981 | 489 | 9.0(10)-47 | Saccharomyces cerevisiae | hypothetical 27.5 kd protein in spo1-sis1 intergenic region. |
| CONTIG1883 | 4947952_f3_1 | 1174 | 15277 | 819 | 273 | P53980 | 330 | 6.4(10)-30 | Saccharomyces cerevisiae | hypothetical 49.9 kd protein in spo1-sis1 intergenic region. |
| CONTIG2980 | 4589591_c1_4 | 1175 | 15278 | 1410 | 470 | P53973 | 442 | 7.0(10)-52 | Saccharomyces cerevisiae | hypothetical 80.1 kd protein in ume3-pub1 intergenic region. |
| CONTIG1632 | 16229149_c1_1 | 1176 | 15279 | 1158 | 386 | P53973 | 1007 | 1.2(10)-101 | Saccharomyces cerevisiae | hypothetical 80.1 kd protein in ume3-pub1 intergenic region. |
| CONTIG4709 | 3761_f2_6 | 1177 | 15280 | 1065 | 355 | P53972 | 569 | 3.0(10)-55 | Saccharomyces cerevisiae | hypothetical 56.2 kd protein in ume3-pub1 intergenic region. |
| CONTIG4709 | 5104026_f3_10 | 1178 | 15281 | 213 | 71 | P53972 | 111 | 1.0(10)-5 | Saccharomyces cerevisiae | hypothetical 56.2 kd protein in ume3-pub1 intergenic region. |
| CONTIG5396 | 3954062_f2_3 | 1179 | 15282 | 846 | 282 | P53971 | 434 | 6.9(10)-40 | Saccharomyces cerevisiae | hypothetical 108.5 kd protein in ume3-pub1 intergenic region. |
| CONTIG5396 | 21729527_f2_4 | 1180 | 15283 | 1725 | 575 | P53971 | 774 | 5.7(10)-77 | Saccharomyces cerevisiae | hypothetical 108.5 kd protein in ume3-pub1 intergenic region. |
| CONTIG4331 | 1067693_f1_1 | 1181 | 15284 | 708 | 236 | P53969 | 316 | 3.2(10)-28 | Saccharomyces cerevisiae | hypothetical 54.4 kd protein in hhf2-ume3 intergenic region. |
| CONTIG5534 | 4485688_f2_3 | 1182 | 15285 | 1134 | 378 | P53965 | 591 | 1.3(10)-57 | Saccharomyces cerevisiae | hypothetical 32.8 kd protein in nce3-hht2 intergenic region. |
| CONTIG3366 | 5266910_f2_1 | 1183 | 15286 | 1092 | 364 | P53962 | 661 | 5.4(10)-65 | Saccharomyces cerevisiae | hypothetical 43.8 kd protein in nce3-hht2 intergenic region. |
| CONTIG5549 | 959712_c1_4 | 1184 | 15287 | 1206 | 402 | P53960 | 490 | 7.0(10)-47 | Saccharomyces cerevisiae | hypothetical 51.0 kd protein in yip3-tfc5 intergenic region. |
| CONTIG5326 | 1957251_f1_3 | 1185 | 15288 | 2358 | 786 | P53959 | 441 | 1.7(10)-50 | Saccharomyces cerevisiae | hypothetical 97.0 kd protein in yip3-tfc5 intergenic region. |
| CONTIG436 | 1075177_f3_3 | 1186 | 15289 | 660 | 220 | P53958 | 135 | 1.8(10)-8 | Saccharomyces cerevisiae | hypothetical 43.7 kd protein in yip3-tfc5 intergenic region. |
| CONTIG914 | 22304536_f2_2 | 1187 | 15290 | 597 | 199 | P53958 | 103 | 0.0033 | Saccharomyces cerevisiae | hypothetical 43.7 kd protein in yip3-tfc5 intergenic region. |
| CONTIG4265 | 25507687_f2_1 | 1188 | 15291 | 282 | 94 | P53953 | 198 | 1.1(10)-14 | Saccharomyces cerevisiae | hypothetical 98.9 kd protein in cox5a-yip3 intergenic region. |
| CONTIG5386 | 33240886_f1_2 | 1189 | 15292 | 348 | 116 | P53952 | 114 | 1.7(10)-6 | Saccharomyces cerevisiae | hypothetical 31.4 kd protein in cox5a-yip3 intergenic region. |
| CONTIG22 | 22147827_c1_2 | 1190 | 15293 | 474 | 158 | P53951 | 245 | 1.3(10)-20 | Saccharomyces cerevisiae | hypothetical 45.6 kd protein in cox5a-yip3 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4265 | 34375337_c1_3 | 1191 | 15294 | 1137 | 379 | P53951 | 288 | 1.8(10)-25 | Saccharomyces cerevisiae | hypothetical 45.6 kd protein in cox5a-yip3 intergenic region. |
| CONTIG4061 | 23629662_c1_6 | 1192 | 15295 | 2094 | 698 | P53950 | 177 | 6.4(10)-10 | Saccharomyces cerevisiae | hypothetical 128.1 kd protein in omp2-msg5 intergenic region. |
| CONTIG5770 | 22767181_c2_30 | 1193 | 15296 | 783 | 261 | P53949 | 210 | 6.2(10)-31 | Saccharomyces cerevisiae | hypothetical 22.5 kd protein in nop2-omp2 intergenic region. |
| CONTIG3682 | 23847625_f2_3 | 1194 | 15297 | 345 | 115 | P53944 | 259 | 2.1(10)-22 | Saccharomyces cerevisiae | hypothetical 35.9 kd protein in mas5-gcd10 intergenic region. |
| CONTIG4208 | 24431686_c2_6 | 1195 | 15298 | 744 | 248 | P53941 | 820 | 7.5(10)-82 | Saccharomyces cerevisiae | hypothetical 33.5 kd protein in mks1-msk1 intergenic region. |
| CONTIG4734 | 20391382_f1_1 | 1196 | 15299 | 1428 | 476 | P53938 | 251 | 9.3(10)-39 | Saccharomyces cerevisiae | hypothetical 41.7 kd protein in pms1-tpm1 intergenic region. |
| CONTIG3292 | 4303311_f2_1 | 1197 | 15300 | 534 | 178 | P48233 | 151 | 5.2(10)-10 | Saccharomyces cerevisiae | putative mitochondrial carrier ynl083w. |
| CONTIG3292 | 1226412_f3_3 | 1198 | 15301 | 987 | 329 | P48233 | 385 | 7.0(10)-63 | Saccharomyces cerevisiae | putative mitochondrial carrier ynl083w. |
| b1x16339.x | 14658431_c3_3 | 1199 | 15302 | 567 | 189 | P48231 | 286 | 7.0(10)-24 | Saccharomyces cerevisiae | hypothetical 132.5 kd protein in top2-mkt1 intergenic region. |
| CONTIG5614 | 14652161_f3_16 | 1200 | 15303 | 1185 | 395 | P53934 | 484 | 3.1(10)-46 | Saccharomyces cerevisiae | hypothetical 45.5 kd protein in ypt53-rho2 intergenic region. |
| CONTIG4999 | 13907792_c1_7 | 1201 | 15304 | 573 | 191 | P53932 | 369 | 2.0(10)-33 | Saccharomyces cerevisiae | hypothetical 71.2 kd protein in ypt53 intergenic region. |
| CONTIG2241 | 480207_f2_1 | 1202 | 15305 | 792 | 264 | P50947 | 262 | 1.0(10)-22 | Saccharomyces cerevisiae | hypothetical 37.0 kd protein in ras2-ypt53 intergenic region. |
| CONTIG377 | 4803150_f1_1 | 1203 | 15306 | 657 | 219 | P50947 | 144 | 3.2(10)-22 | Saccharomyces cerevisiae | hypothetical 37.0 kd protein in ras2-ypt53 intergenic region. |
| CONTIG3056 | 24391087_f2_3 | 1204 | 15307 | 198 | 66 | P50946 | 123 | 1.2(10)-7 | Saccharomyces cerevisiae | hypothetical 27.2 kd protein in pol1-ras2 intergenic region. |
| b2x13866.x | 10833318_f1_1 | 1205 | 15308 | 600 | 200 | P50946 | 372 | 2.2(10)-34 | Saccharomyces cerevisiae | hypothetical 27.2 kd protein in pol1-ras2 intergenic region. |
| CONTIG5369 | 5275330_c1_7 | 1206 | 15309 | 564 | 188 | P53929 | 253 | 9.1(10)-22 | Saccharomyces cerevisiae | hypothetical 30.7 kd protein in cyb5-leu4 intergenic region. |
| CONTIG1997 | 23991322_c3_9 | 1207 | 15310 | 252 | 84 | P53925 | 156 | 2.2(10)-10 | Saccharomyces cerevisiae | hypothetical 74.0 kd protein in mls1-rpc19 intergenic region. |
| b2x12719.x | 20709391_c2_4 | 1208 | 15311 | 837 | 279 | P53925 | 324 | 1.7(10)-28 | Saccharomyces cerevisiae | hypothetical 74.0 kd protein in mls1-rpc19 intergenic region. |
| CONTIG1997 | 5100062_c1_7 | 1209 | 15312 | 1140 | 380 | P53924 | 646 | 2.1(10)-63 | Saccharomyces cerevisiae | hypothetical 57.6 kd protein in mls1-rpc19 intergenic region. |
| CONTIG3152 | 24414067_c1_6 | 1210 | 15313 | 561 | 187 | P53923 | 175 | 1.3(10)-12 | Saccharomyces cerevisiae | hypothetical 56.5 kd protein in tom70-psu1 intergenic region. |
| CONTIG5813 | 25673831_f1_1 | 1211 | 15314 | 327 | 109 | P53923 | 115 | 3.8(10)-6 | Saccharomyces cerevisiae | hypothetical 56.5 kd protein in tom70-psu1 intergenic region. |
| CONTIG3997 | 406311_c3_9 | 1212 | 15315 | 321 | 107 | P53921 | 103 | 7.2(10)-6 | Saccharomyces cerevisiae | hypothetical 13.2 kd protein in spc98-tom70 intergenic region. |
| CONTIG1346 | 25416578_f3_2 | 1213 | 15316 | 801 | 267 | P53920 | 586 | 2.8(10)-56 | Saccharomyces cerevisiae | hypothetical 110.9 kd protein in spc98-tom70 intergenic region. |
| CONTIG3997 | 2244792_f3_3 | 1214 | 15317 | 639 | 213 | P53920 | 395 | 1.1(10)-35 | Saccharomyces cerevisiae | hypothetical 110.9 kd protein in spc98-tom70 intergenic region. |
| b9x13t42.x | 11142039_c2_4 | 1215 | 15318 | 846 | 282 | P53920 | 886 | 7.7(10)-89 | Saccharomyces cerevisiae | hypothetical 110.9 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3662 | 16603325_f1_1 | 1216 | 15319 | 1857 | 619 | P53919 | 293 | 5.4(10)-24 | Saccharomyces cerevisiae | spc98-tom70 intergenic region. hypothetical 54.9 kd protein in spc98-tom70 intergenic region. |
| CONTIG3543 | 29336061_c2_1 | 1217 | 15320 | 2040 | 680 | P53917 | 220 | 1.3(10)-30 | Saccharomyces cerevisiae | hypothetical 109.8 kd protein in cpt1-spc98 intergenic region. |
| b1x18806.y | 25673905_f2_1 | 1218 | 15321 | 459 | 153 | P53917 | 199 | 1.0(10)-14 | Saccharomyces cerevisiae | hypothetical 109.8 kd protein in cpt1-spc98 intergenic region. |
| CONTIG5590 | 100757_f1_2 | 1219 | 15322 | 804 | 268 | P53915 | 396 | 6.5(10)-37 | Saccharomyces cerevisiae | hypothetical 27.7 kd protein in cpt1-spc98 intergenic region. |
| CONTIG5590 | 863500_c3_21 | 1220 | 15323 | 1263 | 421 | P53914 | 1232 | 1.7(10)-125 | Saccharomyces cerevisiae | hypothetical 119.3 kd protein in fpr1-tom22 intergenic region. |
| CONTIG5590 | 23728402_c3_20 | 1221 | 15324 | 1869 | 623 | P53914 | 2387 | 6.7(10)-248 | Saccharomyces cerevisiae | hypothetical 119.3 kd protein in fpr1-tom22 intergenic region. |
| CONTIG680 | 973563_c3_2 | 1222 | 15325 | 396 | 132 | P53914 | 349 | 1.1(10)-30 | Saccharomyces cerevisiae | hypothetical 119.3 kd protein in fpr1-tom22 intergenic region. |
| CONTIG1460 | 12156511_c3_3 | 1223 | 15326 | 621 | 207 | P53912 | 286 | 2.8(10)-25 | Saccharomyces cerevisiae | hypothetical 41.2 kd protein in fpr1-tom22 intergenic region. |
| CONTIG2525 | 20392877_f1_1 | 1224 | 15327 | 1161 | 387 | P53912 | 396 | 6.5(10)-37 | Saccharomyces cerevisiae | hypothetical 41.2 kd protein in fpr1-tom22 intergenic region. |
| CONTIG4017 | 12156511_c1_6 | 1225 | 15328 | 1128 | 376 | P53912 | 455 | 3.6(10)-43 | Saccharomyces cerevisiae | hypothetical 41.2 kd protein in fpr1-tom22 intergenic region. |
| CONTIG5493 | 4891938_f1_2 | 1226 | 15329 | 1005 | 335 | P53912 | 429 | 2.1(10)-40 | Saccharomyces cerevisiae | hypothetical 41.2 kd protein in fpr1-tom22 intergenic region. |
| CONTIG2675 | 1181250_c2_2 | 1227 | 15330 | 1110 | 370 | P53907 | 102 | 7.5(10)-6 | Saccharomyces cerevisiae | hypothetical 84.2 kd protein in mfa2-mep2 intergenic region. |
| CONTIG387 | 1181250_c3_6 | 1228 | 15331 | 606 | 202 | P53907 | 103 | 0.0047 | Saccharomyces cerevisiae | hypothetical 84.2 kd protein in mfa2-mep2 intergenic region. |
| CONTIG5721 | 10820938_f3_16 | 1229 | 15332 | 231 | 77 | P53905 | 196 | 1.0(10)-15 | Saccharomyces cerevisiae | hypothetical 12.1 kd protein in rpc8-mfa2 intergenic region. |
| CONTIG3225 | 9771875_c3_3 | 1230 | 15333 | 873 | 291 | P53901 | 202 | 9.5(10)-16 | Saccharomyces cerevisiae | hypothetical 46.2 kd protein in yck2-rpc8 intergenic region. |
| CONTIG5745 | 23913250_c1_12 | 1231 | 15334 | 423 | 141 | P53900 | 269 | 1.8(10)-23 | Saccharomyces cerevisiae | hypothetical 15.2 kd protein in yck2-rpc8 intergenic region. |
| CONTIG4959 | 14573311_f1_1 | 1232 | 15335 | 963 | 321 | P53899 | 197 | 4.4(10)-32 | Saccharomyces cerevisiae | hypothetical 31.5 kd protein in ygp1-yck2 intergenic region. |
| CONTIG4351 | 3912512_c1_3 | 1233 | 15336 | 1023 | 341 | P53898 | 106 | 9.0(10)-6 | Saccharomyces cerevisiae | hypothetical 33.7 kd protein in ygp1-yck2 intergenic region. |
| CONTIG5490 | 6929636_f3_6 | 1234 | 15337 | 411 | 137 | P53897 | 171 | 4.5(10)-13 | Saccharomyces cerevisiae | hypothetical 18.1 kd protein in ygp1-yck2 intergenic region. |
| CONTIG4149 | 3926537_c1_3 | 1235 | 15338 | 1110 | 370 | P53890 | 112 | 0.00075 | Saccharomyces cerevisiae | hypothetical 49.7 kd protein in sko1-rpl44a intergenic region. |
| CONTIG5109 | 23634682_f2_5 | 1236 | 15339 | 879 | 293 | P53881 | 460 | 1.1(10)-43 | Saccharomyces cerevisiae | hypothetical 34.9 kd protein in rps3-psd1 intergenic region. |
| CONTIG5681 | 34189037_c3_17 | 1237 | 15340 | 1512 | 504 | P53878 | 878 | 5.4(10)-88 | Saccharomyces cerevisiae | hypothetical 46.5 kd protein in npr1-rps3 intergenic region. |
| CONTIG5681 | 3164068_f1_2 | 1238 | 15341 | 1698 | 566 | P53877 | 385 | 3.2(10)-42 | Saccharomyces cerevisiae | hypothetical 61.8 kd protein in npr1-rps3 intergenic region. |
| CONTIG624 | 23488576_c1_3 | 1239 | 15342 | 351 | 117 | P53872 | 149 | 9.6(10)-11 | Saccharomyces cerevisiae | hypothetical 22.0 kd protein in chs1-srp1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x18227.x | 36425626_f1_1 | 1240 | 15343 | 537 | 179 | P53871 | 504 | 2.2(10)-48 | Saccharomyces cerevisiae | hypothetical 40.2 kd protein in chs1-srp1 intergenic region. |
| CONTIG3186 | 2738942_c3_5 | 1241 | 15344 | 1074 | 358 | P53870 | 130 | 1.8(10)-5 | Saccharomyces cerevisiae | hypothetical 63.9 kd protein in whi3-chs1 intergenic region. |
| CONTIG5496 | 134512_c1_13 | 1242 | 15345 | 600 | 200 | P53870 | 124 | 8.0(10)-6 | Saccharomyces cerevisiae | hypothetical 63.9 kd protein in whi3-chs1 intergenic region. |
| CONTIG1744 | 286441_f1_1 | 1243 | 15346 | 471 | 157 | P40165 | 216 | 7.7(10)-18 | Saccharomyces cerevisiae | hypothetical 27.5 kd protein in spx19-gcr2 intergenic region. |
| CONTIG5321 | 32245432_c1_23 | 1244 | 15347 | 1347 | 449 | P40160 | 1235 | 8.0(10)-126 | Saccharomyces cerevisiae | hypothetical 49.1 kd protein in ssb2-spx18 intergenic region. |
| CONTIG2114 | 7083431_f1_1 | 1245 | 15348 | 525 | 175 | P40157 | 348 | 7.4(10)-31 | Saccharomyces cerevisiae | hypothetical 88.8 kd protein in rap1-mer1 intergenic region. |
| CONTIG2947 | 24273962_c1_8 | 1246 | 15349 | 1269 | 423 | P40157 | 424 | 4.2(10)-39 | Saccharomyces cerevisiae | hypothetical 88.8 kd protein in rap1-mer1 intergenic region. |
| CONTIG5440 | 4882000_c3_19 | 1247 | 15350 | 498 | 166 | P40156 | 151 | 5.9(10)-11 | Saccharomyces cerevisiae | hypothetical 25.3 kd protein in rap1-mer1 intergenic region. |
| CONTIG227 | 25656687_c3_4 | 1248 | 15351 | 834 | 278 | P40154 | 148 | 4.4(10)-10 | Saccharomyces cerevisiae | hypothetical 36.2 kd protein in rap1-mer1 intergenic region. |
| CONTIG3868 | 22297055_c3_7 | 1249 | 15352 | 1002 | 334 | P40154 | 161 | 1.6(10)-11 | Saccharomyces cerevisiae | hypothetical 36.2 kd protein in rap1-mer1 intergenic region. |
| CONTIG5666 | 21603427_f1_4 | 1250 | 15353 | 2040 | 680 | P40151 | 996 | 1.7(10)-100 | Saccharomyces cerevisiae | hypothetical 66.5 kd protein in ade12-rap1 intergenic region. |
| CONTIG4979 | 14176300_f3_8 | 1251 | 15354 | 735 | 245 | P53867 | 214 | 8.0(10)-17 | Saccharomyces cerevisiae | hypothetical 56.6 kd protein in ure2-ssu72 intergenic region. |
| CONTIG4979 | 20119176_f1_3 | 1252 | 15355 | 696 | 232 | P53867 | 285 | 1.3(10)-24 | Saccharomyces cerevisiae | hypothetical 56.6 kd protein in ure2-ssu72 intergenic region. |
| CONTIG3425 | 26230450_f2_1 | 1253 | 15356 | 1353 | 451 | P53866 | 195 | 1.6(10)-23 | Saccharomyces cerevisiae | hypothetical 86.9 kd protein in ure2-ssu72 intergenic region. |
| CONTIG5475 | 9932211_c2_13 | 1254 | 15357 | 1008 | 336 | P53859 | 387 | 5.7(10)-36 | Saccharomyces cerevisiae | hypothetical 31.6 kd protein in sin4-ure2 intergenic region. |
| CONTIG5329 | 480202_c3_10 | 1255 | 15358 | 2961 | 987 | P53858 | 119 | 0.00169 | Saccharomyces cerevisiae | hypothetical 100.6 kd protein in sin4-ure2 intergenic region. |
| CONTIG5475 | 12600775_c3_14 | 1256 | 15359 | 630 | 210 | P53858 | 254 | 1.2(10)-20 | Saccharomyces cerevisiae | hypothetical 100.6 kd protein in sin4-ure2 intergenic region. |
| CONTIG4247 | 5276580_c1_3 | 1257 | 15360 | 849 | 283 | P53857 | 291 | 8.6(10)-26 | Saccharomyces cerevisiae | hypothetical 47.8 kd protein in sin4-ure2 intergenic region. |
| CONTIG2129 | 21516953_f2_1 | 1258 | 15361 | 1791 | 597 | P23503 | 392 | 2.8(10)-60 | Saccharomyces cerevisiae | hypothetical 54.2 kd protein in zwf1-blh1/lap3 intergenic region. |
| CONTIG3387 | 16492692_c2_2 | 1259 | 15362 | 1167 | 389 | P53855 | 588 | 7.0(10)-56 | Saccharomyces cerevisiae | hypothetical 178.4 kd protein in sla2-zwf1 intergenic region. |
| CONTIG3704 | 21578452_c2_5 | 1260 | 15363 | 684 | 228 | P53855 | 114 | 0.00079 | Saccharomyces cerevisiae | hypothetical 178.4 kd protein in sla2-zwf1 intergenic region. |
| CONTIG4992 | 25470067_f3_5 | 1261 | 15364 | 2769 | 923 | P53855 | 109 | 4.7(10)-5 | Saccharomyces cerevisiae | hypothetical 178.4 kd protein in sla2-zwf1 intergenic region. |
| CONTIG3027 | 16829055_c3_5 | 1262 | 15365 | 471 | 157 | P53854 | 135 | 2.8(10)-9 | Saccharomyces cerevisiae | hypothetical 20.4 kd protein in rpa49-sui1 intergenic region. |
| CONTIG2965 | 26265885_f3_2 | 1263 | 15366 | 501 | 167 | P53853 | 161 | 7.0(10)-12 | Saccharomyces cerevisiae | hypothetical 30.6 kd protein in rpa49-sui1 intergenic region. |
| CONTIG5793 | 4820262_c3_25 | 1264 | 15367 | 1197 | 399 | P53850 | 144 | 9.4(10)-9 | Saccharomyces cerevisiae | hypothetical 46.2 kd protein in sip3- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG763 | 19725013_f1_1 | 1265 | 15368 | 666 | 222 | P53847 | 108 | 0.00239 | Saccharomyces cerevisiae | hypothetical 88.1 kd protein in atx1-sip3 intergenic region. |
| CONTIG1975 | 20319632_c1_4 | 1266 | 15369 | 726 | 242 | P34624 | 130 | 5.7(10)-6 | Caenorhabditis elegans | hypothetical 63.5 kd protein zk353.1 in chromosome iii. |
| CONTIG5479 | 2833500_f2_4 | 1267 | 15370 | 1035 | 345 | P17778 | 111 | 0.00119 | Yersinia pestis | outer membrane protein yopm. |
| CONTIG833 | 19666391_f1_1 | 1268 | 15371 | 1200 | 400 | P30638 | 145 | 4.2(10)-7 | Caenorhabditis elegans | hypothetical 59.1 kd protein zk637.1 in chromosome iii. |
| CONTIG4986 | 194813_f3_6 | 1269 | 15372 | 183 | 61 | P29953 | 100 | 1.5(10)-5 | Sinorhizobium meliloti | hypothetical 18.2 kd protein in pmi 5'region (orf1). |
| CONTIG4923 | 882807_c2_8 | 1270 | 15373 | 747 | 249 | P43132 | 212 | 2.2(10)-28 | Saccharomyces cerevisiae | hypothetical protein in ppr1 5'region (orfx) (fragment). |
| CONTIG1991 | 10825861_f1_1 | 1271 | 15374 | 912 | 304 | Q09625 | 101 | 0.0061 | Caenorhabditis elegans | hypothetical 84.3 kd protein zk945.10 in chromosome ii. |
| CONTIG3059 | 25399051_c1_7 | 1272 | 15375 | 933 | 311 | Q09625 | 91 | 0.28 | Caenorhabditis elegans | hypothetical 84.3 kd protein zk945.10 in chromosome ii. |
| CONTIG2909 | 134687_f3_3 | 1273 | 15376 | 192 | 64 | P38374 | 140 | 8.6(10)-10 | Saccharomyces cerevisiae | ysy6 protein. |
| CONTIG5399 | 26597138_f3_10 | 1274 | 15377 | 576 | 192 | P38428 | 176 | 1.3(10)-13 | Saccharomyces cerevisiae | hypothetical 17.4 kd protein in tps3 5'region (orf1). |
| CONTIG4596 | 36611686_c3_11 | 1275 | 15378 | 1380 | 460 | Q11157 | 238 | 2.0(10)-21 | Mycobacterium tuberculosis | hypothetical 57.3 kd protein gmc-type oxidoreductase cy20g9.18c. |
| CONTIG5510 | 4956886_f3_12 | 1276 | 15379 | 696 | 232 | Q10532 | 227 | 2.8(10)-18 | Mycobacterium tuberculosis | probable monooxygenase mtcy31.20 (ec 1.14.13.-). |
| CONTIG3344 | 11961463_f2_1 | 1277 | 15380 | 1929 | 643 | P47732 | 150 | 1.7(10)-8 | Chilo iridescent virus | zinc finger protein. |
| CONTIG5374 | 79715_c3_11 | 1278 | 15381 | 204 | 68 | Q07844 | 105 | 9.3(10)-5 | Saccharomyces cerevisiae | hypothetical 93.1 kd protein yll034c. |
| CONTIG1736 | 3907762_f2_1 | 1279 | 15382 | 399 | 133 | Q04749 | 149 | 6.5(10)-10 | Saccharomyces cerevisiae | hypothetical 47.1 kd protein in nca1-hms1 intergenic region. |
| CONTIG1840 | 1229032_c2_2 | 1280 | 15383 | 1302 | 434 | Q04749 | 211 | 1.1(10)-14 | Saccharomyces cerevisiae | hypothetical 47.1 kd protein in nca1-hms1 intergenic region. |
| CONTIG5308 | 19573286_f3_8 | 1281 | 15384 | 939 | 313 | Q00314 | 1088 | 3.0(10)-110 | Candida albicans | vanadate resistance protein. |
| CONTIG3859 | 4954510_f2_2 | 1282 | 15385 | 552 | 184 | Q00614 | 733 | 1.3(10)-72 | Candida tropicalis | carnitine o-acetyltransferase precursor (ec 2.3.1.7) (carnitine acetylase). |
| CONTIG3859 | 40117002_f1_1 | 1283 | 15386 | 933 | 311 | Q00614 | 1371 | 3.1(10)-140 | Candida tropicalis | carnitine o-acetyltransferase precursor (ec 2.3.1.7) (carnitine acetylase). |
| CONTIG4306 | 10625285_f3_3 | 1284 | 15387 | 243 | 81 | Q00614 | 403 | 2.7(10)-37 | Candida tropicalis | carnitine o-acetyltransferase precursor (ec 2.3.1.7) (carnitine acetylase). |
| CONTIG3855 | 24235927_f3_3 | 1285 | 15388 | 708 | 236 | Q17391 | 279 | 2.0(10)-23 | Caenorhabditis elegans | cul-3 protein. |
| CONTIG5274 | 7040968_f3_8 | 1286 | 15389 | 729 | 243 | Q03529 | 482 | 5.0(10)-46 | Saccharomyces cerevisiae | hypothetical 44.9 kd protein in ura10-nrc1 intergenic region. |
| CONTIG5274 | 5970340_f1_1 | 1287 | 15390 | 429 | 143 | Q03529 | 435 | 4.7(10)-41 | Saccharomyces cerevisiae | hypothetical 44.9 kd protein in ura10-nrc1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3166 | 6828532_c1_7 | 1288 | 15391 | 1527 | 509 | Q62871 | 158 | 3.6(10)-8 | *Rattus norvegicus* | dynein intermediate chain 2, cytosoltic (dh ic-2). |
| CONTIG5734 | 4037755_c3_21 | 1289 | 15392 | 261 | 87 | Q24117 | 278 | 2.1(10)-24 | *Drosophila melanogaster* | dynein light chain 1, cytoplasmic. |
| CONTIG2780 | 9900317_f1_1 | 1290 | 15393 | 939 | 313 | Q00310 | 1487 | 1.6(10)-152 | *Candida albicans* | glycolipid 2-alpha-mannosyltransferase (ec 2.4.1.131) (alpha-1,2-mannosyltransferase). |
| CONTIG5223 | 23453407_f1_3 | 1291 | 15394 | 2538 | 846 | Q04660 | 1512 | 2.8(10)-242 | *Saccharomyces cerevisiae* | hypothetical trp-asp repeats containing protein in nup116-far3 intergenic region. |
| CONTIG5208 | 15021941_f2_5 | 1292 | 15395 | 1584 | 528 | Q04225 | 1537 | 8.0(10)-158 | *Saccharomyces cerevisiae* | hypothetical trp-asp repeats containing protein in pom152-rec114 intergenic region. |
| CONTIG2071 | 23985937_f2_1 | 1293 | 15396 | 864 | 288 | Q10010 | 101 | 0.0032 | *Caenorhabditis elegans* | hypothetical 26.6 kd protein t19c3.4 in chromosome iii. |
| CONTIG5431 | 22443787_c1_10 | 1294 | 15397 | 1584 | 528 | Q03103 | 537 | 7.4(10)-52 | *Saccharomyces cerevisiae* | hypothetical 65.0 kd protein in cox14 5'region precursor. |
| CONTIG3692 | 23444692_f3_4 | 1295 | 15398 | 669 | 223 | Q03104 | 256 | 2.2(10)-21 | *Saccharomyces cerevisiae* | hypothetical 59.6 kd protein in cox14-hmgs intergenic region. |
| b3x11010.x | 29407627_c2_2 | 1296 | 15399 | 636 | 212 | Q03104 | 180 | 4.0(10)-13 | *Saccharomyces cerevisiae* | hypothetical 59.6 kd protein in cox14-hmgs intergenic region. |
| CONTIG5790 | 23625900_c2_24 | 1297 | 15400 | 1944 | 648 | Q03124 | 198 | 4.7(10)-28 | *Saccharomyces cerevisiae* | hypothetical 65.2 kd protein in cox14-hmgs intergenic region. |
| CONTIG5785 | 26266876_f3_19 | 1298 | 15401 | 1104 | 368 | Q03210 | 100 | 0.029 | *Saccharomyces cerevisiae* | hypothetical 57.7 kd protein in ndi1-atr1 intergenic region. |
| CONTIG4158 | 25492881_f2_3 | 1299 | 15402 | 1539 | 513 | Q03735 | 387 | 1.1(10)-34 | *Saccharomyces cerevisiae* | hypothetical 126.1 kd protein in ndi1-atr1 intergenic region. |
| CONTIG5322 | 78512_f1_3 | 1300 | 15403 | 1245 | 415 | Q03750 | 128 | 2.2(10)-5 | *Saccharomyces cerevisiae* | hypothetical 58.0 kd protein in van1-dat1 intergenic region. |
| CONTIG5790 | 1985062_c2_25 | 1301 | 15404 | 276 | 92 | Q04493 | 166 | 1.5(10)-12 | *Saccharomyces cerevisiae* | hypothetical 18.4 kd protein in rad10-prs4 intergenic region. |
| CONTIG3067 | 33632692_c3_9 | 1302 | 15405 | 1746 | 582 | Q04500 | 605 | 1.2(10)-104 | *Saccharomyces cerevisiae* | hypothetical 103.0 kd protein in rad10-prs4 intergenic region. |
| CONTIG5172 | 34103430_f1_2 | 1303 | 15406 | 1434 | 478 | Q04511 | 200 | 8.3(10)-13 | *Saccharomyces cerevisiae* | hypothetical 76.9 kd protein in rpm2-tub1 intergenic region. |
| CONTIG3610 | 21484517_c2_8 | 1304 | 15407 | 546 | 182 | Q03630 | 152 | 4.7(10)-11 | *Saccharomyces cerevisiae* | hypothetical 18.4 kd protein in cpr3-hmg1 intergenic region. |
| CONTIG3604 | 35180258_c1_7 | 1305 | 15408 | 744 | 248 | Q03640 | 615 | 8.5(10)-59 | *Saccharomyces cerevisiae* | hypothetical 171.1 kd protein in yl16a-dak1 intergenic region. |
| CONTIG3938 | 24236061_c2_3 | 1306 | 15409 | 1512 | 504 | Q04632 | 143 | 1.0(10)-6 | *Saccharomyces cerevisiae* | hypothetical 69.8 kd protein in yl16a-dak1 intergenic region. |
| CONTIG5538 | 1957043_c3_20 | 1307 | 15410 | 1521 | 507 | Q04638 | 396 | 6.5(10)-37 | *Saccharomyces cerevisiae* | hypothetical 54.1 kd protein in dak1-orc1 intergenic region. |
| CONTIG4112 | 21526632_c2_3 | 1308 | 15411 | 285 | 95 | Q04651 | 140 | 4.2(10)-9 | *Saccharomyces cerevisiae* | hypothetical 40.7 kd protein in dak1-orc1 intergenic region. |
| CONTIG5538 | 14730276_f1_5 | 1309 | 15412 | 594 | 198 | Q04651 | 269 | 1.8(10)-23 | *Saccharomyces cerevisiae* | hypothetical 40.7 kd protein in dak1-orc1 intergenic region. |
| CONTIG5804 | 4866442_f2_13 | 1310 | 15413 | 927 | 309 | Q04658 | 166 | 4.5(10)-10 | *Saccharomyces cerevisiae* | hypothetical 40.9 kd protein in dak1-orc1 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1190 | 1190880_c3_2 | 1311 | 15414 | 603 | 201 | Q04693 | 164 | 8.5(10)-11 | Saccharomyces cerevisiae | hypothetical 153.8 kd protein in gal80-prp39 intergenic region. |
| CONTIG2411 | 20426300_c1_4 | 1312 | 15415 | 495 | 165 | Q03697 | 149 | 7.0(10)-10 | Saccharomyces cerevisiae | hypothetical 49.6 kd protein in cat2-amd1 intergenic region. |
| CONTIG3113 | 24322033_c2_3 | 1313 | 15416 | 726 | 242 | Q03705 | 179 | 6.4(10)-14 | Saccharomyces cerevisiae | hypothetical 20.7 kd protein in cat2-amd1 intergenic region. |
| CONTIG1146 | 23548550_c3_2 | 1314 | 15417 | 402 | 134 | Q03707 | 247 | 3.7(10)-20 | Saccharomyces cerevisiae | hypothetical 74.2 kd protein in amd1-rad52 intergenic region. |
| b1x19622.x | 34160942_f3_2 | 1315 | 15418 | 429 | 143 | Q03707 | 105 | 6.9(10)-5 | Saccharomyces cerevisiae | hypothetical 74.2 kd protein in amd1-rad52 intergenic region. |
| CONTIG3459 | 954431_c1_3 | 1316 | 15419 | 282 | 94 | Q03712 | 167 | 1.2(10)-12 | Saccharomyces cerevisiae | hypothetical 17.7 kd protein in amd1-rad52 intergenic region. |
| CONTIG2638 | 409661_c2_6 | 1317 | 15420 | 447 | 149 | Q03713 | 284 | 4.7(10)-25 | Saccharomyces cerevisiae | hypothetical 18.5 kd protein in ndc1-tsa1 intergenic region. |
| CONTIG4246 | 20197175_c3_6 | 1318 | 15421 | 801 | 267 | Q03722 | 123 | 3.2(10)-10 | Saccharomyces cerevisiae | hypothetical 76.1 kd protein in ung1-psp2 intergenic region. |
| CONTIG4843 | 486637_f1_1 | 1319 | 15422 | 804 | 268 | Q03722 | 417 | 1.6(10)-53 | Saccharomyces cerevisiae | hypothetical 76.1 kd protein in ung1-psp2 intergenic region. |
| CONTIG1350 | 32634401_f2_2 | 1320 | 15423 | 375 | 125 | Q03723 | 108 | 1.2(10)-5 | Saccharomyces cerevisiae | hypothetical 37.9 kd protein in ung1-psp2 intergenic region. |
| CONTIG5667 | 270161_c3_23 | 1321 | 15424 | 1278 | 426 | Q03730 | 561 | 2.1(10)-54 | Saccharomyces cerevisiae | hypothetical 43.7 kd protein in ung1-psp2 intergenic region. |
| CONTIG5626 | 9978387_c1_8 | 1322 | 15425 | 1779 | 593 | Q04228 | 176 | 5.0(10)-12 | Saccharomyces cerevisiae | hypothetical 66.8 kd protein in ppz1-spt5 intergenic region. |
| CONTIG2720 | 34610936_c2_3 | 1323 | 15426 | 1146 | 382 | Q04235 | 557 | 5.5(10)-54 | Saccharomyces cerevisiae | hypothetical 52.7 kd protein in pdr4-glo1 intergenic region. |
| CONTIG4496 | 14881563_f1_1 | 1324 | 15427 | 264 | 88 | Q04257 | 132 | 2.0(10)-8 | Saccharomyces cerevisiae | hypothetical 34.0 kd protein in glo1-ypt7 intergenic region. |
| CONTIG4496 | 6020342_f2_3 | 1325 | 15428 | 1890 | 630 | Q04263 | 371 | 2.0(10)-31 | Saccharomyces cerevisiae | hypothetical 84.6 kd protein in glo1-ypt7 intergenic region. |
| CONTIG304 | 878427_c1_1 | 1326 | 15429 | 504 | 168 | Q03667 | 183 | 2.3(10)-14 | Saccharomyces cerevisiae | hypothetical 16.7 kd protein in cdc5-mvp1 intergenic region. |
| CONTIG4412 | 7070337_c3_6 | 1327 | 15430 | 543 | 181 | Q03677 | 473 | 4.5(10)-45 | Saccharomyces cerevisiae | hypothetical 20.9 kd protein in plb1-hxt2 intergenic region. |
| CONTIG2648 | 24816442_c2_3 | 1328 | 15431 | 291 | 97 | Q03687 | 90 | 0.0015 | Saccharomyces cerevisiae | hypothetical 46.9 kd protein in plb1-hxt2 intergenic region. |
| CONTIG1044 | 10438137_f2_1 | 1329 | 15432 | 969 | 323 | Q03690 | 178 | 2.3(10)-19 | Saccharomyces cerevisiae | hypothetical 145.2 kd protein in hxt2-sec59 intergenic region. |
| CONTIG4741 | 34453912_f2_3 | 1330 | 15433 | 972 | 324 | Q04347 | 124 | 1.2(10)-14 | Saccharomyces cerevisiae | hypothetical 60.1 kd protein in sec59-erg5 intergenic region. |
| CONTIG4060 | 11932275_c2_4 | 1331 | 15434 | 1329 | 443 | Q04371 | 854 | 1.8(10)-85 | Saccharomyces cerevisiae | hypothetical 54.1 kd protein in mrpl3-tap42 intergenic region. |
| CONTIG5334 | 23988281_c2_10 | 1332 | 15435 | 1779 | 593 | Q05040 | 149 | 2.3(10)-7 | Saccharomyces cerevisiae | hypothetical 59.3 kd protein in tap42-imp2 intergenic region. |
| CONTIG4931 | 10974010_f3_9 | 1333 | 15436 | 1242 | 414 | Q05131 | 1170 | 6.2(10)-119 | Saccharomyces cerevisiae | hypothetical 48.4 kd protein in tap42-imp2 intergenic region. |
| CONTIG5673 | 178188_f3_16 | 1334 | 15437 | 243 | 81 | Q04212 | 192 | 6.0(10)-15 | Saccharomyces cerevisiae | hypothetical 38.2 kd protein in sub1-arg1 intergenic region. |
| CONTIG2721 | 23925000_c2_8 | 1335 | 15438 | 867 | 289 | Q04213 | 114 | 4.7(10)-5 | Saccharomyces cerevisiae | hypothetical 55.4 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3004 | 781630_f2_1 | 1336 | 15439 | 1434 | 478 | Q04213 | 114 | 0.00048 | Saccharomyces cerevisiae | mcm1-nup116 intergenic region. |
| b9x10v23.x | 20394062_f1_1 | 1337 | 15440 | 525 | 175 | Q04213 | 112 | 2.2(10)-14 | Saccharomyces cerevisiae | hypothetical 55.4 kd protein in mcm1-nup116 intergenic region. |
| CONTIG3141 | 4100318_f1_1 | 1338 | 15441 | 921 | 307 | Q04659 | 151 | 5.5(10)-9 | Saccharomyces cerevisiae | hypothetical 55.4 kd protein in mcm1-nup116 intergenic region. |
| CONTIG5130 | 15651077_c3_14 | 1339 | 15442 | 522 | 174 | Q04767 | 424 | 7.0(10)-40 | Saccharomyces cerevisiae | hypothetical 36.4 kd protein in nup116-far3 intergenic region. |
| CONTIG5016 | 4065682_f2_2 | 1340 | 15443 | 1110 | 370 | Q04779 | 233 | 2.7(10)-29 | Saccharomyces cerevisiae | hypothetical 18.7 kd protein in hms1-abf2 intergenic region. |
| CONTIG5742 | 210838_c2_25 | 1341 | 15444 | 711 | 237 | Q04264 | 324 | 6.9(10)-28 | Saccharomyces cerevisiae | hypothetical 78.8 kd protein in abf2-chl12 intergenic region. |
| CONTIG5742 | 22351410_c1_20 | 1342 | 15445 | 2259 | 753 | Q04264 | 812 | 2.7(10)-80 | Saccharomyces cerevisiae | hypothetical 147.0 kd protein in abf2-chl12 intergenic region. |
| CONTIG5742 | 5136561_c2_24 | 1343 | 15446 | 798 | 266 | Q04264 | 415 | 1.3(10)-37 | Saccharomyces cerevisiae | hypothetical 147.0 kd protein in abf2-chl12 intergenic region. |
| CONTIG1154 | 34158377_c3_1 | 1344 | 15447 | 579 | 193 | Q04305 | 516 | 1.2(10)-49 | Saccharomyces cerevisiae | hypothetical 147.0 kd protein in abf2-chl12 intergenic region. |
| CONTIG2587 | 4064188_f3_4 | 1345 | 15448 | 240 | 80 | Q04305 | 161 | 4.5(10)-11 | Saccharomyces cerevisiae | hypothetical 57.7 kd protein in aip1-ctf13 intergenic region. |
| CONTIG2587 | 4776637_f2_2 | 1346 | 15449 | 555 | 185 | Q04305 | 227 | 3.2(10)-18 | Saccharomyces cerevisiae | hypothetical 57.7 kd protein in aip1-ctf13 intergenic region. |
| CONTIG4456 | 781250_f3_6 | 1347 | 15450 | 1257 | 419 | Q03151 | 580 | 2.1(10)-56 | Saccharomyces cerevisiae | hypothetical 57.7 kd protein in aip1-ctf13 intergenic region. |
| CONTIG1690 | 6892876_f1_1 | 1348 | 15451 | 873 | 291 | Q03153 | 202 | 2.3(10)-15 | Saccharomyces cerevisiae | hypothetical 42.1 kd protein in ctf13-ypk2 intergenic region. |
| CONTIG5282 | 2145292_c3_12 | 1349 | 15452 | 915 | 305 | Q03161 | 909 | 2.7(10)-91 | Saccharomyces cerevisiae | hypothetical 70.4 kd protein in ctf13-ypk2 intergenic region. |
| CONTIG5465 | 13863177_f2_2 | 1350 | 15453 | 1989 | 663 | Q03162 | 413 | 2.2(10)-52 | Saccharomyces cerevisiae | hypothetical 34.0 kd protein in ctf13-ypk2 intergenic region. |
| CONTIG1456 | 35979055_c1_4 | 1351 | 15454 | 582 | 194 | Q99278 | 112 | 8.0(10)-7 | Saccharomyces cerevisiae | hypothetical 72.2 kd protein in ctf13-ypk2 intergenic region. |
| CONTIG5205 | 4065662_f3_2 | 1352 | 15455 | 1674 | 558 | Q04472 | 412 | 1.0(10)-51 | Saccharomyces cerevisiae | hypothetical 15.2 kd protein in ade17 intergenic region. |
| CONTIG4176 | 14221890_f3_3 | 1353 | 15456 | 1041 | 347 | Q04223 | 323 | 3.5(10)-29 | Saccharomyces cerevisiae | hypothetical 58.0 kd protein in ade17 intergenic region. |
| CONTIG4201 | 25788432_f2_1 | 1354 | 15457 | 1743 | 581 | Q03795 | 352 | 1.6(10)-57 | Saccharomyces cerevisiae | hypothetical 35.3 kd protein in pom152-rec114 intergenic region. |
| CONTIG4237 | 2938801_c2_8 | 1355 | 15458 | 663 | 221 | Q03795 | 127 | 4.2(10)-6 | Saccharomyces cerevisiae | hypothetical 60.0 kd protein in imp1-hlj1 intergenic region. |
| CONTIG5477 | 13750157_c2_14 | 1356 | 15459 | 894 | 298 | Q03798 | 131 | 1.8(10)-6 | Saccharomyces cerevisiae | hypothetical 60.0 kd protein in imp1-hlj1 intergenic region. |
| CONTIG5477 | 20354682_f2_4 | 1357 | 15460 | 183 | 61 | Q03799 | 96 | 4.0(10)-5 | Saccharomyces cerevisiae | hypothetical 29.1 kd protein in imp1-hlj1 intergenic region. |
| CONTIG5477 | 33476001_f1_2 | 1358 | 15461 | 372 | 124 | Q03799 | 263 | 8.0(10)-23 | Saccharomyces cerevisiae | hypothetical 17.5 kd protein in imp1-hlj1 intergenic region. |
| CONTIG5731 | 22457807_f3_12 | 1359 | 15462 | 1608 | 536 | Q03212 | 597 | 3.2(10)-58 | Saccharomyces cerevisiae | hypothetical 62.5 kd protein in ald5-ddr48 intergenic region. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5790 | 3145661_f3_17 | 1360 | 15463 | 1221 | 407 | Q03214 | 215 | 6.4(10)-22 | Saccharomyces cerevisiae | hypothetical 162.7 kd protein in sip18-spt21 intergenic region. |
| CONTIG2867 | 33203900_f2_2 | 1361 | 15464 | 939 | 313 | Q03218 | 289 | 5.0(10)-25 | Saccharomyces cerevisiae | hypothetical 56.2 kd protein in sip18-spt21 intergenic region. |
| CONTIG2412 | 29332563_f2_4 | 1362 | 15465 | 606 | 202 | Q03219 | 207 | 6.9(10)-17 | Saccharomyces cerevisiae | hypothetical 31.1 kd protein in sip18-spt21 intergenic region. |
| CONTIG2417 | 45585506_c2_3 | 1363 | 15466 | 366 | 122 | Q03219 | 122 | 2.2(10)-7 | Saccharomyces cerevisiae | hypothetical 31.1 kd protein in sip18-spt21 intergenic region. |
| CONTIG5818 | 214453_f3_26 | 1364 | 15467 | 2700 | 900 | Q12751 | 574 | 7.5(10)-89 | Saccharomyces cerevisiae | hypothetical 113.2 kd protein in sso2-hsc82 intergenic region. |
| CONTIG5344 | 4803260_f3_9 | 1365 | 15468 | 2337 | 779 | Q04336 | 1823 | 3.2(10)-254 | Saccharomyces cerevisiae | hypothetical 126.6 kd protein in rpl39-cik1 intergenic region. |
| CONTIG5344 | 24651577_f1_2 | 1366 | 15469 | 963 | 321 | Q04336 | 586 | 4.2(10)-56 | Saccharomyces cerevisiae | hypothetical 126.6 kd protein in rpl39-cik1 intergenic region. |
| CONTIG5723 | 2750511_c2_24 | 1367 | 15470 | 633 | 211 | Q03691 | 398 | 4.0(10)-37 | Saccharomyces cerevisiae | hypothetical 28.9 kd protein in cln1-rad14 intergenic region. |
| CONTIG699 | 24320282_c3_5 | 1368 | 15471 | 1017 | 339 | Q03694 | 122 | 5.2(10)-5 | Saccharomyces cerevisiae | hypothetical 47.3 kd protein in tom40-pfk2 intergenic region. |
| CONTIG3934 | 182156_c2_6 | 1369 | 15472 | 624 | 208 | Q03648 | 256 | 1.5(10)-21 | Saccharomyces cerevisiae | hypothetical 52.2 kd protein in rar1-scj1 intergenic region. |
| CONTIG5497 | 2907513_f2_3 | 1370 | 15473 | 1716 | 572 | Q03652 | 183 | 1.6(10)-18 | Saccharomyces cerevisiae | hypothetical 55.3 kd protein in rar1-scj1 intergenic region. |
| CONTIG1993 | 2112625_f2_1 | 1371 | 15474 | 1185 | 395 | Q03653 | 115 | 0.00169 | Saccharomyces cerevisiae | hypothetical 89.2 kd protein in rar1-scj1 intergenic region. |
| CONTIG5315 | 2906375_c3_15 | 1372 | 15475 | 261 | 87 | Q03653 | 106 | 6.7(10)-5 | Saccharomyces cerevisiae | hypothetical 89.2 kd protein in rar1-scj1 intergenic region. |
| CONTIG5134 | 4376436_f2_1 | 1373 | 15476 | 3180 | 1060 | Q03660 | 174 | 2.8(10)-28 | Saccharomyces cerevisiae | hypothetical 128.1 kd protein in gua1-erg8 intergenic region. |
| CONTIG1641 | 25673931_f2_2 | 1374 | 15477 | 729 | 243 | Q04991 | 568 | 3.7(10)-55 | Saccharomyces cerevisiae | hypothetical 56.2 kd protein in erg8-mre11 intergenic region. |
| CONTIG2874 | 414026_c3_7 | 1375 | 15478 | 1059 | 353 | Q04991 | 568 | 3.7(10)-55 | Saccharomyces cerevisiae | hypothetical 56.2 kd protein in erg8-mre11 intergenic region. |
| b9x10437.x | 10676260_f3_2 | 1376 | 15479 | 537 | 179 | Q04991 | 389 | 3.6(10)-36 | Saccharomyces cerevisiae | hypothetical 56.2 kd protein in erg8-mre11 intergenic region. |
| CONTIG4948 | 23867062_f2_5 | 1377 | 15480 | 507 | 169 | Q05024 | 200 | 3.7(10)-16 | Saccharomyces cerevisiae | hypothetical 26.5 kd protein in fus2-mrh1 intergenic region. |
| CONTIG4452 | 1300025_c1_7 | 1378 | 15481 | 1509 | 503 | Q05031 | 1260 | 1.8(10)-128 | Saccharomyces cerevisiae | hypothetical 50.5 kd protein in rna1-rnt1 intergenic region. |
| CONTIG5397 | 23525262_c2_19 | 1379 | 15482 | 909 | 303 | Q04013 | 1128 | 1.8(10)-114 | Saccharomyces cerevisiae | hypothetical 34.2 kd protein in cus1-rpl18a1 intergenic region. |
| CONTIG2938 | 25582885_c3_7 | 1380 | 15483 | 1455 | 485 | Q04781 | 657 | 2.8(10)-63 | Saccharomyces cerevisiae | hypothetical 180.2 kd protein in faa4-cox7 intergenic region. |
| CONTIG5180 | 21525077_f3_7 | 1381 | 15484 | 372 | 124 | Q04781 | 148 | 5.0(10)-9 | Saccharomyces cerevisiae | hypothetical 180.2 kd protein in faa4-cox7 intergenic region. |
| CONTIG5180 | 3298211_f1_3 | 1382 | 15485 | 1089 | 363 | Q04781 | 188 | 1.3(10)-11 | Saccharomyces cerevisiae | hypothetical 180.2 kd protein in faa4-cox7 intergenic region. |
| CONTIG2039 | 36589425_c2_4 | 1383 | 15486 | 1197 | 399 | Q04847 | 215 | 6.0(10)-15 | Saccharomyces cerevisiae | hypothetical 64.4 kd protein in pet111-tif11 intergenic region. |
| CONTIG5689 | 4397680_c3_28 | 1384 | 15487 | 2568 | 856 | Q03496 | 249 | 5.5(10)-25 | Saccharomyces cerevisiae | hypothetical 163.6 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5214 | 29304817_c3_22 | 1385 | 15488 | 234 | 78 | Q03516 | 153 | 8.1(10)-10 | Saccharomyces cerevisiae | pet111-tif11 intergenic region. hypothetical 107.7 kd protein in tsp3-ipp2 intergenic region. |
| CONTIG5214 | 23851512_c1_14 | 1386 | 15489 | 2226 | 742 | Q03516 | 1462 | 7.0(10)-150 | Saccharomyces cerevisiae | hypothetical 107.7 kd protein in tsp3-ipp2 intergenic region. |
| CONTIG5739 | 54715_c2_23 | 1387 | 15490 | 594 | 198 | Q03525 | 97 | 0.00033 | Saccharomyces cerevisiae | hypothetical 16.2 kd protein in prp24-rrm9 intergenic region. |
| CONTIG2885 | 30896938_c2_5 | 1388 | 15491 | 705 | 235 | Q03254 | 166 | 2.2(10)-11 | Saccharomyces cerevisiae | hypothetical 83.4 kd protein in dsk2-cat8 intergenic region. |
| CONTIG595 | 4473518_f1_1 | 1389 | 15492 | 1101 | 367 | Q03254 | 753 | 2.6(10)-79 | Saccharomyces cerevisiae | hypothetical 83.4 kd protein in dsk2-cat8 intergenic region. |
| CONTIG4612 | 4073541_c3_5 | 1390 | 15493 | 960 | 320 | Q03266 | 273 | 7.0(10)-24 | Saccharomyces cerevisiae | hypothetical 42.6 kd protein in msu1-jnm1 intergenic region. |
| CONTIG2973 | 195205_c3_5 | 1391 | 15494 | 396 | 132 | Q03559 | 213 | 1.6(10)-17 | Saccharomyces cerevisiae | hypothetical 22.2 kd protein in jnm1-lcb1 intergenic region. |
| CONTIG2973 | 266050_c3_4 | 1392 | 15495 | 342 | 114 | Q03559 | 125 | 3.3(10)-8 | Saccharomyces cerevisiae | hypothetical 22.2 kd protein in jnm1-lcb1 intergenic region. |
| CONTIG5511 | 19804537_c2_17 | 1393 | 15496 | 1230 | 410 | Q04951 | 953 | 6.0(10)-96 | Saccharomyces cerevisiae | hypothetical 40.5 kd protein in adh2-gas1 intergenic region precursor. |
| CONTIG5723 | 14328401_c1_16 | 1394 | 15497 | 1128 | 376 | Q04867 | 343 | 2.7(10)-31 | Saccharomyces cerevisiae | hypothetical 35.9 kd protein in nip1-glc8 intergenic region. |
| CONTIG4422 | 582785_c1_6 | 1395 | 15498 | 1131 | 377 | Q04869 | 829 | 8.5(10)-83 | Saccharomyces cerevisiae | hypothetical 38.2 kd protein in pre5-fet4 intergenic region. |
| CONTIG5353 | 906325_c1_11 | 1396 | 15499 | 1146 | 382 | Q03829 | 876 | 8.9(10)-88 | Saccharomyces cerevisiae | putative mitochondrial carrier ym166c. |
| CONTIG3577 | 11907193_c1_7 | 1397 | 15500 | 1197 | 399 | Q16739 | 131 | 9.3(10)-20 | Homo sapiens | ceramide glucosyltransferase (ec 2.4.1.80) (fragment). |
| CONTIG3577 | 25397768_c1_6 | 1398 | 15501 | 504 | 168 | Q16739 | 122 | 4.7(10)-7 | Homo sapiens | ceramide glucosyltransferase (ec 2.4.1.80) (fragment). |
| CONTIG5166 | 7112750_c1_7 | 1399 | 15502 | 2352 | 784 | Q12387 | 238 | 2.1(10)-16 | Saccharomyces cerevisiae | dec1 protein (mdm20 protein). |
| CONTIG5345 | 4385790_c3_22 | 1400 | 15503 | 1233 | 411 | Q92206 | 2055 | 1.0(10)-212 | Candida albicans | squalene monooxygenase (ec 1.14.99.7) (squalene epoxidase) (se). |
| CONTIG2584 | 2392002_c2_8 | 1401 | 15504 | 444 | 148 | Q12328 | 426 | 4.2(10)-40 | Saccharomyces cerevisiae | mitochondrial import inner membrane translocase subunit tim22. |
| CONTIG2455 | 5281950_c3_9 | 1402 | 15505 | 735 | 245 | Q12446 | 92 | 0.12 | Saccharomyces cerevisiae | proline-rich protein las17. |
| CONTIG477 | 4188518_c2_3 | 1403 | 15506 | 270 | 90 | Q12446 | 108 | 3.1(10)-5 | Saccharomyces cerevisiae | proline-rich protein las17. |
| CONTIG5033 | 30720953_c1_7 | 1404 | 15507 | 1998 | 666 | Q12446 | 583 | 9.9(10)-57 | Saccharomyces cerevisiae | proline-rich protein las17. |
| CONTIG5540 | 23985180_f3_12 | 1405 | 15508 | 1410 | 470 | Q09329 | 294 | 2.6(10)-52 | Schizosaccharomyces pombe | mlo2 protein. |
| CONTIG1987 | 26798466_f3_4 | 1406 | 15509 | 1023 | 341 | Q00312 | 579 | 2.1(10)-73 | Candida albicans | transcription factor rbf1. |
| CONTIG4207 | 11799055_c2_6 | 1407 | 15510 | 1743 | 581 | Q00312 | 103 | 0.019 | Candida | transcription factor rbf1. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG73 | 26756682_c2_5 | 1408 | 15511 | 537 | 179 | Q00312 | 509 | 6.9(10)-49 | Candida albicans | transcription factor rbf1. |
| CONTIG4868 | 2531286_f3_5 | 1409 | 15512 | 1209 | 403 | Q12600 | 555 | 6.5(10)-87 | Candida albicans | sis2 protein (halotolerance protein hal3). |
| CONTIG3844 | 38175_f3_1 | 1410 | 15513 | 1536 | 512 | Q92331 | 326 | 3.7(10)-27 | Candida tropicalis | vacuolar protein sorting-associated protein vps5. |
| CONTIG4023 | 1962563_f3_3 | 1411 | 15514 | 486 | 162 | Q16718 | 161 | 5.2(10)-12 | Saccharomyces cerevisiae | nadh-ubiquinone oxidoreductase 13 kd-b subunit (ec 1.6.5.3) (ec 1.6.99.3) (complex i-13kd-b) (ci-13kd-b) (b13). |
| CONTIG4798 | 390925_f1_2 | 1412 | 15515 | 1230 | 410 | Q92213 | 1818 | 1.3(10)-187 | Homo sapiens | phosphatidylinositol 3-kinase vps34 (ec 2.7.1.137) (pi3-kinase) (ptdins-3-kinase) (pi3k) (vacuolar sorting protein 34). |
| CONTIG4798 | 7781_f1_3 | 1413 | 15516 | 213 | 71 | Q92213 | 311 | 1.2(10)-26 | Candida albicans | phosphatidylinositol 3-kinase vps34 (ec 2.7.1.137) (pi3-kinase) (ptdins-3-kinase) (pi3k) (vacuolar sorting protein 34). |
| CONTIG4798 | 781567_f1_4 | 1414 | 15517 | 1602 | 534 | Q92213 | 2540 | 4.0(10)-264 | Candida albicans | phosphatidylinositol 3-kinase vps34 (ec 2.7.1.137) (pi3-kinase) (ptdins-3-kinase) (pi3k) (vacuolar sorting protein 34). |
| CONTIG3437 | 21522677_c2_9 | 1415 | 15518 | 1059 | 353 | Q92212 | 723 | 1.1(10)-70 | Candida albicans | serine/threonine-protein kinase cst20 (ec 2.7.1.-). |
| CONTIG3437 | 29472503_c1_7 | 1416 | 15519 | 1074 | 358 | Q92212 | 1097 | 3.3(10)-111 | Candida albicans | serine/threonine-protein kinase cst20 (ec 2.7.1.-). |
| CONTIG2686 | 23995392_c1_8 | 1417 | 15520 | 642 | 214 | Q12196 | 394 | 1.1(10)-36 | Saccharomyces cerevisiae | rio1 protein. |
| CONTIG3377 | 4865656_c3_8 | 1418 | 15521 | 1035 | 345 | Q03532 | 1457 | 2.3(10)-149 | Saccharomyces cerevisiae | putative atp-dependent rna helicase ymr290c. |
| CONTIG5814 | 23600407_f3_21 | 1419 | 15522 | 3813 | 1271 | Q04217 | 1924 | 1.1(10)-295 | Saccharomyces cerevisiae | putative atp-dependent rna helicase ymr128w. |
| CONTIG5735 | 26370160_f1_1 | 1420 | 15523 | 2232 | 744 | Q08162 | 2124 | 5.0(10)-220 | Saccharomyces cerevisiae | dis3 protein. |
| CONTIG5735 | 24629511_f2_5 | 1421 | 15524 | 915 | 305 | Q08162 | 1129 | 1.3(10)-114 | Saccharomyces cerevisiae | dis3 protein. |
| CONTIG5808 | 1990656_c3_38 | 1422 | 15525 | 1578 | 526 | Q03649 | 554 | 1.2(10)-53 | Saccharomyces cerevisiae | hypothetical 51.4 kd protein in rar1-scj1 intergenic region. |
| CONTIG2215 | 19814763_f2_1 | 1423 | 15526 | 468 | 156 | Q04958 | 485 | 7.4(10)-45 | Saccharomyces cerevisiae | hypothetical 187.1 kd protein in ogg1-cna2 intergenic region. |
| b3x17744.y | 954688_c1_2 | 1424 | 15527 | 444 | 148 | Q17308 | 109 | 5.0(10)-5 | Caenorhabditis briggsae | sex-determining transformer protein 1. |
| CONTIG5820 | 10158568_f2_30 | 1425 | 15528 | 321 | 107 | S15157 | 382 | 2.0(10)-35 | Saccharomyces sp. | ubiquinol--cytochrome-c reductase (ec 1.10.2.2) cytochrome b- yeast (saccharomyces sp.) mitochondrion (strain 4707-22d)(sgc2) |
| CONTIG5232 | 34380_c3_15 | 1426 | 15529 | 693 | 231 | A27331 | 794 | 4.2(10)-79 | Candida tropicalis | acyl-coa oxidase (ec 1.3.3.6) pxp2, peroxisomal - yeast(candida |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x16736.y | 23517882_c2_2 | 1427 | 15530 | 561 | 187 | A25123 | 691 | 3.6(10)-68 | *Candida tropicalis* | *tropicalis*) this enzyme, located in peroxisomes, catalyzes the oxygen-specific oxidation of long-chain (8 and up) acyl-coa to trans-2, 3-dehydroacyl-coa with oxygen being converted to hydrog acyl-coa oxidase (ec 1.3.3.6) pox4, peroxisomal - yeast(*candida tropicalis*) this enzyme, located in peroxisomes, catalyzes the oxygen-specific oxidation of long-chain (8 and up) acyl-coa to trans-2, 3-dehydroacyl-coa with oxygen being converted to hydrog |
| CONTIG5453 | 10970285_f3_16 | 1428 | 15531 | 1998 | 666 | B25123 | 2996 | 0 | *Candida tropicalis* | acyl-coa oxidase (ec 1.3.3.6) pox5, peroxisomal - yeast(*candida tropicalis*) this enzyme, located in peroxisomes, catalyzes the oxygen-specific oxidation of long-chain (8 and up) acyl-coa to trans-2, 3-dehydroacyl-coa with oxygen being converted to hydrog |
| CONTIG5656 | 21489635_c3_30 | 1429 | 15532 | 237 | 79 | A35427 | 111 | 1.2(10)-5 | *Oryctolagus cuniculus* | dimethylaniline monooxygenase (n-oxide-forming) (ec 1.14.13.8), hepatic 1 - rabbit this enzyme is involved in the metabolism of many drugs, pesticides, and other foreign compounds, including xenobiotics, by catalyzing the nadph-dependent oxidation of vari |
| CONTIG781 | 24641317_c1_4 | 1430 | 15533 | 918 | 306 | S43743 | 1276 | 3.6(10)-130 | *Candida albicans* | probable dual specificity phosphatase (ec 3.1.3.-) - yeast(*candida albicans*) this enzyme interferes with the s. cerevisiae pheromone response pathway. |
| CONTIG5585 | 26361557_f3_9 | 1431 | 15534 | 912 | 304 | A03324 | 509 | 1.5(10)-47 | *Drosophila melanogaster* | retrovirus-related polyprotein - fruit fly (drosophilamelanogaster) transposon copia |
| CONTIG2913 | 24110931_f1_3 | 1432 | 15535 | 1014 | 338 | A26896 | 93 | 0.22 | Human parainfluenza virus 3 | polymerase-associated nucleocapsid phosphoprotein (version 2) - parainfluenza virus type 3 the rna sequence was obtained from genbank, release 52.0. this protein may be a component of the active polymerase. |
| CONTIG5766 | 20517561_c1_24 | 1433 | 15536 | 462 | 154 | B40576 | 694 | 1.7(10)-68 | *Candida maltosa* | cytochrome p450 alk3-a - yeast (*candida maltosa*) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5766 | 503885_c2_30 | 1434 | 15537 | 1647 | 549 | A40576 | 2161 | 6.0(10)-224 | Candida maltosa | cytochrome p450 a1k2-a - yeast (candida maltosa) |
| CONTIG5783 | 7265957_c2_37 | 1435 | 15538 | 672 | 224 | JS0726 | 914 | 8.3(10)-92 | Candida maltosa | cytochrome p450 alk8, alkane-inducible - yeast (candida maltosa) |
| CONTIG5783 | 2925050_c1_28 | 1436 | 15539 | 948 | 316 | JS0726 | 1058 | 4.5(10)-107 | Candida maltosa | cytochrome p450 alk8, alkane-inducible - yeast (candida maltosa) |
| CONTIG5695 | 37577_f2_3 | 1437 | 15540 | 1524 | 508 | JS0724 | 1563 | 1.3(10)-160 | Candida maltosa | cytochrome p450 alk6-a, alkane-inducible - yeast (candida maltosa) |
| CONTIG5471 | 34098453_f1_1 | 1438 | 15541 | 1710 | 570 | A45249 | 2900 | 2.8(10)-302 | Candida albicans | alpha-glucosidase (ec 3.2.1.20) mal62 - yeast (candida albicans) |
| CONTIG5820 | 134635_c3_89 | 1439 | 15542 | 270 | 90 | S44135 | 235 | 7.5(10)-20 | Candida parapsilosis | h+transporting ap synthase (ec 3.6.1.34) protein 9 - yeast(candida parapsilosis) mitochondrion (sgc3) |
| CONTIG3842 | 10660005_c3_15 | 1440 | 15543 | 348 | 116 | S61168 | 344 | 2.1(10)-31 | Saccharomyces cerevisiae | hypothetical protein ydr373w - yeast (saccharomyces cerevisiae) |
| CONTIG3996 | 21953160_f1_1 | 1441 | 15544 | 915 | 305 | S61979 | 673 | 2.8(10)-66 | Saccharomyces cerevisiae | probable membrane protein yp1087w - yeast (saccharomyces cerevisiae) |
| CONTIG4146 | 34665932_c1_6 | 1442 | 15545 | 471 | 157 | S30284 | 104 | 0.0008 | Streptococcus pyogenes | m protein precursor - streptococcus pyogenes (serotype m52) |
| CONTIG5460 | 35189205_f1_7 | 1443 | 15546 | 894 | 298 | S21347 | 167 | 6.5(10)-10 | Rattus norvegicus | hypothetical protein 3 - rat |
| CONTIG5712 | 33610776_c1_18 | 1444 | 15547 | 2715 | 905 | S21347 | 447 | 2.1(10)-41 | Rattus norvegicus | hypothetical protein 3 - rat |
| CONTIG142 | 1298937_f3_2 | 1445 | 15548 | 462 | 154 | S12588 | 178 | 4.0(10)-13 | Mink cell focus-forming virus | pol polyprotein - mink cell focus-forming virus (fragment) |
| CONTIG5820 | 1459800_f3_48 | 1446 | 15549 | 411 | 137 | S23209 | 181 | 3.2(10)-13 | Saccharomyces sp. | mrna maturase bi3 - yeast (saccharomyces sp.) mitochondrion(strain 4707-22d) (sgc2) |
| CONTIG1281 | 35823958_f3_1 | 1447 | 15550 | 636 | 212 | S42250 | 90 | 0.031 | Fowlpox virus | hypothetical protein 4 - fowlpox virus |
| CONTIG3723 | 16501550_f2_2 | 1448 | 15551 | 903 | 301 | A56976 | 95 | 0.12 | Staphylococcus aureus | transfer complex protein trsi - staphylococcus aureus |
| CONTIG5469 | 34187550_f3_6 | 1449 | 15552 | 1143 | 381 | JC6009 | 116 | 0.0019 | Mycoplasma hominis | surface-located membrane protein lmp3 - mycoplasma hominis(sgc3) |
| CONTIG4741 | 24094125_f2_2 | 1450 | 15553 | 570 | 190 | S31142 | 90 | 0.078 | Mycoplasma pulmonis | probable transposase (insertion sequence is1138) - mycoplasma pulmonis (sgc3) |
| CONTIG3041 | 10680381_c2_6 | 1451 | 15554 | 198 | 66 | S54738 | 95 | 7.7(10)-5 | Desulfurococcus mobilis | hypothetical protein c179 - desulfurococcus mobilis |
| CONTIG5254 | 24303151_f3_9 | 1452 | 15555 | 552 | 184 | S54738 | 224 | 1.1(10)-18 | Desulfurococcus mobilis | hypothetical protein c179 - desulfurococcus mobilis |
| CONTIG5539 | 10680381_c2_14 | 1453 | 15556 | 198 | 66 | S54738 | 95 | 7.7(10)-5 | Desulfurococcus mobilis | hypothetical protein c179 - desulfurococcus mobilis |
| CONTIG4740 | 16878533_f2_3 | 1454 | 15557 | 630 | 210 | S04714 | 124 | 4.2(10)-8 | Sulfolobus acidocaldarius | hypothetical protein end - sulfolobus acidocaldarius (fragment) |
| CONTIG5204 | 29423756_f1_1 | 1455 | 15558 | 336 | 112 | S59860 | 151 | 3.2(10)-10 | Sulfolobus | hypothetical protein - sulfolobus |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5351 | 4876557_f2_4 | 1456 | 15559 | 1011 | 337 | S42651 | 284 | 4.7(10)-25 | shibatae | hypothetical protein - rape shibatae |
| CONTIG5543 | 14978380_c2_15 | 1457 | 15560 | 1596 | 532 | S20500 | 109 | 0.0025 | Brassica napus | hydroxyproline-rich glycoprotein - rice |
| CONTIG5341 | 22831438_f3_13 | 1458 | 15561 | 801 | 267 | S52645 | 123 | 2.7(10)-5 | Oryza sativa | probable 1-acyl-glycerol-3-phosphate acyltransferase - maize |
| CONTIG5270 | 4725035_c2_11 | 1459 | 15562 | 753 | 251 | S28720 | 94 | 0.027 | Zea mays | gene d-4 protein - slime mold (dictyostelium discoideum)plasmid ddp1 |
| CONTIG4720 | 156505_c1_7 | 1460 | 15563 | 468 | 156 | S55723 | 217 | 6.0(10)-18 | Dictyostelium discoideum | pac2 protein - fission yeast (schizosaccharomyces pombe) |
| CONTIG5619 | 22033952_f3_13 | 1461 | 15564 | 987 | 329 | S52837 | 92 | 0.17 | Schizosaccharomyces pombe | sll1 protein - fission yeast (schizosaccharomyces pombe) |
| CONTIG5263 | 14448063_c1_11 | 1462 | 15565 | 762 | 254 | S63669 | 757 | 4.5(10)-74 | Schizosaccharomyces pombe | udpglucose--glycoprotein glucosephosphotransferase (ec 2.7.8.19) - fission yeast (schizosaccharomyces pombe) |
| CONTIG5545 | 29329557_c1_13 | 1463 | 15566 | 2550 | 850 | S30356 | 3985 | 0 | Candida albicans | cdc25 protein homolog - yeast (candida albicans) |
| CONTIG670 | 35198453_f2_1 | 1464 | 15567 | 1206 | 402 | S30356 | 1855 | 1.6(10)-191 | Candida albicans | cdc25 protein homolog - yeast (candida albicans) |
| CONTIG2208 | 3953436_f1_2 | 1465 | 15568 | 747 | 249 | S43279 | 1075 | 7.2(10)-109 | Candida albicans | cell division control protein cdc3 - yeast (candida albicans) |
| CONTIG5534 | 25485782_c2_8 | 1466 | 15569 | 363 | 121 | A47259 | 650 | 7.9(10)-64 | Candida albicans | corticosteroid-binding protein - yeast (candida albicans) |
| CONTIG5190 | 3913400_f3_4 | 1467 | 15570 | 1521 | 507 | JC4828 | 2033 | 2.2(10)-210 | Candida albicans | cyclin b - yeast (candida albicans) |
| CONTIG4973 | 4334425_c1_4 | 1468 | 15571 | 1407 | 469 | S51613 | 2115 | 4.5(10)-219 | Candida albicans | cyclin homolog cln2 - yeast (candida albicans) |
| CONTIG3138 | 4025277_f3_6 | 1469 | 15572 | 651 | 217 | A36990 | 1048 | 5.2(10)-106 | Candida albicans | estrogen-binding protein - yeast (candida albicans) |
| CONTIG4960 | 19718792_c2_8 | 1470 | 15573 | 1245 | 415 | A36990 | 1689 | 6.2(10)-174 | Candida albicans | estrogen-binding protein - yeast (candida albicans) |
| CONTIG5794 | 7082041_c1_24 | 1471 | 15574 | 924 | 308 | S27407 | 808 | 1.3(10)-80 | Candida albicans | finger protein znf1 - yeast (candida albicans) |
| CONTIG3328 | 22445176_c2_3 | 1472 | 15575 | 2082 | 694 | S49206 | 2457 | 2.6(10)-255 | Candida albicans | g1 cyclin cln1 - yeast (candida albicans) |
| CONTIG5727 | 9932660_f3_16 | 1473 | 15576 | 1305 | 435 | A44384 | 2054 | 1.3(10)-212 | Candida albicans | gtp-binding regulatory protein g alpha chain cag1 - yeast(candida albicans) |
| CONTIG1662 | 4884377_c2_4 | 1474 | 15577 | 948 | 316 | S58135 | 1139 | 1.2(10)-115 | Candida albicans | hyphally regulated protein - yeast (candida albicans) |
| CONTIG4906 | 30344703_c3_9 | 1475 | 15578 | 1986 | 662 | S58135 | 681 | 4.0(10)-67 | Candida albicans | hyphally regulated protein - yeast (candida albicans) |
| CONTIG4971 | 22070427_f2_1 | 1476 | 15579 | 2934 | 978 | S58135 | 646 | 1.6(10)-73 | Candida albicans | hyphally regulated protein - yeast (candida albicans) |
| CONTIG5290 | 1208437_c2_13 | 1477 | 15580 | 882 | 294 | S58135 | 541 | 1.7(10)-51 | Candida albicans | hyphally regulated protein - yeast (candida albicans) |
| CONTIG2790 | 32281575_c2_6 | 1478 | 15581 | 294 | 98 | JC6013 | 299 | 1.2(10)-26 | Candida albicans | hypothetical k protein - yeast |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4345 | 21579430_f2_4 | 1479 | 15582 | 594 | 198 | S43029 | 97 | 3.7(10)-5 | *Candida albicans* | hypothetical protein 1 - yeast (*candida albicans*) |
| CONTIG5725 | 35586038_f2_6 | 1480 | 15583 | 393 | 131 | S43029 | 197 | 7.9(10)-16 | *Candida albicans* | hypothetical protein 1 - yeast (*candida albicans*) |
| CONTIG4283 | 2787552_c1_4 | 1481 | 15584 | 237 | 79 | S43030 | 170 | 5.7(10)-13 | *Candida albicans* | hypothetical protein 2 - yeast (*candida albicans*) |
| CONTIG5746 | 2787552_f3_11 | 1482 | 15585 | 345 | 115 | S43030 | 241 | 1.7(10)-20 | *Candida albicans* | hypothetical protein 2 - yeast (*candida albicans*) |
| CONTIG4222 | 5078186_c1_11 | 1483 | 15586 | 1215 | 405 | A55588 | 2146 | 2.2(10)-222 | *Candida albicans* | mannosyl-glycoprotein endo-beta-n-acetylglucosaminidase (ec 3.2.1.96) precursor - yeast (*candida albicans*) |
| CONTIG5500 | 10976437_c2_14 | 1484 | 15587 | 999 | 333 | A43302 | 1662 | 4.5(10)-171 | *Candida albicans* | probable finger protein casuc1 - yeast (*candida albicans*) |
| CONTIG5441 | 23682638_c1_11 | 1485 | 15588 | 2577 | 859 | S47220 | 3680 | 0 | *Candida albicans* | protein kinase c - yeast (*candida albicans*) |
| CONTIG104 | 23719051_c3_2 | 1486 | 15589 | 273 | 91 | JN0320 | 357 | 8.8(10)-33 | *Candida albicans* | rapamycin-binding protein - yeast (*candida albicans*) this protein possesses peptidyl-prolyl cis-trans isomerase activity which is inhibited by the binding of rapamycin. |
| CONTIG1295 | 10975877_c3_5 | 1487 | 15590 | 381 | 127 | JN0320 | 578 | 3.3(10)-56 | *Candida albicans* | rapamycin-binding protein - yeast (*candida albicans*) this protein possesses peptidyl-prolyl cis-trans isomerase activity which is inhibited by the binding of rapamycin. |
| CONTIG5203 | 13703132_f1_1 | 1488 | 15591 | 1401 | 467 | S37606 | 2146 | 2.2(10)-222 | *Candida albicans* | sec18 protein - yeast (*candida albicans*) |
| CONTIG1225 | 478207_f3_3 | 1489 | 15592 | 1041 | 347 | S60154 | 956 | 3.0(10)-96 | *Candida albicans* | serine/threonine-specific kinase (ec 2.7.1.-) isoform hst7-q- yeast (*candida albicans*) |
| CONTIG5448 | 23492064_c1_11 | 1490 | 15593 | 459 | 153 | B48329 | 133 | 4.7(10)-9 | *Candida maltosa* | hypothetical protein (c-his5 3 region) - yeast (*candida maltosa*) (fragment) |
| CONTIG4988 | 10975882_f2_2 | 1491 | 15594 | 390 | 130 | JS0155 | 566 | 6.2(10)-55 | *Candida tropicalis* | pox18 protein - yeast (*candida tropicalis*) this protein is one of the oleate-inducible peroxisomal proteins. peroxisomes purified from oleate-grown cells contain approx. 20 proteins. this protein is the smallest among them. |
| CONTIG5820 | 390933_f2_24 | 1492 | 15595 | 486 | 162 | S17996 | 358 | 1.7(10)-32 | *Kluyveromyces lactis* | gene cox1 intron 2 protein - yeast (*kluyveromyces marxianusvar. lactis*) mitochondrion (sgc2) |
| CONTIG5820 | 894800_f1_12 | 1493 | 15596 | 186 | 62 | S17998 | 120 | 2.1(10)-6 | *Kluyveromyces lactis* | gene cox1 intron 4 protein - yeast (*kluyveromyces marxianusvar. lactis*) mitochondrion (sgc2) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3252 | 1412528_f2_2 | 1494 | 15597 | 846 | 282 | S67800 | 513 | 2.6(10)-49 | Saccharomyces cerevisiae | 4-nitrophenylphosphatase (ec 3.1.3.41) - yeast (saccharomyces cerevisiae) the activity of this enzyme is enhanced by mg2+ ion but inhibited by ca2+, zn2+ and be2+ ions. |
| CONTIG4732 | 4023307_f3_8 | 1495 | 15598 | 567 | 189 | S59317 | 500 | 4.9(10)-47 | Saccharomyces cerevisiae | dip2 protein - yeast (saccharomyces cerevisiae) |
| CONTIG4732 | 10743813_f1_4 | 1496 | 15599 | 1464 | 488 | S59317 | 951 | 1.0(10)-95 | Saccharomyces cerevisiae | dip2 protein - yeast (saccharomyces cerevisiae) |
| CONTIG1025 | 2535306_f2_1 | 1497 | 15600 | 705 | 235 | S31848 | 279 | 1.6(10)-24 | Saccharomyces cerevisiae | heat shock protein hsp30 - yeast (saccharomyces cerevisiae) |
| CONTIG5756 | 1354707_f1_5 | 1498 | 15601 | 1263 | 421 | S49776 | 108 | 0.0037 | Saccharomyces cerevisiae | hypothetical protein (sdh4 3 region) - yeast (saccharomyces cerevisiae) (fragment) |
| CONTIG5756 | 24619052_f3_12 | 1499 | 15602 | 546 | 182 | S61567 | 291 | 8.6(10)-26 | Saccharomyces cerevisiae | hypothetical protein yd8142a.01 - yeast (saccharomyces cerevisiae) (fragment) |
| CONTIG5756 | 32069076_f1_7 | 1500 | 15603 | 492 | 164 | S61567 | 425 | 5.5(10)-40 | Saccharomyces cerevisiae | hypothetical protein yd8142a.01 - yeast (saccharomyces cerevisiae) (fragment) |
| CONTIG2258 | 15891442_f2_1 | 1501 | 15604 | 1107 | 369 | S67592 | 163 | 1.3(10)-9 | Saccharomyces cerevisiae | hypothetical protein ydl057w - yeast (saccharomyces cerevisiae) |
| CONTIG5271 | 23962782_f2_1 | 1502 | 15605 | 2529 | 843 | S67595 | 955 | 1.7(10)-143 | Saccharomyces cerevisiae | hypothetical protein ydl060w - yeast (saccharomyces cerevisiae) |
| CONTIG3376 | 26567127_c3_5 | 1503 | 15606 | 690 | 230 | S67612 | 163 | 6.2(10)-11 | Saccharomyces cerevisiae | hypothetical protein ydl076c - yeast (saccharomyces cerevisiae) |
| CONTIG3267 | 24240803_f1_1 | 1504 | 15607 | 384 | 128 | S67622 | 429 | 2.1(10)-40 | Saccharomyces cerevisiae | hypothetical protein ydl086w - yeast (saccharomyces cerevisiae) |
| CONTIG1281 | 13675000_f3_3 | 1505 | 15608 | 456 | 152 | S67623 | 281 | 1.0(10)-24 | Saccharomyces cerevisiae | hypothetical protein ydl087c - yeast (saccharomyces cerevisiae) |
| CONTIG541 | 4885325_c2_2 | 1506 | 15609 | 504 | 168 | S67639 | 484 | 3.1(10)-46 | Saccharomyces cerevisiae | hypothetical protein ydl097c - yeast (saccharomyces cerevisiae) |
| CONTIG3360 | 26069452_f2_3 | 1507 | 15610 | 732 | 244 | S67640 | 117 | 1.0(10)-5 | Saccharomyces cerevisiae | hypothetical protein ydl098c - yeast (saccharomyces cerevisiae) |
| CONTIG4511 | 828403_f1_1 | 1508 | 15611 | 1251 | 417 | S67658 | 111 | 4.2(10)-11 | Saccharomyces cerevisiae | hypothetical protein ydl115c - yeast (saccharomyces cerevisiae) |
| CONTIG3814 | 11047182_f2_2 | 1509 | 15612 | 2301 | 767 | S67660 | 653 | 1.8(10)-70 | Saccharomyces cerevisiae | hypothetical protein ydl117w - yeast (saccharomyces cerevisiae) |
| CONTIG1335 | 2822180_c1_3 | 1510 | 15613 | 861 | 287 | S67662 | 257 | 1.8(10)-36 | Saccharomyces cerevisiae | hypothetical protein ydl119c - yeast (saccharomyces cerevisiae) |
| CONTIG2522 | 23548786_f1_1 | 1511 | 15614 | 582 | 194 | S67663 | 227 | 5.2(10)-19 | Saccharomyces cerevisiae | hypothetical protein ydl120w - yeast (saccharomyces cerevisiae) |
| CONTIG5132 | 23626552_f3_7 | 1512 | 15615 | 1992 | 664 | S67685 | 106 | 0.00419 | Saccharomyces cerevisiae | hypothetical protein ydl139c - yeast (saccharomyces cerevisiae) |
| CONTIG5798 | 23914693_f1_8 | 1513 | 15616 | 1590 | 530 | S67695 | 844 | 2.2(10)-84 | Saccharomyces cerevisiae | hypothetical protein ydl147w - yeast (saccharomyces cerevisiae) |
| CONTIG3001 | 24402261_c2_6 | 1514 | 15617 | 210 | 70 | S67704 | 117 | 2.6(10)-6 | Saccharomyces cerevisiae | hypothetical protein ydl156w - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG366 | 650760_f1_1 | 1515 | 15618 | 528 | 176 | S67704 | 244 | 4.7(10)-20 | Saccharomyces cerevisiae | yeast (saccharomyces cerevisiae) hypothetical protein ydl156w- cerevisiae |
| CONTIG2209 | 972507_f3_2 | 1516 | 15619 | 321 | 107 | S61056 | 116 | 3.0(10)-7 | Saccharomyces cerevisiae | hypothetical protein ydl157c- cerevisiae |
| CONTIG5437 | 15678552_f2_5 | 1517 | 15620 | 282 | 94 | S61047 | 97 | 6.0(10)-5 | Saccharomyces cerevisiae | yeast (saccharomyces cerevisiae) hypothetical protein ydl166c - |
| CONTIG5437 | 10347000_f3_9 | 1518 | 15621 | 660 | 220 | S61047 | 377 | 6.7(10)-35 | Saccharomyces cerevisiae | yeast (saccharomyces cerevisiae) hypothetical protein ydl166c - |
| CONTIG4210 | 2115886_c2_9 | 1519 | 15622 | 426 | 142 | S61039 | 122 | 2.7(10)-7 | Saccharomyces cerevisiae | yeast (saccharomyces cerevisiae) hypothetical protein ydl173w - |
| CONTIG5130 | 12705287_c1_9 | 1520 | 15623 | 615 | 205 | S61037 | 404 | 9.1(10)-38 | Saccharomyces cerevisiae | yeast (saccharomyces cerevisiae) hypothetical protein ydl175c - |
| CONTIG4319 | 4812568_c3_10 | 1521 | 15624 | 1242 | 414 | S67744 | 115 | 5.4(10)-5 | Saccharomyces cerevisiae | yeast (saccharomyces cerevisiae) hypothetical protein ydl189w - |
| CONTIG5163 | 24413505_f3_3 | 1522 | 15625 | 1113 | 371 | S67760 | 768 | 2.5(10)-76 | Saccharomyces cerevisiae | yeast (saccharomyces cerevisiae) hypothetical protein ydl201w - |
| CONTIG5681 | 22069692_f1_3 | 1523 | 15626 | 804 | 268 | S67772 | 225 | 8.5(10)-19 | Saccharomyces cerevisiae | yeast (saccharomyces cerevisiae) hypothetical protein ydl213c - |
| CONTIG1456 | 26343811_f3_2 | 1524 | 15627 | 231 | 77 | S50994 | 262 | 1.0(10)-22 | Saccharomyces cerevisiae | yeast (saccharomyces cerevisiae) hypothetical protein ydr013w - |
| CONTIG5565 | 24266882_f2_11 | 1525 | 15628 | 525 | 175 | S54639 | 140 | 8.6(10)-10 | Saccharomyces cerevisiae | yeast (saccharomyces cerevisiae) hypothetical protein ydr016c - |
| CONTIG5040 | 19703382_f3_7 | 1526 | 15629 | 345 | 115 | S67845 | 180 | 5.0(10)-14 | Saccharomyces cerevisiae | yeast (saccharomyces cerevisiae) hypothetical protein ydr031w - |
| CONTIG1950 | 5329400_c3_2 | 1527 | 15630 | 525 | 175 | S54036 | 301 | 7.5(10)-27 | Saccharomyces cerevisiae | yeast (saccharomyces cerevisiae) hypothetical protein ydr051c - |
| CONTIG3403 | 4800788_c1_5 | 1528 | 15631 | 798 | 266 | S58837 | 152 | 2.1(10)-8 | Saccharomyces cerevisiae | yeast (saccharomyces cerevisiae) hypothetical protein ydr057w - |
| CONTIG5806 | 29960017_f2_13 | 1529 | 15632 | 372 | 124 | S54047 | 143 | 4.2(10)-10 | Saccharomyces cerevisiae | yeast (saccharomyces cerevisiae) hypothetical protein ydr063w - |
| CONTIG5118 | 14254175_f3_4 | 1530 | 15633 | 612 | 204 | S49826 | 274 | 5.5(10)-24 | Saccharomyces cerevisiae | yeast (saccharomyces cerevisiae) hypothetical protein ydr071c - |
| CONTIG113 | 11757800_f3_1 | 1531 | 15634 | 570 | 190 | S52682 | 101 | 0.00044 | Saccharomyces cerevisiae | yeast (saccharomyces cerevisiae) hypothetical protein ydr117c - |
| CONTIG1796 | 11754562_c1_5 | 1532 | 15635 | 486 | 162 | S52682 | 232 | 1.2(10)-18 | Saccharomyces cerevisiae | yeast (saccharomyces cerevisiae) hypothetical protein ydr117c - |
| CONTIG3998 | 46051031_f2_2 | 1533 | 15636 | 900 | 300 | S52682 | 254 | 8.1(10)-34 | Saccharomyces cerevisiae | yeast (saccharomyces cerevisiae) hypothetical protein ydr117c - |
| CONTIG5814 | 4798188_f3_19 | 1534 | 15637 | 330 | 110 | S52686 | 222 | 1.8(10)-18 | Saccharomyces cerevisiae | yeast (saccharomyces cerevisiae) hypothetical protein ydr121w - |
| CONTIG5787 | 23726576_c2_30 | 1535 | 15638 | 1341 | 447 | S52689 | 207 | 8.6(10)-15 | Saccharomyces cerevisiae | yeast (saccharomyces cerevisiae) hypothetical protein ydr124w - |
| CONTIG5778 | 785932_c1_22 | 1536 | 15639 | 453 | 151 | S52690 | 155 | 1.6(10)-10 | Saccharomyces cerevisiae | yeast (saccharomyces cerevisiae) hypothetical protein ydr125c - |
| CONTIG5778 | 4037512_c3_30 | 1537 | 15640 | 1176 | 392 | S52690 | 206 | 5.0(10)-14 | Saccharomyces cerevisiae | yeast (saccharomyces cerevisiae) hypothetical protein ydr125c - |
| CONTIG2385 | 30504689_c2_4 | 1538 | 15641 | 444 | 148 | S52690 | 141 | 5.2(10)-9 | Saccharomyces cerevisiae | yeast (saccharomyces cerevisiae) hypothetical protein ydr125c - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3719 | 35196911_f2_2 | 1539 | 15642 | 2679 | 893 | S51855 | 397 | 2.1(10)-62 | Saccharomyces cerevisiae | hypothetical protein ydr128w - yeast (saccharomyces cerevisiae) |
| CONTIG5784 | 1038187_c3_21 | 1540 | 15643 | 1131 | 377 | S51855 | 148 | 2.5(10)-15 | Saccharomyces cerevisiae | hypothetical protein ydr128w - yeast (saccharomyces cerevisiae) |
| CONTIG1982 | 199155_f2_1 | 1541 | 15644 | 1359 | 453 | S51859 | 359 | 5.2(10)-37 | Saccharomyces cerevisiae | hypothetical protein ydr132c - yeast (saccharomyces cerevisiae) |
| CONTIG4661 | 287_c3_5 | 1542 | 15645 | 723 | 241 | S51868 | 599 | 2.0(10)-58 | Saccharomyces cerevisiae | hypothetical protein ydr140w - yeast (saccharomyces cerevisiae) |
| CONTIG3367 | 267067_f2_4 | 1543 | 15646 | 588 | 196 | S57978 | 198 | 6.2(10)-16 | Saccharomyces cerevisiae | hypothetical protein ydr152w - yeast (saccharomyces cerevisiae) |
| CONTIG2706 | 173135_c1_3 | 1544 | 15647 | 330 | 110 | S57987 | 103 | 7.5(10)-6 | Saccharomyces cerevisiae | hypothetical protein ydr163w - yeast (saccharomyces cerevisiae) |
| CONTIG4745 | 5195930_f3_4 | 1545 | 15648 | 942 | 314 | S49771 | 440 | 1.3(10)-41 | Saccharomyces cerevisiae | hypothetical protein ydr175c - yeast (saccharomyces cerevisiae) |
| CONTIG5676 | 15663382_f1_5 | 1546 | 15649 | 690 | 230 | S49778 | 142 | 4.2(10)-8 | Saccharomyces cerevisiae | hypothetical protein ydr181c - yeast (saccharomyces cerevisiae) |
| CONTIG829 | 961017_c2_4 | 1547 | 15650 | 420 | 140 | S49781 | 98 | 0.00012 | Saccharomyces cerevisiae | hypothetical protein ydr184c - yeast (saccharomyces cerevisiae) |
| CONTIG5794 | 22712807_f1_6 | 1548 | 15651 | 918 | 306 | S52698 | 1331 | 5.4(10)-136 | Saccharomyces cerevisiae | hypothetical protein ydr190c - yeast (saccharomyces cerevisiae) |
| CONTIG5794 | 1182807_f2_10 | 1549 | 15652 | 531 | 177 | S52698 | 509 | 6.9(10)-49 | Saccharomyces cerevisiae | hypothetical protein ydr190c - yeast (saccharomyces cerevisiae) |
| CONTIG5476 | 29346963_f1_1 | 1550 | 15653 | 1164 | 388 | S52708 | 295 | 3.2(10)-26 | Saccharomyces cerevisiae | hypothetical protein ydr202c - yeast (saccharomyces cerevisiae) |
| CONTIG5458 | 1644162_f1_2 | 1551 | 15654 | 1053 | 351 | S61581 | 618 | 1.8(10)-60 | Saccharomyces cerevisiae | hypothetical protein ydr214w - yeast (saccharomyces cerevisiae) |
| CONTIG5400 | 13848962_c1_8 | 1552 | 15655 | 1215 | 405 | S54531 | 391 | 2.2(10)-36 | Saccharomyces cerevisiae | hypothetical protein ydr235w - yeast (saccharomyces cerevisiae) |
| CONTIG5146 | 14540957_f1_4 | 1553 | 15656 | 882 | 294 | S70126 | 492 | 4.4(10)-47 | Saccharomyces cerevisiae | hypothetical protein ydr266c - yeast (saccharomyces cerevisiae) |
| CONTIG1324 | 26803465_c1_4 | 1554 | 15657 | 669 | 223 | S70127 | 338 | 9.0(10)-31 | Saccharomyces cerevisiae | hypothetical protein ydr267c - yeast (saccharomyces cerevisiae) |
| CONTIG5232 | 12538182_f2_5 | 1555 | 15658 | 219 | 73 | S70224 | 154 | 2.8(10)-11 | Saccharomyces cerevisiae | hypothetical protein ydr276c - yeast (saccharomyces cerevisiae) |
| CONTIG3858 | 12500061_c1_4 | 1556 | 15659 | 681 | 227 | S70138 | 447 | 2.6(10)-42 | Saccharomyces cerevisiae | hypothetical protein ydr282c - yeast (saccharomyces cerevisiae) |
| CONTIG2423 | 3022217_c2_5 | 1557 | 15660 | 732 | 244 | S70114 | 458 | 1.7(10)-43 | Saccharomyces cerevisiae | hypothetical protein ydr284c - yeast (saccharomyces cerevisiae) |
| CONTIG3184 | 4500007_c2_7 | 1558 | 15661 | 891 | 297 | S70114 | 397 | 5.0(10)-37 | Saccharomyces cerevisiae | hypothetical protein ydr284c - yeast (saccharomyces cerevisiae) |
| CONTIG5351 | 21671882_c2_10 | 1559 | 15662 | 387 | 129 | S70116 | 175 | 1.7(10)-13 | Saccharomyces cerevisiae | hypothetical protein ydr286c - yeast (saccharomyces cerevisiae) |
| CONTIG4041 | 24485875_f3_3 | 1560 | 15663 | 1137 | 379 | S70118 | 108 | 0.00169 | Saccharomyces cerevisiae | hypothetical protein ydr288w - yeast (saccharomyces cerevisiae) |
| CONTIG5343 | 23602342_c2_17 | 1561 | 15664 | 1086 | 362 | S70119 | 257 | 6.2(10)-22 | Saccharomyces cerevisiae | hypothetical protein ydr289c - yeast (saccharomyces cerevisiae) |
| CONTIG3679 | 26260462_f1_1 | 1562 | 15665 | 480 | 160 | S70120 | 359 | 9.5(10)-32 | Saccharomyces cerevisiae | hypothetical protein ydr291w - yeast (saccharomyces cerevisiae) |
| CONTIG1487 | 3942512_c1_6 | 1563 | 15666 | 534 | 178 | S61181 | 104 | 9.0(10)-5 | Saccharomyces cerevisiae | hypothetical protein ydr295c - yeast (saccharomyces cerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4990 | 24015882_c2_11 | 1564 | 15667 | 564 | 188 | S61182 | 382 | 2.0(10)-35 | Saccharomyces cerevisiae | yeast (saccharomyces cerevisiae) hypothetical protein ydr296w - |
| CONTIG1445 | 24507042_c1_3 | 1565 | 15668 | 840 | 280 | S61185 | 331 | 7.4(10)-52 | Saccharomyces cerevisiae | yeast (saccharomyces cerevisiae) hypothetical protein ydr299w - |
| CONTIG1212 | 5112843_c1_3 | 1566 | 15669 | 678 | 226 | S61185 | 204 | 4.5(10)-22 | Saccharomyces cerevisiae | yeast (saccharomyces cerevisiae) hypothetical protein ydr299w - |
| CONTIG5732 | 391961_c1_27 | 1567 | 15670 | 1389 | 463 | S61192 | 735 | 4.2(10)-79 | Saccharomyces cerevisiae | yeast (saccharomyces cerevisiae) hypothetical protein ydr306c - |
| CONTIG4909 | 16664627_c3_9 | 1568 | 15671 | 807 | 269 | S61199 | 173 | 4.2(10)-13 | Saccharomyces cerevisiae | yeast (saccharomyces cerevisiae) hypothetical protein ydr313c - |
| b9x13c01.x | 25595263_c3_2 | 1569 | 15672 | 678 | 226 | S59784 | 99 | 0.0051 | Saccharomyces cerevisiae | yeast (saccharomyces cerevisiae) hypothetical protein ydr318w - |
| CONTIG5614 | 273552_c2_20 | 1570 | 15673 | 1470 | 490 | S59786 | 121 | 0.00027 | Saccharomyces cerevisiae | yeast (saccharomyces cerevisiae) hypothetical protein ydr320c - |
| CONTIG5215 | 29486627_c2_11 | 1571 | 15674 | 957 | 319 | S59788 | 414 | 8.0(10)-39 | Saccharomyces cerevisiae | yeast (saccharomyces cerevisiae) hypothetical protein ydr322w - |
| CONTIG2732 | 12933333_f1_1 | 1572 | 15675 | 615 | 205 | S59790 | 201 | 4.5(10)-15 | Saccharomyces cerevisiae | yeast (saccharomyces cerevisiae) hypothetical protein ydr324c - |
| CONTIG3381 | 157691_c2_3 | 1573 | 15676 | 612 | 204 | S59790 | 478 | 5.0(10)-45 | Saccharomyces cerevisiae | yeast (saccharomyces cerevisiae) hypothetical protein ydr324c - |
| b3x12311.y | 477291_f3_1 | 1574 | 15677 | 558 | 186 | S59790 | 508 | 2.2(10)-48 | Saccharomyces cerevisiae | yeast (saccharomyces cerevisiae) hypothetical protein ydr324c - |
| CONTIG4570 | 14534653_c2_8 | 1575 | 15678 | 366 | 122 | S59795 | 149 | 8.6(10)-10 | Saccharomyces cerevisiae | yeast (saccharomyces cerevisiae) hypothetical protein ydr330w - |
| CONTIG4570 | 22067152_c3_10 | 1576 | 15679 | 990 | 330 | S59795 | 488 | 1.2(10)-46 | Saccharomyces cerevisiae | yeast (saccharomyces cerevisiae) hypothetical protein ydr330w - |
| CONTIG1423 | 24300265_c3_2 | 1577 | 15680 | 789 | 263 | S59797 | 446 | 8.1(10)-42 | Saccharomyces cerevisiae | yeast (saccharomyces cerevisiae) hypothetical protein ydr332w - |
| CONTIG4737 | 2244526_c2_4 | 1578 | 15681 | 1059 | 353 | S59797 | 470 | 1.3(10)-44 | Saccharomyces cerevisiae | yeast (saccharomyces cerevisiae) hypothetical protein ydr332w - |
| CONTIG4853 | 14565637_c3_9 | 1579 | 15682 | 1839 | 613 | S70098 | 728 | 4.2(10)-72 | Saccharomyces cerevisiae | yeast (saccharomyces cerevisiae) hypothetical protein ydr333c - |
| b3x16841.y | 4881536_c2_3 | 1580 | 15683 | 276 | 92 | S70104 | 231 | 2.0(10)-19 | Saccharomyces cerevisiae | yeast (saccharomyces cerevisiae) hypothetical protein ydr339c - |
| CONTIG1948 | 12676532_f2_3 | 1581 | 15684 | 282 | 94 | S70111 | 197 | 5.0(10)-15 | Saccharomyces cerevisiae | yeast (saccharomyces cerevisiae) hypothetical protein ydr346c - |
| CONTIG5756 | 1259657_c1_14 | 1582 | 15685 | 480 | 160 | S61153 | 121 | 9.0(10)-8 | Saccharomyces cerevisiae | yeast (saccharomyces cerevisiae) hypothetical protein ydr357c - |
| CONTIG2562 | 16178317_c2_6 | 1583 | 15686 | 765 | 255 | S61155 | 176 | 2.8(10)-12 | Saccharomyces cerevisiae | yeast (saccharomyces cerevisiae) hypothetical protein ydr359c - |
| CONTIG837 | 35338180_f3_1 | 1584 | 15687 | 639 | 213 | S61156 | 154 | 6.2(10)-11 | Saccharomyces cerevisiae | yeast (saccharomyces cerevisiae) hypothetical protein ydr361c - |
| CONTIG2049 | 21492958_f3_2 | 1585 | 15688 | 582 | 194 | S61160 | 213 | 1.6(10)-16 | Saccharomyces cerevisiae | yeast (saccharomyces cerevisiae) hypothetical protein ydr365c - |
| CONTIG4064 | 19956686_f3_2 | 1586 | 15689 | 1419 | 473 | S61160 | 606 | 3.3(10)-69 | Saccharomyces cerevisiae | yeast (saccharomyces cerevisiae) hypothetical protein ydr365c - |
| CONTIG4064 | 13725781_f3_1 | 1587 | 15690 | 603 | 201 | S70234 | 139 | 1.1(10)-9 | Saccharomyces cerevisiae | yeast (saccharomyces cerevisiae) hypothetical protein ydr367w - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5376 | 10664175_c3_17 | 1588 | 15691 | 1038 | 346 | S61167 | 969 | 1.2(10)-97 | Saccharomyces cerevisiae | hypothetical protein ydr372c - yeast (saccharomycescerevisiae) |
| CONTIG2269 | 632640_f1_1 | 1589 | 15692 | 414 | 138 | S61169 | 281 | 1.0(10)-24 | Saccharomyces cerevisiae | hypothetical protein ydr374c - yeast (saccharomycescerevisiae) |
| CONTIG5467 | 14230276_c1_14 | 1590 | 15693 | 1860 | 620 | S69670 | 569 | 3.2(10)-83 | Saccharomyces cerevisiae | hypothetical protein ydr386w - yeast (saccharomycescerevisiae) |
| CONTIG5310 | 22516308_f2_3 | 1591 | 15694 | 2046 | 682 | S69681 | 322 | 7.0(10)-55 | Saccharomyces cerevisiae | hypothetical protein ydr398w - yeast (saccharomycescerevisiae) |
| CONTIG5108 | 29333377_c1_6 | 1592 | 15695 | 657 | 219 | S69682 | 655 | 2.2(10)-64 | Saccharomyces cerevisiae | hypothetical protein ydr399w - yeast (saccharomycescerevisiae) |
| CONTIG3928 | 31331900_f1_1 | 1593 | 15696 | 1764 | 588 | S69689 | 310 | 4.0(10)-26 | Saccharomyces cerevisiae | hypothetical protein ydr407c - yeast (saccharomycescerevisiae) |
| CONTIG4662 | 26806510_c2_8 | 1594 | 15697 | 597 | 199 | S69689 | 284 | 1.3(10)-23 | Saccharomyces cerevisiae | hypothetical protein ydr407c - yeast (saccharomycescerevisiae) |
| CONTIG5447 | 14158186_f1_4 | 1595 | 15698 | 1173 | 391 | S69696 | 198 | 1.5(10)-13 | Saccharomyces cerevisiae | hypothetical protein ydr411c - yeast (saccharomycescerevisiae) |
| CONTIG4744 | 4376257_f2_3 | 1596 | 15699 | 819 | 273 | S69697 | 208 | 3.7(10)-29 | Saccharomyces cerevisiae | hypothetical protein ydr412w - yeast (saccharomycescerevisiae) |
| CONTIG3306 | 9772762_c3_5 | 1597 | 15700 | 1014 | 338 | S69702 | 614 | 5.0(10)-60 | Saccharomyces cerevisiae | hypothetical protein ydr419w - yeast (saccharomycescerevisiae) |
| CONTIG5556 | 25792887_c3_19 | 1598 | 15701 | 1443 | 481 | S69704 | 447 | 4.0(10)-50 | Saccharomyces cerevisiae | hypothetical protein ydr421w - yeast (saccharomycescerevisiae) |
| CONTIG5556 | 33378176_c2_15 | 1599 | 15702 | 1578 | 526 | S69704 | 468 | 2.2(10)-66 | Saccharomyces cerevisiae | hypothetical protein ydr421w - yeast (saccharomycescerevisiae) |
| CONTIG336 | 16500153_f3_2 | 1600 | 15703 | 558 | 186 | S69707 | 132 | 8.1(10)-8 | Saccharomyces cerevisiae | hypothetical protein ydr425w - yeast (saccharomycescerevisiae) |
| CONTIG4761 | 23457157_f3_5 | 1601 | 15704 | 1269 | 423 | S69708 | 367 | 1.1(10)-48 | Saccharomyces cerevisiae | hypothetical protein ydr427w - yeast (saccharomycescerevisiae) |
| CONTIG5754 | 26604683_f2_11 | 1602 | 15705 | 810 | 270 | S69709 | 277 | 2.6(10)-24 | Saccharomyces cerevisiae | hypothetical protein ydr428c - yeast (saccharomycescerevisiae) |
| CONTIG3700 | 212677_c2_2 | 1603 | 15706 | 2718 | 906 | S69711 | 912 | 1.3(10)-91 | Saccharomyces cerevisiae | hypothetical protein ydr430c - yeast (saccharomycescerevisiae) |
| CONTIG5465 | 10554007_c1_10 | 1604 | 15707 | 459 | 153 | S69711 | 412 | 1.7(10)-37 | Saccharomyces cerevisiae | hypothetical protein ydr430c - yeast (saccharomycescerevisiae) |
| CONTIG5211 | 4798800_f2_6 | 1605 | 15708 | 1143 | 381 | S69715 | 273 | 7.0(10)-24 | Saccharomyces cerevisiae | hypothetical protein ydr435c - yeast (saccharomycescerevisiae) |
| CONTIG3209 | 42212_c2_5 | 1606 | 15709 | 723 | 241 | S69718 | 112 | 8.4(10)-5 | Saccharomyces cerevisiae | hypothetical protein ydr438w - yeast (saccharomycescerevisiae) |
| CONTIG3209 | 20441380_c1_4 | 1607 | 15710 | 612 | 204 | S69718 | 156 | 8.3(10)-11 | Saccharomyces cerevisiae | hypothetical protein ydr438w - yeast (saccharomycescerevisiae) |
| CONTIG1109 | 25580378_c3_2 | 1608 | 15711 | 438 | 146 | S69720 | 182 | 3.1(10)-13 | Saccharomyces cerevisiae | hypothetical protein ydr440w - yeast (saccharomycescerevisiae) |
| CONTIG5555 | 22680286_c3_23 | 1609 | 15712 | 2193 | 731 | S69723 | 512 | 5.0(10)-75 | Saccharomyces cerevisiae | hypothetical protein ydr444w - yeast (saccharomycescerevisiae) |
| CONTIG4200 | 25429703_f2_1 | 1610 | 15713 | 666 | 222 | S69728 | 441 | 1.1(10)-41 | Saccharomyces cerevisiae | hypothetical protein ydr449c - yeast (saccharomycescerevisiae) |
| CONTIG4875 | 33303442_f3_4 | 1611 | 15714 | 1470 | 490 | S69731 | 622 | 8.0(10)-93 | Saccharomyces cerevisiae | hypothetical protein ydr452w - yeast (saccharomycescerevisiae) |
| CONTIG1367 | 979750_c1_5 | 1612 | 15715 | 1206 | 402 | S69625 | 320 | 6.2(10)-27 | Saccharomyces cerevisiae | hypothetical protein ydr457w - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1275 | 12144516_f2_1 | 1613 | 15716 | 1344 | 448 | S69625 | 490 | 5.5(10)-45 | Saccharomyces cerevisiae | yeast (saccharomycescerevisiae) hypothetical protein yd457w - |
| CONTIG1949 | 10646875_c3_4 | 1614 | 15717 | 708 | 236 | S69625 | 251 | 1.3(10)-19 | Saccharomyces cerevisiae | yeast (saccharomycescerevisiae) hypothetical protein yd457w - |
| CONTIG1949 | 10629567_c3_3 | 1615 | 15718 | 786 | 262 | S69625 | 516 | 9.5(10)-48 | Saccharomyces cerevisiae | yeast (saccharomycescerevisiae) hypothetical protein yd457w - |
| CONTIG2556 | 23836502_f2_2 | 1616 | 15719 | 972 | 324 | S69625 | 194 | 8.9(10)-12 | Saccharomyces cerevisiae | yeast (saccharomycescerevisiae) hypothetical protein yd457w - |
| CONTIG901 | 23449043_f3_2 | 1617 | 15720 | 525 | 175 | S69625 | 730 | 1.8(10)-70 | Saccharomyces cerevisiae | yeast (saccharomycescerevisiae) hypothetical protein yd457w - |
| CONTIG5684 | 4320340_c2_16 | 1618 | 15721 | 1227 | 409 | S69627 | 197 | 2.2(10)-13 | Saccharomyces cerevisiae | yeast (saccharomycescerevisiae) hypothetical protein yd459c - |
| CONTIG3693 | 12_f3_2 | 1619 | 15722 | 1458 | 486 | S69633 | 704 | 1.8(10)-93 | Saccharomyces cerevisiae | yeast (saccharomycescerevisiae) hypothetical protein yd465c - |
| CONTIG981 | 175340_c2_4 | 1620 | 15723 | 684 | 228 | S69635 | 190 | 4.4(10)-15 | Saccharomyces cerevisiae | yeast (saccharomycescerevisiae) hypothetical protein yd468c - |
| CONTIG2217 | 21485000_f1_1 | 1621 | 15724 | 450 | 150 | S69636 | 156 | 1.8(10)-11 | Saccharomyces cerevisiae | yeast (saccharomycescerevisiae) hypothetical protein yd469w - |
| CONTIG2217 | 9853412_f1_2 | 1622 | 15725 | 240 | 80 | S69637 | 106 | 3.7(10)-5 | Saccharomyces cerevisiae | yeast (saccharomycescerevisiae) hypothetical protein yd470c - |
| CONTIG3070 | 1067628_f1_1 | 1623 | 15726 | 1698 | 566 | S69641 | 151 | 1.3(10)-7 | Saccharomyces cerevisiae | yeast (saccharomycescerevisiae) hypothetical protein yd474c - |
| CONTIG5095 | 24098387_f2_2 | 1624 | 15727 | 1878 | 626 | S69646 | 315 | 8.3(10)-33 | Saccharomyces cerevisiae | yeast (saccharomycescerevisiae) hypothetical protein yd479c - |
| CONTIG5707 | 16978125_c3_23 | 1625 | 15728 | 519 | 173 | S69652 | 195 | 2.1(10)-14 | Saccharomyces cerevisiae | yeast (saccharomycescerevisiae) hypothetical protein yd485c - |
| CONTIG5140 | 23613385_c2_10 | 1626 | 15729 | 378 | 126 | S69660 | 191 | 3.3(10)-15 | Saccharomyces cerevisiae | yeast (saccharomycescerevisiae) hypothetical protein yd493w - |
| CONTIG3718 | 4002217_c2_9 | 1627 | 15730 | 924 | 308 | S69557 | 148 | 2.0(10)-7 | Saccharomyces cerevisiae | yeast (saccharomycescerevisiae) hypothetical protein yd499w - |
| CONTIG1874 | 12901541_c1_3 | 1628 | 15731 | 261 | 87 | S69568 | 253 | 9.1(10)-22 | Saccharomyces cerevisiae | yeast (saccharomycescerevisiae) hypothetical protein yd511w - |
| CONTIG4717 | 29375312_c2_4 | 1629 | 15732 | 552 | 184 | S69569 | 147 | 1.6(10)-10 | Saccharomyces cerevisiae | yeast (saccharomycescerevisiae) hypothetical protein yd512c - |
| CONTIG5454 | 24429682_c3_13 | 1630 | 15733 | 879 | 293 | S69574 | 144 | 1.7(10)-7 | Saccharomyces cerevisiae | yeast (saccharomycescerevisiae) hypothetical protein yd517w - |
| CONTIG4648 | 13673307_f3_3 | 1631 | 15734 | 2742 | 914 | S69580 | 279 | 2.6(10)-21 | Saccharomyces cerevisiae | yeast (saccharomycescerevisiae) hypothetical protein yd524c - |
| CONTIG5684 | 21882_c2_17 | 1632 | 15735 | 1422 | 474 | S69582 | 546 | 8.3(10)-53 | Saccharomyces cerevisiae | yeast (saccharomycescerevisiae) hypothetical protein yd527w - |
| CONTIG5459 | 11906503_c3_15 | 1633 | 15736 | 1719 | 573 | S69586 | 646 | 1.3(10)-67 | Saccharomyces cerevisiae | yeast (saccharomycescerevisiae) hypothetical protein yd531w - |
| CONTIG4549 | 15672152_c3_10 | 1634 | 15737 | 477 | 159 | S69588 | 480 | 8.0(10)-46 | Saccharomyces cerevisiae | yeast (saccharomycescerevisiae) hypothetical protein yd533c - |
| CONTIG3725 | 4804007_f3_2 | 1635 | 15738 | 378 | 126 | S53543 | 405 | 7.2(10)-38 | Saccharomyces cerevisiae | yeast (saccharomycescerevisiae) hypothetical protein yet007c-a - |
| CONTIG5390 | 12507212_c2_17 | 1636 | 15739 | 525 | 175 | S53547 | 191 | 3.3(10)-15 | Saccharomyces cerevisiae | yeast (saccharomycescerevisiae) hypothetical protein yet093c-a - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2504 | 4485253_c2_5 | 1637 | 15740 | 711 | 237 | S46791 | 723 | 1.3(10)-71 | Saccharomyces cerevisiae | hypothetical protein yhr016c - yeast (saccharomycescerevisiae) |
| CONTIG5367 | 25397135_c1_10 | 1638 | 15741 | 1338 | 446 | S64752 | 739 | 2.8(10)-73 | Saccharomyces cerevisiae | hypothetical protein yll010c - yeast (saccharomycescerevisiae) |
| CONTIG2282 | 6672187_c3_3 | 1639 | 15742 | 1305 | 435 | S64755 | 128 | 9.0(10)-5 | Saccharomyces cerevisiae | hypothetical protein yll013c - yeast (saccharomycescerevisiae) |
| CONTIG5451 | 190932_f3_5 | 1640 | 15743 | 2838 | 946 | S64755 | 842 | 3.5(10)-84 | Saccharomyces cerevisiae | hypothetical protein yll013c - yeast (saccharomycescerevisiae) |
| CONTIG1958 | 7242067_f2_1 | 1641 | 15744 | 1122 | 374 | S64780 | 647 | 1.6(10)-63 | Saccharomyces cerevisiae | hypothetical protein yll029w - yeast (saccharomycescerevisiae) |
| CONTIG3575 | 29565882_c1_5 | 1642 | 15745 | 318 | 106 | S64780 | 186 | 1.7(10)-13 | Saccharomyces cerevisiae | hypothetical protein yll029w - yeast (saccharomycescerevisiae) |
| CONTIG5645 | 21523937_f1_1 | 1643 | 15746 | 765 | 255 | S64780 | 781 | 1.0(10)-77 | Saccharomyces cerevisiae | hypothetical protein yll029w - yeast (saccharomycescerevisiae) |
| CONTIG4196 | 34381575_c3_6 | 1644 | 15747 | 1422 | 474 | S64786 | 259 | 1.8(10)-19 | Saccharomyces cerevisiae | hypothetical protein yll035w - yeast (saccharomycescerevisiae) |
| CONTIG5683 | 24662502_c1_15 | 1645 | 15748 | 987 | 329 | S64789 | 105 | 0.002 | Saccharomyces cerevisiae | hypothetical protein yll038c - yeast (saccharomycescerevisiae) |
| CONTIG1512 | 7760_f2_1 | 1646 | 15749 | 768 | 256 | S64824 | 304 | 2.7(10)-26 | Saccharomyces cerevisiae | hypothetical protein ylr002c - yeast (saccharomycescerevisiae) |
| CONTIG4372 | 7064177_f1_1 | 1647 | 15750 | 237 | 79 | S64824 | 105 | 6.9(10)-5 | Saccharomyces cerevisiae | hypothetical protein ylr002c - yeast (saccharomycescerevisiae) |
| CONTIG576 | 12402137_f2_1 | 1648 | 15751 | 657 | 219 | S64824 | 241 | 1.7(10)-19 | Saccharomyces cerevisiae | hypothetical protein ylr002c - yeast (saccharomycescerevisiae) |
| b2x14796.y | 23650037_c3_3 | 1649 | 15752 | 516 | 172 | S64825 | 91 | 0.01299 | Saccharomyces cerevisiae | hypothetical protein ylr003c - yeast (saccharomycescerevisiae) |
| CONTIG5774 | 34179687_f1_1 | 1650 | 15753 | 1722 | 574 | S64860 | 243 | 4.0(10)-33 | Saccharomyces cerevisiae | hypothetical protein ylr033w - yeast (saccharomycescerevisiae) |
| CONTIG5450 | 4882812_f1_2 | 1651 | 15754 | 669 | 223 | S61625 | 396 | 6.5(10)-37 | Saccharomyces cerevisiae | hypothetical protein ylr051c - yeast (saccharomycescerevisiae) |
| CONTIG3527 | 21878793_c3_7 | 1652 | 15755 | 423 | 141 | S64906 | 188 | 7.0(10)-15 | Saccharomyces cerevisiae | hypothetical protein ylr074c - yeast (saccharomycescerevisiae) |
| CONTIG5277 | 33242325_f2_6 | 1653 | 15756 | 1374 | 458 | S64931 | 233 | 2.1(10)-29 | Saccharomyces cerevisiae | hypothetical protein ylr097c - yeast (saccharomycescerevisiae) |
| CONTIG5779 | 22300817_f2_7 | 1654 | 15757 | 1161 | 387 | S64944 | 443 | 6.7(10)-42 | Saccharomyces cerevisiae | hypothetical protein ylr107w - yeast (saccharomycescerevisiae) |
| CONTIG4656 | 4782200_c1_6 | 1655 | 15758 | 2460 | 820 | S64951 | 794 | 4.2(10)-79 | Saccharomyces cerevisiae | hypothetical protein ylr114c - yeast (saccharomycescerevisiae) |
| CONTIG5112 | 34094688_f1_1 | 1656 | 15759 | 1320 | 440 | S64954 | 678 | 8.5(10)-67 | Saccharomyces cerevisiae | hypothetical protein ylr117c - yeast (saccharomycescerevisiae) |
| CONTIG5705 | 21617625_f3_11 | 1657 | 15760 | 1698 | 566 | S59315 | 144 | 2.1(10)-6 | Saccharomyces cerevisiae | hypothetical protein ylr127c - yeast (saccharomycescerevisiae) |
| CONTIG5705 | 234702_f3_12 | 1658 | 15761 | 783 | 261 | S59315 | 199 | 8.5(10)-15 | Saccharomyces cerevisiae | hypothetical protein ylr127c - yeast (saccharomycescerevisiae) |
| CONTIG5705 | 30588436_c1_18 | 1659 | 15762 | 930 | 310 | S59316 | 162 | 1.1(10)-17 | Saccharomyces cerevisiae | hypothetical protein ylr128w - yeast (saccharomycescerevisiae) |
| CONTIG5383 | 4789063_f3_3 | 1660 | 15763 | 2028 | 676 | S64985 | 707 | 9.5(10)-115 | Saccharomyces cerevisiae | hypothetical protein ylr143w - yeast (saccharomycescerevisiae) |
| CONTIG5433 | 5188430_f2_2 | 1661 | 15764 | 2262 | 754 | S64993 | 1108 | 2.2(10)-112 | Saccharomyces cerevisiae | hypothetical protein ylr144c - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5638 | 6814055_f3_12 | 1662 | 15765 | 1728 | 576 | S64998 | 227 | 6.2(10)-39 | Saccharomyces cerevisiae | hypothetical protein ylr149c - yeast (saccharomycescerevisiae) |
| CONTIG1155 | 33751687_f1_1 | 1663 | 15766 | 390 | 130 | S68481 | 103 | 2.5(10)-5 | Saccharomyces cerevisiae | hypothetical protein ylr165c - yeast (saccharomycescerevisiae) |
| CONTIG1580 | 33751687_c1_4 | 1664 | 15767 | 462 | 154 | S68481 | 136 | 4.7(10)-9 | Saccharomyces cerevisiae | hypothetical protein ylr165c - yeast (saccharomycescerevisiae) |
| CONTIG3733 | 13006378_c2_3 | 1665 | 15768 | 261 | 87 | S51428 | 215 | 5.7(10)-17 | Saccharomyces cerevisiae | hypothetical protein ylr183c - yeast (saccharomycescerevisiae) |
| CONTIG2333 | 4687575_f3_1 | 1666 | 15769 | 870 | 290 | S51431 | 951 | 1.0(10)-95 | Saccharomyces cerevisiae | hypothetical protein ylr186w - yeast (saccharomycescerevisiae) |
| CONTIG1558 | 22666275_c3_5 | 1667 | 15770 | 1020 | 340 | S51432 | 633 | 2.5(10)-61 | Saccharomyces cerevisiae | hypothetical protein ylr187w - yeast (saccharomycescerevisiae) |
| CONTIG435 | 34166062_c1_4 | 1668 | 15771 | 819 | 273 | S51434 | 122 | 5.0(10)-11 | Saccharomyces cerevisiae | hypothetical protein ylr189c - yeast (saccharomycescerevisiae) |
| CONTIG565 | 36115631_c3_2 | 1669 | 15772 | 1014 | 338 | S51434 | 124 | 0.00012 | Saccharomyces cerevisiae | hypothetical protein ylr189c - yeast (saccharomycescerevisiae) |
| b2x19027.x | 480041_f3_1 | 1670 | 15773 | 507 | 169 | S51434 | 333 | 6.9(10)-29 | Saccharomyces cerevisiae | hypothetical protein ylr189c - yeast (saccharomycescerevisiae) |
| CONTIG5696 | 5360762_f3_6 | 1671 | 15774 | 762 | 254 | S48545 | 287 | 2.2(10)-25 | Saccharomyces cerevisiae | hypothetical protein ylr192c - yeast (saccharomycescerevisiae) |
| CONTIG4850 | 36131316_c1_8 | 1672 | 15775 | 627 | 209 | S48546 | 375 | 1.1(10)-34 | Saccharomyces cerevisiae | hypothetical protein ylr193c - yeast (saccharomycescerevisiae) |
| CONTIG2729 | 3164062_c3_2 | 1673 | 15776 | 876 | 292 | S48553 | 291 | 8.6(10)-26 | Saccharomyces cerevisiae | hypothetical protein ylr201c - yeast (saccharomycescerevisiae) |
| CONTIG4667 | 6832926_f2_1 | 1674 | 15777 | 1638 | 546 | S48557 | 410 | 4.7(10)-59 | Saccharomyces cerevisiae | hypothetical protein ylr206w - yeast (saccharomycescerevisiae) |
| CONTIG3918 | 34555217_f3_4 | 1675 | 15778 | 1059 | 353 | S48566 | 565 | 8.0(10)-55 | Saccharomyces cerevisiae | hypothetical protein ylr215c - yeast (saccharomycescerevisiae) |
| CONTIG5132 | 2386286_f3_6 | 1676 | 15779 | 219 | 73 | S48568 | 237 | 4.5(10)-20 | Saccharomyces cerevisiae | hypothetical protein ylr218c - yeast (saccharomycescerevisiae) |
| CONTIG4279 | 24613561_c2_4 | 1677 | 15780 | 693 | 231 | S51444 | 143 | 4.2(10)-10 | Saccharomyces cerevisiae | hypothetical protein ylr221c - yeast (saccharomycescerevisiae) |
| CONTIG3494 | 4882830_f1_2 | 1678 | 15781 | 294 | 98 | S51447 | 124 | 2.6(10)-7 | Saccharomyces cerevisiae | hypothetical protein ylr224w - yeast (saccharomycescerevisiae) |
| CONTIG5756 | 4866312_c2_21 | 1679 | 15782 | 978 | 326 | S51458 | 414 | 8.0(10)-39 | Saccharomyces cerevisiae | hypothetical protein ylr239c - yeast (saccharomycescerevisiae) |
| CONTIG5796 | 13878135_f3_14 | 1680 | 15783 | 999 | 333 | S51406 | 678 | 2.2(10)-78 | Saccharomyces cerevisiae | hypothetical protein ylr270w - yeast (saccharomycescerevisiae) |
| CONTIG5788 | 34179702_f3_11 | 1681 | 15784 | 816 | 272 | S51407 | 161 | 4.7(10)-19 | Saccharomyces cerevisiae | hypothetical protein ylr271w - yeast (saccharomycescerevisiae) |
| CONTIG1977 | 198582_c2_3 | 1682 | 15785 | 1200 | 400 | S51408 | 478 | 2.1(10)-44 | Saccharomyces cerevisiae | hypothetical protein ylr272c - yeast (saccharomycescerevisiae) |
| CONTIG3262 | 12503875_c2_7 | 1683 | 15786 | 261 | 87 | S51408 | 107 | 8.4(10)-5 | Saccharomyces cerevisiae | hypothetical protein ylr272c - yeast (saccharomycescerevisiae) |
| CONTIG2680 | 31593_c1_5 | 1684 | 15787 | 975 | 325 | S50372 | 110 | 0.00042 | Saccharomyces cerevisiae | hypothetical protein ylr287c - yeast (saccharomycescerevisiae) |
| CONTIG5348 | 5273437_c1_13 | 1685 | 15788 | 849 | 283 | S50375 | 479 | 1.0(10)-45 | Saccharomyces cerevisiae | hypothetical protein ylr290c - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3521 | 10992128_c1_6 | 1686 | 15789 | 1476 | 492 | S51441 | 94 | 0.34 | Saccharomyces cerevisiae | hypothetical protein ylr309c - yeast (saccharomycescerevisiae) |
| CONTIG886 | 21972809_c2_2 | 1687 | 15790 | 621 | 207 | S51441 | 100 | 0.01499 | Saccharomyces cerevisiae | hypothetical protein ylr309c - yeast (saccharomycescerevisiae) |
| CONTIG5416 | 9859833_c3_13 | 1688 | 15791 | 825 | 275 | S53395 | 338 | 9.0(10)-31 | Saccharomyces cerevisiae | hypothetical protein ylr316c - yeast (saccharomycescerevisiae) |
| CONTIG1468 | 35973266_f1_1 | 1689 | 15792 | 804 | 268 | S53396 | 134 | 5.7(10)-6 | Saccharomyces cerevisiae | hypothetical protein ylr318w - yeast (saccharomycescerevisiae) |
| CONTIG3528 | 10345281_f1_1 | 1690 | 15793 | 561 | 187 | S51388 | 526 | 1.1(10)-50 | Saccharomyces cerevisiae | hypothetical protein ylr370c - yeast (saccharomycescerevisiae) |
| CONTIG1673 | 33672638_f2_1 | 1691 | 15794 | 288 | 96 | S51467 | 142 | 3.3(10)-9 | Saccharomyces cerevisiae | hypothetical protein ylr380c - yeast (saccharomycescerevisiae) |
| CONTIG5165 | 14298557_c2_16 | 1692 | 15795 | 732 | 244 | S51474 | 243 | 3.2(10)-20 | Saccharomyces cerevisiae | hypothetical protein ylr387c - yeast (saccharomycescerevisiae) |
| CONTIG5753 | 35674013_f3_8 | 1693 | 15796 | 798 | 266 | S51474 | 541 | 2.7(10)-52 | Saccharomyces cerevisiae | hypothetical protein ylr387c - yeast (saccharomycescerevisiae) |
| CONTIG5337 | 4183432_f1_1 | 1694 | 15797 | 999 | 333 | S55950 | 159 | 5.5(10)-9 | Saccharomyces cerevisiae | hypothetical protein ylr394w - yeast (saccharomycescerevisiae) |
| CONTIG4139 | 980026_c2_11 | 1695 | 15798 | 1011 | 337 | S59376 | 532 | 6.0(10)-56 | Saccharomyces cerevisiae | hypothetical protein ylr410w - yeast (saccharomycescerevisiae) |
| CONTIG2295 | 10833318_c1_3 | 1696 | 15799 | 1182 | 394 | S59376 | 811 | 9.4(10)-81 | Saccharomyces cerevisiae | hypothetical protein ylr410w - yeast (saccharomycescerevisiae) |
| b9x13a89.x | 25401392_c3_4 | 1697 | 15800 | 693 | 231 | S59376 | 630 | 9.0(10)-61 | Saccharomyces cerevisiae | hypothetical protein ylr410w - yeast (saccharomycescerevisiae) |
| CONTIG4001 | 16836002_f1_2 | 1698 | 15801 | 483 | 161 | S59378 | 225 | 8.5(10)-19 | Saccharomyces cerevisiae | hypothetical protein ylr412w - yeast (saccharomycescerevisiae) |
| CONTIG3034 | 35426637_c2_1 | 1699 | 15802 | 1041 | 347 | S59382 | 183 | 1.3(10)-11 | Saccharomyces cerevisiae | hypothetical protein ylr417w - yeast (saccharomycescerevisiae) |
| CONTIG2903 | 23475836_c2_6 | 1700 | 15803 | 1095 | 365 | S59384 | 263 | 2.6(10)-21 | Saccharomyces cerevisiae | hypothetical protein ylr419w - yeast (saccharomycescerevisiae) |
| CONTIG5705 | 34117217_c2_19 | 1701 | 15804 | 387 | 129 | S59384 | 282 | 2.5(10)-23 | Saccharomyces cerevisiae | hypothetical protein ylr419w - yeast (saccharomycescerevisiae) |
| b9x11r43.x | 24353442_f1_1 | 1702 | 15805 | 729 | 243 | S59384 | 320 | 2.2(10)-27 | Saccharomyces cerevisiae | hypothetical protein ylr419w - yeast (saccharomycescerevisiae) |
| CONTIG4618 | 23862537_c2_4 | 1703 | 15806 | 354 | 118 | S69319 | 186 | 1.2(10)-14 | Saccharomyces cerevisiae | hypothetical protein ylr421c - yeast (saccharomycescerevisiae) |
| CONTIG4085 | 9798432_f3_4 | 1704 | 15807 | 1863 | 621 | S53411 | 142 | 3.0(10)-6 | Saccharomyces cerevisiae | hypothetical protein ylr424w - yeast (saccharomycescerevisiae) |
| CONTIG4399 | 5272561_f1_1 | 1705 | 15808 | 351 | 117 | S59404 | 366 | 9.8(10)-34 | Saccharomyces cerevisiae | hypothetical protein ylr435w - yeast (saccharomycescerevisiae) |
| b9x13a50.x | 89026_f3_2 | 1706 | 15809 | 570 | 190 | S55966 | 197 | 4.2(10)-15 | Saccharomyces cerevisiae | hypothetical protein ylr443w - yeast (saccharomycescerevisiae) |
| CONTIG5458 | 16428311_c1_11 | 1707 | 15810 | 339 | 113 | S69858 | 227 | 5.2(10)-19 | Saccharomyces cerevisiae | hypothetical protein ymr244c-a- yeast (saccharomycescerevisiae) |
| CONTIG4905 | 4772130_f1_1 | 1708 | 15811 | 1806 | 602 | S66717 | 744 | 2.2(10)-73 | Saccharomyces cerevisiae | hypothetical protein yol034w - yeast (saccharomycescerevisiae) |
| CONTIG5635 | 20890654_c1_13 | 1709 | 15812 | 1446 | 482 | S66717 | 625 | 2.6(10)-60 | Saccharomyces cerevisiae | hypothetical protein yol034w - yeast (saccharomycescerevisiae) |
| CONTIG5468 | 10976588_f1_3 | 1710 | 15813 | 1374 | 458 | S66726 | 605 | 2.1(10)-71 | Saccharomyces cerevisiae | hypothetical protein yol041c - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5481 | 10975937_f2_4 | 1711 | 15814 | 2109 | 703 | S66749 | 1246 | 1.3(10)-154 | Saccharomyces cerevisiae | yeast (saccharomycescerevisiae) hypothetical protein yol057w - |
| CONTIG5704 | 567151_c1_12 | 1712 | 15815 | 750 | 250 | S66763 | 206 | 5.9(10)-16 | Saccharomyces cerevisiae | yeast (saccharomycescerevisiae) hypothetical protein yol070c - |
| CONTIG3842 | 1210312_f1_2 | 1713 | 15816 | 474 | 158 | S66764 | 340 | 5.5(10)-31 | Saccharomyces cerevisiae | yeast (saccharomycescerevisiae) hypothetical protein yol071w - |
| CONTIG4914 | 19957626_f2_3 | 1714 | 15817 | 885 | 295 | S66773 | 563 | 1.3(10)-54 | Saccharomyces cerevisiae | yeast (saccharomycescerevisiae) hypothetical protein yol080c - |
| CONTIG3055 | 23865953_c1_3 | 1715 | 15818 | 861 | 287 | S57382 | 129 | 2.7(10)-5 | Saccharomyces cerevisiae | yeast (saccharomycescerevisiae) hypothetical protein yol087c - |
| CONTIG3580 | 433340_f2_1 | 1716 | 15819 | 789 | 263 | S57382 | 201 | 7.5(10)-15 | Saccharomyces cerevisiae | yeast (saccharomycescerevisiae) hypothetical protein yol087c - |
| b3x17370.x | 212557_f3_2 | 1717 | 15820 | 183 | 61 | S57376 | 135 | 9.6(10)-9 | Saccharomyces cerevisiae | yeast (saccharomycescerevisiae) hypothetical protein yol093w - |
| b9x13a48.y | 22632202_c1_3 | 1718 | 15821 | 678 | 226 | S57376 | 288 | 1.8(10)-25 | Saccharomyces cerevisiae | yeast (saccharomycescerevisiae) hypothetical protein yol093w - |
| CONTIG2227 | 4566306_f1_1 | 1719 | 15822 | 1095 | 365 | S51900 | 261 | 5.7(10)-29 | Saccharomyces cerevisiae | yeast (saccharomycescerevisiae) hypothetical protein yol098c - |
| CONTIG3647 | 22689087_c3_6 | 1720 | 15823 | 636 | 212 | S51900 | 432 | 1.3(10)-39 | Saccharomyces cerevisiae | yeast (saccharomycescerevisiae) hypothetical protein yol098c - |
| CONTIG659 | 25582750_f1_1 | 1721 | 15824 | 798 | 266 | S51900 | 422 | 1.6(10)-38 | Saccharomyces cerevisiae | yeast (saccharomycescerevisiae) hypothetical protein yol098c - |
| CONTIG4769 | 10344655_c3_10 | 1722 | 15825 | 594 | 198 | S51883 | 256 | 4.4(10)-22 | Saccharomyces cerevisiae | yeast (saccharomycescerevisiae) hypothetical protein yol114c - |
| CONTIG5521 | 7070260_c3_30 | 1723 | 15826 | 1425 | 475 | S63447 | 1204 | 1.5(10)-122 | Saccharomyces cerevisiae | yeast (saccharomycescerevisiae) hypothetical protein yol124c - |
| CONTIG4741 | 30507200_c3_18 | 1724 | 15827 | 348 | 116 | S63445 | 107 | 1.6(10)-10 | Saccharomyces cerevisiae | yeast (saccharomycescerevisiae) hypothetical protein yol125w - |
| CONTIG4741 | 2120393_c3_17 | 1725 | 15828 | 936 | 312 | S63445 | 290 | 2.7(10)-25 | Saccharomyces cerevisiae | yeast (saccharomycescerevisiae) hypothetical protein yol125w - |
| CONTIG5142 | 24301550_f1_1 | 1726 | 15829 | 936 | 312 | S66832 | 148 | 6.0(10)-22 | Saccharomyces cerevisiae | yeast (saccharomycescerevisiae) hypothetical protein yol135c - |
| CONTIG3025 | 33322155_f2_1 | 1727 | 15830 | 1593 | 531 | S61873 | 689 | 5.7(10)-68 | Saccharomyces cerevisiae | yeast (saccharomycescerevisiae) hypothetical protein yol141w - |
| CONTIG2493 | 2449542_c3_9 | 1728 | 15831 | 366 | 122 | S61872 | 177 | 1.0(10)-13 | Saccharomyces cerevisiae | yeast (saccharomycescerevisiae) hypothetical protein yol142w - |
| CONTIG4677 | 4953427_c2_7 | 1729 | 15832 | 1968 | 656 | S61870 | 205 | 1.7(10)-30 | Saccharomyces cerevisiae | yeast (saccharomycescerevisiae) hypothetical protein yol144w - |
| CONTIG5396 | 20425805_c2_13 | 1730 | 15833 | 828 | 276 | S61987 | 570 | 2.3(10)-55 | Saccharomyces cerevisiae | yeast (saccharomycescerevisiae) hypothetical protein yor004w - |
| CONTIG4975 | 20900336_f2_3 | 1731 | 15834 | 624 | 208 | S54627 | 714 | 1.3(10)-70 | Saccharomyces cerevisiae | yeast (saccharomycescerevisiae) hypothetical protein yor021c - |
| CONTIG4536 | 22829638_f1_2 | 1732 | 15835 | 714 | 238 | S54628 | 316 | 1.7(10)-27 | Saccharomyces cerevisiae | yeast (saccharomycescerevisiae) hypothetical protein yor022c - |
| CONTIG4975 | 6745177_c1_7 | 1733 | 15836 | 1524 | 508 | S54628 | 583 | 9.9(10)-57 | Saccharomyces cerevisiae | yeast (saccharomycescerevisiae) hypothetical protein yor022c - |
| CONTIG5310 | 13960187_f2_2 | 1734 | 15837 | 912 | 304 | S54629 | 173 | 1.3(10)-10 | Saccharomyces cerevisiae | yeast (saccharomycescerevisiae) hypothetical protein yor023c - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5639 | 16834680_c3_24 | 1735 | 15838 | 981 | 327 | S66916 | 177 | 5.4(10)-13 | Saccharomyces cerevisiae | hypothetical protein yor042w - yeast (saccharomycescerevisiae) |
| CONTIG2032 | 29563878_c1_3 | 1736 | 15839 | 744 | 248 | S66923 | 106 | 0.00012 | Saccharomyces cerevisiae | hypothetical protein yor049c - yeast (saccharomycescerevisiae) |
| CONTIG3741 | 33804687_c3_5 | 1737 | 15840 | 1056 | 352 | S66923 | 343 | 2.7(10)-31 | Saccharomyces cerevisiae | hypothetical protein yor049c - yeast (saccharomycescerevisiae) |
| CONTIG3987 | 1954063_c3_8 | 1738 | 15841 | 1362 | 454 | S66923 | 380 | 3.2(10)-35 | Saccharomyces cerevisiae | hypothetical protein yor049c - yeast (saccharomycescerevisiae) |
| CONTIG4353 | 4707125_f3_3 | 1739 | 15842 | 1506 | 502 | S66923 | 373 | 1.8(10)-34 | Saccharomyces cerevisiae | hypothetical protein yor049c - yeast (saccharomycescerevisiae) |
| CONTIG5819 | 16834683_f2_13 | 1740 | 15843 | 1272 | 424 | S66925 | 536 | 9.5(10)-52 | Saccharomyces cerevisiae | hypothetical protein yor051c - yeast (saccharomycescerevisiae) |
| CONTIG5819 | 6837757_c2_45 | 1741 | 15844 | 561 | 187 | S66926 | 190 | 4.4(10)-15 | Saccharomyces cerevisiae | hypothetical protein yor052c - yeast (saccharomycescerevisiae) |
| CONTIG5778 | 4970252_c2_27 | 1742 | 15845 | 1413 | 471 | S66939 | 730 | 3.8(10)-95 | Saccharomyces cerevisiae | hypothetical protein yor056c - yeast (saccharomycescerevisiae) |
| CONTIG5406 | 14256667_f1_4 | 1743 | 15846 | 903 | 301 | S66943 | 95 | 0.028 | Saccharomyces cerevisiae | hypothetical protein yor060c - yeast (saccharomycescerevisiae) |
| CONTIG5730 | 3992010_f2_6 | 1744 | 15847 | 1083 | 361 | S66947 | 156 | 1.6(10)-19 | Saccharomyces cerevisiae | hypothetical protein yor064c - yeast (saccharomycescerevisiae) |
| CONTIG3290 | 26597180_c2_2 | 1745 | 15848 | 360 | 120 | S66963 | 129 | 2.2(10)-7 | Saccharomyces cerevisiae | hypothetical protein yor080w - yeast (saccharomycescerevisiae) |
| CONTIG3093 | 33370300_f2_5 | 1746 | 15849 | 702 | 234 | S61651 | 585 | 6.0(10)-57 | Saccharomyces cerevisiae | hypothetical protein yor091w - yeast (saccharomycescerevisiae) |
| CONTIG4999 | 14631876_c3_12 | 1747 | 15850 | 1230 | 410 | S66977 | 447 | 2.6(10)-42 | Saccharomyces cerevisiae | hypothetical protein yor092w - yeast (saccharomycescerevisiae) |
| CONTIG2135 | 26344010_f2_4 | 1748 | 15851 | 645 | 215 | S60992 | 243 | 1.3(10)-19 | Saccharomyces cerevisiae | hypothetical protein yor112w - yeast (saccharomycescerevisiae) |
| CONTIG4511 | 23609655_f1_1 | 1749 | 15852 | 720 | 240 | S61003 | 297 | 2.0(10)-26 | Saccharomyces cerevisiae | hypothetical protein yor115c - yeast (saccharomycescerevisiae) |
| CONTIG4911 | 4900252_f2_2 | 1750 | 15853 | 2697 | 899 | S61698 | 281 | 4.7(10)-25 | Saccharomyces cerevisiae | hypothetical protein yor144c - yeast (saccharomycescerevisiae) |
| CONTIG5696 | 16835187_c2_18 | 1751 | 15854 | 837 | 279 | S67033 | 886 | 7.7(10)-89 | Saccharomyces cerevisiae | hypothetical protein yor145c - yeast (saccharomycescerevisiae) |
| CONTIG2288 | 12500090_f2_1 | 1752 | 15855 | 561 | 187 | S67043 | 305 | 3.1(10)-27 | Saccharomyces cerevisiae | hypothetical protein yor155c - yeast (saccharomycescerevisiae) |
| CONTIG383 | 10625278_f2_3 | 1753 | 15856 | 618 | 206 | S67043 | 384 | 1.2(10)-35 | Saccharomyces cerevisiae | hypothetical protein yor155c - yeast (saccharomycescerevisiae) |
| CONTIG2160 | 35417293_f2_1 | 1754 | 15857 | 495 | 165 | S67051 | 317 | 1.5(10)-28 | Saccharomyces cerevisiae | hypothetical protein yor163w - yeast (saccharomycescerevisiae) |
| CONTIG2160 | 24314575_c2_5 | 1755 | 15858 | 1026 | 342 | S67052 | 266 | 3.8(10)-23 | Saccharomyces cerevisiae | hypothetical protein yor164c - yeast (saccharomycescerevisiae) |
| CONTIG5479 | 21675000_c2_12 | 1756 | 15859 | 1611 | 537 | S67059 | 633 | 6.0(10)-101 | Saccharomyces cerevisiae | hypothetical protein yor171c - yeast (saccharomycescerevisiae) |
| CONTIG5788 | 33320292_c1_18 | 1757 | 15860 | 1008 | 336 | S67062 | 195 | 4.0(10)-18 | Saccharomyces cerevisiae | hypothetical protein yor174w - yeast (saccharomycescerevisiae) |
| CONTIG3393 | 12290927_c2_5 | 1758 | 15861 | 1428 | 476 | S67083 | 621 | 2.2(10)-59 | Saccharomyces cerevisiae | hypothetical protein yor191w - yeast (saccharomycescerevisiae) |
| CONTIG5802 | 24226387_c1_25 | 1759 | 15862 | 1371 | 457 | S67089 | 978 | 1.3(10)-98 | Saccharomyces cerevisiae | hypothetical protein yor197w - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2957 | 4725675_c1_4 | 1760 | 15863 | 837 | 279 | S60947 | 126 | 6.5(10)-6 | Saccharomyces cerevisiae | yeast (saccharomycescerevisiae) hypothetical protein yor220w - |
| CONTIG1321 | 11113876_c1_3 | 1761 | 15864 | 321 | 107 | S67131 | 186 | 1.8(10)-14 | Saccharomyces cerevisiae | yeast (saccharomycescerevisiae) hypothetical protein yor238w - |
| CONTIG5813 | 485931_c2_48 | 1762 | 15865 | 810 | 270 | S67155 | 300 | 8.0(10)-31 | Saccharomyces cerevisiae | yeast (saccharomycescerevisiae) hypothetical protein yor258w - |
| CONTIG3777 | 187817_c2_3 | 1763 | 15866 | 378 | 126 | S67183 | 213 | 1.6(10)-17 | Saccharomyces cerevisiae | yeast (saccharomycescerevisiae) hypothetical protein yor281c - |
| CONTIG4807 | 10649055_c3_10 | 1764 | 15867 | 858 | 286 | S67189 | 372 | 2.2(10)-34 | Saccharomyces cerevisiae | yeast (saccharomycescerevisiae) hypothetical protein yor287c - |
| CONTIG1842 | 2773317_f1_1 | 1765 | 15868 | 657 | 219 | S67191 | 253 | 9.1(10)-22 | Saccharomyces cerevisiae | yeast (saccharomycescerevisiae) hypothetical protein yor289w - |
| CONTIG4948 | 9852290_f3_6 | 1766 | 15869 | 633 | 211 | S67198 | 732 | 1.6(10)-72 | Saccharomyces cerevisiae | yeast (saccharomycescerevisiae) hypothetical protein yor294w - |
| CONTIG4691 | 24647656_f2_2 | 1767 | 15870 | 2433 | 811 | S67200 | 540 | 2.0(10)-93 | Saccharomyces cerevisiae | yeast (saccharomycescerevisiae) hypothetical protein yor296w - |
| CONTIG4948 | 978125_f1_3 | 1768 | 15871 | 927 | 309 | S67200 | 139 | 4.5(10)-9 | Saccharomyces cerevisiae | yeast (saccharomycescerevisiae) hypothetical protein yor296w - |
| CONTIG5812 | 4038125_f3_13 | 1769 | 15872 | 744 | 248 | S67209 | 132 | 4.7(10)-7 | Saccharomyces cerevisiae | yeast (saccharomycescerevisiae) hypothetical protein yor305w - |
| CONTIG1727 | 2385942_f1_1 | 1770 | 15873 | 408 | 136 | S58319 | 117 | 3.1(10)-6 | Saccharomyces cerevisiae | yeast (saccharomycescerevisiae) hypothetical protein yor308c - |
| CONTIG2180 | 10829192_f1_1 | 1771 | 15874 | 513 | 171 | S58319 | 117 | 3.1(10)-6 | Saccharomyces cerevisiae | yeast (saccharomycescerevisiae) hypothetical protein yor308c - |
| CONTIG4545 | 11894432_f1_1 | 1772 | 15875 | 1608 | 536 | S58319 | 130 | 6.7(10)-10 | Saccharomyces cerevisiae | yeast (saccharomycescerevisiae) hypothetical protein yor308c - |
| b2x17256.y | 46876260_f2_1 | 1773 | 15876 | 507 | 169 | S67247 | 394 | 1.1(10)-36 | Saccharomyces cerevisiae | yeast (saccharomycescerevisiae) hypothetical protein yor338w - |
| CONTIG5698 | 898457_f1_7 | 1774 | 15877 | 501 | 167 | S67269 | 292 | 6.7(10)-26 | Saccharomyces cerevisiae | yeast (saccharomycescerevisiae) hypothetical protein yor357c - |
| CONTIG3335 | 14425307_c3_3 | 1775 | 15878 | 1434 | 478 | S67283 | 198 | 2.3(10)-12 | Saccharomyces cerevisiae | yeast (saccharomycescerevisiae) hypothetical protein yor371c - |
| CONTIG5699 | 24007061_c2_28 | 1776 | 15879 | 1818 | 606 | S52526 | 207 | 2.1(10)-13 | Saccharomyces cerevisiae | yeast (saccharomycescerevisiae) hypothetical protein ypl005w - |
| CONTIG1935 | 3221407_f3_3 | 1777 | 15880 | 606 | 202 | S52522 | 473 | 5.2(10)-44 | Saccharomyces cerevisiae | yeast (saccharomycescerevisiae) hypothetical protein ypl009c - |
| b2x14507.y | 480083_f3_1 | 1778 | 15881 | 546 | 182 | S52522 | 133 | 1.2(10)-7 | Saccharomyces cerevisiae | yeast (saccharomycescerevisiae) hypothetical protein ypl009c - |
| CONTIG3925 | 4303879_c1_3 | 1779 | 15882 | 1233 | 411 | S52522 | 691 | 1.1(10)-67 | Saccharomyces cerevisiae | yeast (saccharomycescerevisiae) hypothetical protein ypl009c - |
| CONTIG2812 | 33786557_f1_1 | 1780 | 15883 | 315 | 105 | S52520 | 181 | 1.3(10)-13 | Saccharomyces cerevisiae | yeast (saccharomycescerevisiae) hypothetical protein ypl011c - |
| CONTIG5209 | 24480301_c1_8 | 1781 | 15884 | 1215 | 405 | S59679 | 93 | 0.11 | Saccharomyces cerevisiae | yeast (saccharomycescerevisiae) hypothetical protein ypl014w - |
| CONTIG3455 | 2118806_f2_2 | 1782 | 15885 | 348 | 116 | S63462 | 90 | 0.00259 | Saccharomyces cerevisiae | yeast (saccharomycescerevisiae) hypothetical protein ypl020c - |
| CONTIG4940 | 11109702_f3_3 | 1783 | 15886 | 1476 | 492 | S63462 | 425 | 7.2(10)-40 | Saccharomyces cerevisiae | yeast (saccharomycescerevisiae) hypothetical protein ypl020c - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5317 | 26775253_f3_11 | 1784 | 15887 | 510 | 170 | S63458 | 95 | 0.0051 | Saccharomyces cerevisiae | hypothetical protein ypl024w - yeast (saccharomycescerevisiae) |
| CONTIG3310 | 26261077_f1_1 | 1785 | 15888 | 249 | 83 | S63452 | 143 | 4.7(10)-9 | Saccharomyces cerevisiae | hypothetical protein ypl030w - yeast (saccharomycescerevisiae) |
| CONTIG3632 | 20329457_c2_8 | 1786 | 15889 | 1008 | 336 | S63452 | 502 | 1.7(10)-63 | Saccharomyces cerevisiae | hypothetical protein ypl030w - yeast (saccharomycescerevisiae) |
| CONTIG3949 | 9961006_f2_2 | 1787 | 15890 | 516 | 172 | S60927 | 294 | 9.5(10)-26 | Saccharomyces cerevisiae | hypothetical protein ypl063w - yeast (saccharomycescerevisiae) |
| CONTIG4163 | 16500028_c3_6 | 1788 | 15891 | 558 | 186 | S60925 | 262 | 1.0(10)-22 | Saccharomyces cerevisiae | hypothetical protein ypl065w - yeast (saccharomycescerevisiae) |
| CONTIG3302 | 4772187_f3_2 | 1789 | 15892 | 399 | 133 | S60923 | 142 | 5.2(10)-10 | Saccharomyces cerevisiae | hypothetical protein ypl067c - yeast (saccharomycescerevisiae) |
| CONTIG2472 | 5913918_f1_1 | 1790 | 15893 | 1263 | 421 | S61105 | 164 | 2.5(10)-9 | Saccharomyces cerevisiae | hypothetical protein ypl083c - yeast (saccharomycescerevisiae) |
| CONTIG3765 | 4457682_c1_5 | 1791 | 15894 | 1443 | 481 | S61980 | 2203 | 2.1(10)-228 | Saccharomyces cerevisiae | hypothetical protein ypl086c - yeast (saccharomycescerevisiae) |
| CONTIG2177 | 4879567_f3_2 | 1792 | 15895 | 1008 | 336 | S61973 | 1346 | 1.3(10)-137 | Saccharomyces cerevisiae | hypothetical protein ypl093w - yeast (saccharomycescerevisiae) |
| CONTIG4346 | 194657_c1_2 | 1793 | 15896 | 570 | 190 | S61973 | 360 | 2.0(10)-32 | Saccharomyces cerevisiae | hypothetical protein ypl093w - yeast (saccharomycescerevisiae) |
| CONTIG2762 | 24877343_f1_1 | 1794 | 15897 | 516 | 172 | S61970 | 215 | 4.0(10)-22 | Saccharomyces cerevisiae | hypothetical protein ypl096w - yeast (saccharomycescerevisiae) |
| CONTIG5200 | 174092_f2_4 | 1795 | 15898 | 1491 | 497 | S61997 | 544 | 1.2(10)-51 | Saccharomyces cerevisiae | hypothetical protein ypl125w - yeast (saccharomycescerevisiae) |
| b9x11u37.y | 29335425_c2_4 | 1796 | 15899 | 642 | 214 | S61997 | 396 | 9.5(10)-36 | Saccharomyces cerevisiae | hypothetical protein ypl125w - yeast (saccharomycescerevisiae) |
| CONTIG5666 | 24414052_c2_14 | 1797 | 15900 | 1287 | 429 | S69047 | 306 | 2.2(10)-27 | Saccharomyces cerevisiae | hypothetical protein ypl138c - yeast (saccharomycescerevisiae) |
| CONTIG4841 | 35573416_c3_6 | 1798 | 15901 | 1002 | 334 | S65157 | 239 | 2.3(10)-38 | Saccharomyces cerevisiae | hypothetical protein ypl146c - yeast (saccharomycescerevisiae) |
| CONTIG2343 | 5163282_c3_7 | 1799 | 15902 | 1026 | 342 | S65168 | 314 | 3.2(10)-28 | Saccharomyces cerevisiae | hypothetical protein ypl157w - yeast (saccharomycescerevisiae) |
| CONTIG5586 | 3929551_c3_18 | 1800 | 15903 | 1176 | 392 | S65176 | 450 | 1.2(10)-42 | Saccharomyces cerevisiae | hypothetical protein ypl165c - yeast (saccharomycescerevisiae) |
| CONTIG3690 | 10211532_c2_5 | 1801 | 15904 | 735 | 245 | S65180 | 394 | 2.0(10)-36 | Saccharomyces cerevisiae | hypothetical protein ypl169c - yeast (saccharomycescerevisiae) |
| CONTIG4361 | 38155_c2_9 | 1802 | 15905 | 963 | 321 | S65180 | 450 | 1.2(10)-42 | Saccharomyces cerevisiae | hypothetical protein ypl169c - yeast (saccharomycescerevisiae) |
| CONTIG4361 | 13704035_c2_8 | 1803 | 15906 | 513 | 171 | S65181 | 350 | 4.9(10)-32 | Saccharomyces cerevisiae | hypothetical protein ypl170w - yeast (saccharomycescerevisiae) |
| CONTIG5292 | 23694552_c1_10 | 1804 | 15907 | 1440 | 480 | S65193 | 220 | 6.4(10)-24 | Saccharomyces cerevisiae | hypothetical protein ypl181w - yeast (saccharomycescerevisiae) |
| CONTIG3555 | 3906336_c1_4 | 1805 | 15908 | 1482 | 494 | S65210 | 144 | 3.7(10)-11 | Saccharomyces cerevisiae | hypothetical protein ypl191c - yeast (saccharomycescerevisiae) |
| CONTIG5350 | 970187_f2_7 | 1806 | 15909 | 1494 | 498 | S65213 | 170 | 1.3(10)-9 | Saccharomyces cerevisiae | hypothetical protein ypl194w - yeast (saccharomycescerevisiae) |
| CONTIG2909 | 22166562_c3_6 | 1807 | 15910 | 243 | 81 | S65215 | 140 | 2.2(10)-9 | Saccharomyces cerevisiae | hypothetical protein ypl196w - yeast (saccharomycescerevisiae) |
| CONTIG5350 | 23875762_c2_15 | 1808 | 15911 | 1083 | 361 | S65215 | 297 | 4.7(10)-42 | Saccharomyces cerevisiae | hypothetical protein ypl196w - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1085 | 23550143_f1_1 | 1809 | 15912 | 603 | 201 | S65218 | 355 | 1.3(10)-32 | Saccharomyces cerevisiae | yeast (saccharomycescerevisiae) hypothetical protein ypl199c- |
| CONTIG590 | 4171931_f3_1 | 1810 | 15913 | 555 | 185 | S65230 | 789 | 1.5(10)-78 | Saccharomyces cerevisiae | yeast (saccharomycescerevisiae) hypothetical protein ypl211w- |
| CONTIG4363 | 239536_f3_5 | 1811 | 15914 | 729 | 243 | S65232 | 246 | 5.0(10)-21 | Saccharomyces cerevisiae | yeast (saccharomycescerevisiae) hypothetical protein ypl213w- |
| CONTIG4264 | 12694693_c2_7 | 1812 | 15915 | 276 | 92 | S65241 | 116 | 4.7(10)-6 | Saccharomyces cerevisiae | yeast (saccharomycescerevisiae) hypothetical protein ypl222w- |
| CONTIG5334 | 24017176_c1_7 | 1813 | 15916 | 468 | 156 | S65244 | 439 | 1.8(10)-41 | Saccharomyces cerevisiae | yeast (saccharomycescerevisiae) hypothetical protein ypl225w- |
| CONTIG5624 | 35312876_f3_8 | 1814 | 15917 | 1584 | 528 | S61706 | 322 | 2.1(10)-34 | Saccharomyces cerevisiae | yeast (saccharomycescerevisiae) hypothetical protein ypl228w- |
| CONTIG5661 | 25439030_c2_10 | 1815 | 15918 | 738 | 246 | S61706 | 269 | 1.0(10)-22 | Saccharomyces cerevisiae | yeast (saccharomycescerevisiae) hypothetical protein ypl228w- |
| CONTIG3371 | 23938802_f2_2 | 1816 | 15919 | 732 | 244 | S61701 | 212 | 2.0(10)-17 | Saccharomyces cerevisiae | yeast (saccharomycescerevisiae) hypothetical protein ypl233w- |
| CONTIG3515 | 110637_c3_6 | 1817 | 15920 | 1524 | 508 | S61029 | 1782 | 8.6(10)-184 | Saccharomyces cerevisiae | yeast (saccharomycescerevisiae) hypothetical protein ypl235w- |
| CONTIG5539 | 10719063_c2_12 | 1818 | 15921 | 279 | 93 | S61017 | 103 | 2.2(10)-9 | Saccharomyces cerevisiae | yeast (saccharomycescerevisiae) hypothetical protein ypl247c- |
| CONTIG5578 | 39076812_f3_5 | 1819 | 15922 | 1509 | 503 | S61017 | 442 | 3.1(10)-55 | Saccharomyces cerevisiae | yeast (saccharomycescerevisiae) hypothetical protein ypl247c- |
| CONTIG5815 | 14570181_f1_6 | 1820 | 15923 | 1659 | 553 | S61015 | 827 | 1.3(10)-82 | Saccharomyces cerevisiae | yeast (saccharomycescerevisiae) hypothetical protein ypl249c- |
| CONTIG5344 | 22915995_f3_10 | 1821 | 15924 | 615 | 205 | S61012 | 343 | 2.7(10)-31 | Saccharomyces cerevisiae | yeast (saccharomycescerevisiae) hypothetical protein ypl252c- |
| CONTIG5565 | 24020003_c1_22 | 1822 | 15925 | 1953 | 651 | S65296 | 796 | 2.2(10)-129 | Saccharomyces cerevisiae | yeast (saccharomycescerevisiae) hypothetical protein ypl263c- |
| CONTIG683 | 12691692_f1_1 | 1823 | 15926 | 894 | 298 | S65302 | 139 | 1.2(10)-6 | Saccharomyces cerevisiae | yeast (saccharomycescerevisiae) hypothetical protein ypl269w- |
| CONTIG5575 | 30515575_f3_8 | 1824 | 15927 | 1578 | 526 | S52820 | 113 | 0.00309 | Saccharomyces cerevisiae | yeast (saccharomycescerevisiae) hypothetical protein ypr007c- |
| CONTIG5434 | 10348402_c2_7 | 1825 | 15928 | 789 | 263 | S57550 | 1170 | 6.2(10)-119 | Saccharomyces cerevisiae | yeast (saccharomycescerevisiae) hypothetical protein ypr016c- |
| b9x11g23.x | 23594413_f2_1 | 1826 | 15929 | 243 | 81 | S54497 | 159 | 4.7(10)-11 | Saccharomyces cerevisiae | yeast (saccharomycescerevisiae) hypothetical protein ypr023c- |
| CONTIG5491 | 23617062_c3_13 | 1827 | 15930 | 1170 | 390 | S61061 | 578 | 3.3(10)-56 | Saccharomyces cerevisiae | yeast (saccharomycescerevisiae) hypothetical protein ypr040w- |
| CONTIG3651 | 4790902_c2_2 | 1828 | 15931 | 1011 | 337 | S69063 | 91 | 8.4(10)-5 | Saccharomyces cerevisiae | yeast (saccharomycescerevisiae) hypothetical protein ypr075c- |
| CONTIG4087 | 9975186_c3_4 | 1829 | 15932 | 969 | 323 | S69065 | 316 | 1.8(10)-28 | Saccharomyces cerevisiae | yeast (saccharomycescerevisiae) hypothetical protein ypr079w- |
| CONTIG5154 | 36362812_f2_4 | 1830 | 15933 | 453 | 151 | S69068 | 528 | 6.7(10)-51 | Saccharomyces cerevisiae | yeast (saccharomycescerevisiae) hypothetical protein ypr082c- |
| CONTIG4864 | 4490801_c2_10 | 1831 | 15934 | 1017 | 339 | S69070 | 365 | 1.2(10)-33 | Saccharomyces cerevisiae | yeast (saccharomycescerevisiae) hypothetical protein ypr084w- |
| CONTIG3878 | 7144105_c1_4 | 1832 | 15935 | 1623 | 541 | S69074 | 257 | 9.8(10)-38 | Saccharomyces cerevisiae | yeast (saccharomycescerevisiae) hypothetical protein ypr090w- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2912 | 26269501_c3_8 | 1833 | 15936 | 1326 | 442 | S69075 | 214 | 9.5(10)-15 | Saccharomyces cerevisiae | hypothetical protein ypr091c - yeast (saccharomycescerevisiae) |
| CONTIG3060 | 12128176_c2_5 | 1834 | 15937 | 1602 | 534 | S69075 | 367 | 3.6(10)-53 | Saccharomyces cerevisiae | hypothetical protein ypr091c - yeast (saccharomycescerevisiae) |
| CONTIG4806 | 10969030_f1_3 | 1835 | 15938 | 366 | 122 | S69077 | 326 | 1.7(10)-29 | Saccharomyces cerevisiae | hypothetical protein ypr094w - yeast (saccharomycescerevisiae) |
| CONTIG3317 | 2166288_c2_9 | 1836 | 15939 | 780 | 260 | S69079 | 293 | 1.1(10)-24 | Saccharomyces cerevisiae | hypothetical protein ypr097w - yeast (saccharomycescerevisiae) |
| CONTIG4173 | 2131385_c1_5 | 1837 | 15940 | 882 | 294 | S69773 | 819 | 9.6(10)-82 | Saccharomyces cerevisiae | hypothetical protein ypr108w - yeast (saccharomycescerevisiae) |
| CONTIG5341 | 10744077_c1_16 | 1838 | 15941 | 1866 | 622 | S59777 | 1490 | 7.5(10)-153 | Saccharomyces cerevisiae | hypothetical protein ypr112c - yeast (saccharomycescerevisiae) |
| CONTIG5341 | 2110650_c2_17 | 1839 | 15942 | 321 | 107 | S59777 | 244 | 1.3(10)-19 | Saccharomyces cerevisiae | hypothetical protein ypr112c - yeast (saccharomycescerevisiae) |
| CONTIG5054 | 9788202_c1_7 | 1840 | 15943 | 876 | 292 | S69019 | 407 | 4.4(10)-38 | Saccharomyces cerevisiae | hypothetical protein ypr128c - yeast (saccharomycescerevisiae) |
| CONTIG5247 | 3251562_c3_20 | 1841 | 15944 | 249 | 83 | S69019 | 123 | 2.7(10)-7 | Saccharomyces cerevisiae | hypothetical protein ypr128c - yeast (saccharomycescerevisiae) |
| CONTIG2405 | 14172182_c1_3 | 1842 | 15945 | 1263 | 421 | S69026 | 587 | 4.2(10)-67 | Saccharomyces cerevisiae | hypothetical protein ypr137w - yeast (saccharomycescerevisiae) |
| CONTIG5223 | 35949128_f1_2 | 1843 | 15946 | 1035 | 345 | S69028 | 141 | 2.1(10)-7 | Saccharomyces cerevisiae | hypothetical protein ypr139c - yeast (saccharomycescerevisiae) |
| CONTIG5789 | 24306563_c2_27 | 1844 | 15947 | 1341 | 447 | S69029 | 633 | 7.0(10)-115 | Saccharomyces cerevisiae | hypothetical protein ypr140w - yeast (saccharomycescerevisiae) |
| CONTIG1570 | 9852291_f3_3 | 1845 | 15948 | 204 | 68 | S69031 | 157 | 1.5(10)-11 | Saccharomyces cerevisiae | hypothetical protein ypr143w - yeast (saccharomycescerevisiae) |
| CONTIG4164 | 26382812_f2_2 | 1846 | 15949 | 705 | 235 | S69031 | 355 | 1.3(10)-32 | Saccharomyces cerevisiae | hypothetical protein ypr143w - yeast (saccharomycescerevisiae) |
| CONTIG2759 | 35953288_f1_1 | 1847 | 15950 | 975 | 325 | S69032 | 541 | 2.7(10)-52 | Saccharomyces cerevisiae | hypothetical protein ypr144c - yeast (saccharomycescerevisiae) |
| CONTIG3152 | 24800343_c2_8 | 1848 | 15951 | 225 | 75 | S69034 | 96 | 0.00021 | Saccharomyces cerevisiae | hypothetical protein ypr147c - yeast (saccharomycescerevisiae) |
| CONTIG3152 | 12681385_c2_7 | 1849 | 15952 | 765 | 255 | S69034 | 170 | 1.5(10)-11 | Saccharomyces cerevisiae | hypothetical protein ypr147c - yeast (saccharomycescerevisiae) |
| CONTIG5244 | 23630132_c3_16 | 1850 | 15953 | 996 | 332 | S59828 | 384 | 1.2(10)-35 | Saccharomyces cerevisiae | hypothetical protein ypr169w - yeast (saccharomycescerevisiae) |
| CONTIG5244 | 13832575_c1_11 | 1851 | 15954 | 636 | 212 | S59828 | 327 | 2.7(10)-29 | Saccharomyces cerevisiae | hypothetical protein ypr169w - yeast (saccharomycescerevisiae) |
| CONTIG2056 | 19704752_c3_3 | 1852 | 15955 | 1320 | 440 | S59836 | 144 | 1.1(10)-25 | Saccharomyces cerevisiae | hypothetical protein ypr179c - yeast (saccharomycescerevisiae) |
| CONTIG66 | 12600452_c2_2 | 1853 | 15956 | 267 | 89 | S69459 | 137 | 1.8(10)-9 | Saccharomyces cerevisiae | hypothetical protein ypr197c - yeast (saccharomycescerevisiae) |
| CONTIG5739 | 2757307_c2_25 | 1854 | 15957 | 1596 | 532 | S47455 | 200 | 2.0(10)-12 | Saccharomyces cerevisiae | mdm1 protein - yeast (saccharomycescerevisiae) |
| b9x10b37.y | 26368813_f2_2 | 1855 | 15958 | 459 | 153 | S57976 | 109 | 0.0064 | Saccharomyces cerevisiae | nuclear migration protein num1 - yeast (saccharomycescerevisiae) |
| CONTIG1390 | 32429582_f2_1 | 1856 | 15959 | 756 | 252 | S62011 | 188 | 2.1(10)-13 | Saccharomyces cerevisiae | pho85 protein - yeast (saccharomyces cerevisiae) |
| CONTIG3594 | 1429625_c1_6 | 1857 | 15960 | 264 | 88 | S62011 | 113 | 2.0(10)-5 | Saccharomyces cerevisiae | pho85 protein - yeast |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5491 | 7277062_c1_9 | 1858 | 15961 | 2421 | 807 | S62011 | 980 | 2.5(10)-140 | Saccharomyces cerevisiae | pho85 protein - yeast (saccharomyces cerevisiae) |
| CONTIG2454 | 5867026_c2_4 | 1859 | 15962 | 420 | 140 | S65200 | 102 | 1.7(10)-11 | Saccharomyces cerevisiae | pos5 protein - yeast (saccharomyces cerevisiae) |
| CONTIG35 | 33400325_c3_4 | 1860 | 15963 | 627 | 209 | S59296 | 120 | 8.3(10)-7 | Saccharomyces cerevisiae | probable finger protein yol054w - yeast (saccharomycescerevisiae) |
| CONTIG667 | 14085885_f1_1 | 1861 | 15964 | 564 | 188 | S50981 | 109 | 1.3(10)-5 | Saccharomyces cerevisiae | probable membrane protein ydl001w - yeast (saccharomycescerevisiae) |
| CONTIG988 | 24611028_c2_2 | 1862 | 15965 | 597 | 199 | S50981 | 665 | 2.0(10)-65 | Saccharomyces cerevisiae | probable membrane protein ydl001w - yeast (saccharomycescerevisiae) |
| CONTIG1094 | 35438932_f2_2 | 1863 | 15966 | 243 | 81 | S52507 | 115 | 3.8(10)-7 | Saccharomyces cerevisiae | probable membrane protein ydl012c - yeast (saccharomycescerevisiae) |
| CONTIG1530 | 13142916_f3_2 | 1864 | 15967 | 894 | 298 | S52504 | 399 | 3.1(10)-37 | Saccharomyces cerevisiae | probable membrane protein ydl015c - yeast (saccharomycescerevisiae) |
| CONTIG2203 | 22713577_c1_4 | 1865 | 15968 | 1320 | 440 | S67568 | 169 | 1.8(10)-9 | Saccharomyces cerevisiae | probable membrane protein ydl035c - yeast (saccharomycescerevisiae) |
| CONTIG5432 | 4322161_c1_18 | 1866 | 15969 | 1320 | 440 | S67589 | 329 | 5.4(10)-46 | Saccharomyces cerevisiae | probable membrane protein ydl054c - yeast (saccharomycescerevisiae) |
| CONTIG4382 | 6739075_c3_4 | 1867 | 15970 | 1305 | 435 | S67598 | 300 | 6.2(10)-26 | Saccharomyces cerevisiae | probable membrane protein ydl063c - yeast (saccharomycescerevisiae) |
| CONTIG5027 | 9796950_f1_1 | 1868 | 15971 | 2094 | 698 | S67610 | 505 | 8.0(10)-62 | Saccharomyces cerevisiae | probable membrane protein ydl074c - yeast (saccharomycescerevisiae) |
| CONTIG531 | 24305432_f3_1 | 1869 | 15972 | 855 | 285 | S67627 | 108 | 0.00068 | Saccharomyces cerevisiae | probable membrane protein ydl091c - yeast (saccharomycescerevisiae) |
| b9x12p19.x | 4017818_c3_2 | 1870 | 15973 | 699 | 233 | S67655 | 287 | 7.2(10)-24 | Saccharomyces cerevisiae | probable membrane protein ydl112w - yeast (saccharomycescerevisiae) |
| CONTIG2633 | 10442599_c1_4 | 1871 | 15974 | 1485 | 495 | S67655 | 620 | 3.1(10)-86 | Saccharomyces cerevisiae | probable membrane protein ydl112w - yeast (saccharomycescerevisiae) |
| CONTIG1661 | 25585925_c3_3 | 1872 | 15975 | 762 | 254 | S67679 | 303 | 4.5(10)-27 | Saccharomyces cerevisiae | probable membrane protein ydl133w - yeast (saccharomycescerevisiae) |
| CONTIG3866 | 10973426_c3_4 | 1873 | 15976 | 1077 | 359 | S67691 | 469 | 1.2(10)-44 | Saccharomyces cerevisiae | probable membrane protein ydl144c - yeast (saccharomycescerevisiae) |
| b2x14977.x | 9953207_c2_1 | 1874 | 15977 | 609 | 203 | S67696 | 173 | 4.0(10)-12 | Saccharomyces cerevisiae | probable membrane protein ydl148c - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11904.x | 26350250_f3_1 | 1875 | 15978 | 546 | 182 | S67696 | 239 | 4.0(10)-19 | Saccharomyces cerevisiae | probable membrane protein ydl148c - yeast (saccharomycescerevisiae) |
| CONTIG4991 | 16907808_f2_1 | 1876 | 15979 | 1608 | 536 | S67697 | 361 | 1.6(10)-58 | Saccharomyces cerevisiae | probable membrane protein ydl149w - yeast (saccharomycescerevisiae) |
| CONTIG924 | 13754782_f3_2 | 1877 | 15980 | 735 | 245 | S67697 | 268 | 4.5(10)-22 | Saccharomyces cerevisiae | probable membrane protein ydl149w - yeast (saccharomycescerevisiae) |
| CONTIG5563 | 24786090_c1_18 | 1878 | 15981 | 183 | 61 | S58784 | 213 | 4.0(10)-17 | Saccharomyces cerevisiae | probable membrane protein ydl193w - yeast (saccharomycescerevisiae) |
| CONTIG5563 | 34062507_c3_25 | 1879 | 15982 | 954 | 318 | S58784 | 327 | 1.3(10)-29 | Saccharomyces cerevisiae | probable membrane protein ydl193w - yeast (saccharomycescerevisiae) |
| CONTIG4890 | 15645035_f1_1 | 1880 | 15983 | 1206 | 402 | S67801 | 282 | 4.0(10)-39 | Saccharomyces cerevisiae | probable membrane protein ydl237w - yeast (saccharomycescerevisiae) |
| CONTIG4770 | 167707_f3_4 | 1881 | 15984 | 645 | 215 | S50934 | 189 | 1.1(10)-13 | Saccharomyces cerevisiae | probable membrane protein ydr027c - yeast (saccharomycescerevisiae) |
| CONTIG4949 | 25660878_c3_9 | 1882 | 15985 | 1464 | 488 | S50934 | 299 | 4.0(10)-26 | Saccharomyces cerevisiae | probable membrane protein ydr027c - yeast (saccharomycescerevisiae) |
| CONTIG5689 | 15864033_c2_19 | 1883 | 15986 | 900 | 300 | S54034 | 241 | 5.5(10)-39 | Saccharomyces cerevisiae | probable membrane protein ydr049w - yeast (saccharomycescerevisiae) |
| CONTIG1573 | 33298575_f2_1 | 1884 | 15987 | 651 | 217 | S54044 | 600 | 9.9(10)-58 | Saccharomyces cerevisiae | probable membrane protein ydr060w - yeast (saccharomycescerevisiae) |
| CONTIG1574 | 412817_c2_4 | 1885 | 15988 | 537 | 179 | S54044 | 110 | 3.3(10)-5 | Saccharomyces cerevisiae | probable membrane protein ydr060w - yeast (saccharomycescerevisiae) |
| b9x12u01.y | 24397507_c3_2 | 1886 | 15989 | 615 | 205 | S54044 | 659 | 3.3(10)-64 | Saccharomyces cerevisiae | probable membrane protein ydr060w - yeast (saccharomycescerevisiae) |
| CONTIG4672 | 21642137_c1_7 | 1887 | 15990 | 771 | 257 | S58090 | 611 | 1.1(10)-59 | Saccharomyces cerevisiae | probable membrane protein ydr090c - yeast (saccharomycescerevisiae) |
| CONTIG5210 | 25650426_c1_9 | 1888 | 15991 | 489 | 163 | S51251 | 192 | 2.7(10)-15 | Saccharomyces cerevisiae | probable membrane protein ydr100w - yeast (saccharomycescerevisiae) |
| CONTIG2110 | 26854540_c2_3 | 1889 | 15992 | 819 | 273 | S51252 | 483 | 3.8(10)-46 | Saccharomyces cerevisiae | probable membrane protein ydr101c - yeast (saccharomycescerevisiae) |
| CONTIG5666 | 4417200_c3_17 | 1890 | 15993 | 840 | 280 | S51252 | 500 | 2.8(10)-76 | Saccharomyces cerevisiae | probable membrane protein ydr101c - yeast (saccharomycescerevisiae) |
| CONTIG5138 | 11132692_f1_1 | 1891 | 15994 | 2010 | 670 | S51255 | 409 | 1.2(10)-62 | Saccharomyces cerevisiae | probable membrane protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1266 | 35599056_f2_1 | 1892 | 15995 | 1188 | 396 | S51256 | 867 | 8.0(10)-87 | Saccharomyces cerevisiae | ydr104c - yeast (saccharomycescerevisiae) probable membrane protein ydr105c - yeast |
| CONTIG1176 | 29424150_f3_1 | 1893 | 15996 | 831 | 277 | S52675 | 296 | 1.7(10)-39 | Saccharomyces cerevisiae | (saccharomycescerevisiae) probable membrane protein ydr109c - yeast |
| CONTIG187 | 6052217_f3_1 | 1894 | 15997 | 363 | 121 | S52675 | 157 | 2.1(10)-10 | Saccharomyces cerevisiae | (saccharomycescerevisiae) probable membrane protein ydr109c - yeast |
| CONTIG720 | 29344642_f3_3 | 1895 | 15998 | 963 | 321 | S52675 | 942 | 9.0(10)-95 | Saccharomyces cerevisiae | (saccharomycescerevisiae) probable membrane protein ydr126w - yeast |
| CONTIG1663 | 113907_f1_1 | 1896 | 15999 | 717 | 239 | S52691 | 341 | 4.4(10)-31 | Saccharomyces cerevisiae | (saccharomycescerevisiae) probable membrane protein ydr141c - yeast |
| CONTIG3848 | 24875300_f1_1 | 1897 | 16000 | 2064 | 688 | S51869 | 460 | 7.2(10)-41 | Saccharomyces cerevisiae | (saccharomycescerevisiae) probable membrane protein ydr141c - yeast |
| CONTIG5191 | 25571937_c2_10 | 1898 | 16001 | 2112 | 704 | S51869 | 401 | 8.1(10)-62 | Saccharomyces cerevisiae | (saccharomycescerevisiae) probable membrane protein ydr161w - yeast |
| CONTIG2041 | 25548438_f3_1 | 1899 | 16002 | 1053 | 351 | S57985 | 280 | 1.8(10)-42 | Saccharomyces cerevisiae | (saccharomycescerevisiae) probable membrane protein ydr165w - yeast |
| CONTIG4113 | 20585202_f3_2 | 1900 | 16003 | 1131 | 377 | S57989 | 399 | 3.1(10)-37 | Saccharomyces cerevisiae | (saccharomycescerevisiae) probable membrane protein ydr198c - yeast |
| CONTIG4689 | 390637_f2_3 | 1901 | 16004 | 1341 | 447 | S52705 | 280 | 2.1(10)-35 | Saccharomyces cerevisiae | (saccharomycescerevisiae) probable membrane protein ydr200c - yeast |
| CONTIG2356 | 23948386_f1_1 | 1902 | 16005 | 747 | 249 | S52706 | 95 | 0.02599 | Saccharomyces cerevisiae | (saccharomycescerevisiae) probable membrane protein ydr205w - yeast |
| CONTIG5794 | 4876438_f2_8 | 1903 | 16006 | 339 | 113 | S61568 | 120 | 2.0(10)-6 | Saccharomyces cerevisiae | (saccharomycescerevisiae) probable membrane protein ydr231c - yeast |
| CONTIG2458 | 9765686_c1_2 | 1904 | 16007 | 618 | 206 | S59437 | 265 | 4.9(10)-23 | Saccharomyces cerevisiae | (saccharomycescerevisiae) probable membrane protein ydr233c - yeast |
| CONTIG5163 | 179502_c2_7 | 1905 | 16008 | 1125 | 375 | S59439 | 366 | 9.8(10)-34 | Saccharomyces cerevisiae | (saccharomycescerevisiae) probable membrane protein ydr236c - yeast |
| CONTIG850 | 30360635_c3_3 | 1906 | 16009 | 381 | 127 | S54532 | 245 | 6.5(10)-21 | Saccharomyces cerevisiae | (saccharomycescerevisiae) probable membrane protein ydr262w - yeast |
| CONTIG4231 | 26445327_f2_4 | 1907 | 16010 | 564 | 188 | S61117 | 119 | 3.3(10)-6 | Saccharomyces cerevisiae | (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5309 | 5316_c1_9 | 1908 | 16011 | 1413 | 471 | S61202 | 663 | 2.6(10)-75 | Saccharomyces cerevisiae | probable membrane protein ydr316w - yeast (saccharomycescerevisiae) |
| CONTIG3590 | 30476455_c3_4 | 1909 | 16012 | 1272 | 424 | S59791 | 278 | 7.4(10)-36 | Saccharomyces cerevisiae | probable membrane protein ydr325w - yeast (saccharomycescerevisiae) |
| CONTIG4280 | 32612552_f1_1 | 1910 | 16013 | 2586 | 862 | S59791 | 525 | 4.5(10)-59 | Saccharomyces cerevisiae | probable membrane protein ydr325w - yeast (saccharomycescerevisiae) |
| CONTIG5710 | 14649053_f3_8 | 1911 | 16014 | 2334 | 778 | S59792 | 402 | 4.5(10)-37 | Saccharomyces cerevisiae | probable membrane protein ydr326c - yeast (saccharomycescerevisiae) |
| CONTIG4221 | 29400278_c1_4 | 1912 | 16015 | 741 | 247 | S61149 | 140 | 5.7(10)-14 | Saccharomyces cerevisiae | probable membrane protein ydr352w - yeast (saccharomycescerevisiae) |
| CONTIG4267 | 4084555_c2_4 | 1913 | 16016 | 1584 | 528 | S62018 | 1586 | 5.0(10)-163 | Saccharomyces cerevisiae | probable membrane protein ydr539w - yeast (saccharomycescerevisiae) |
| CONTIG4639 | 1194053_c3_5 | 1914 | 16017 | 2034 | 678 | S64747 | 429 | 4.5(10)-38 | Saccharomyces cerevisiae | probable membrane protein yll005c - yeast (saccharomycescerevisiae) |
| CONTIG3769 | 14879541_f2_2 | 1915 | 16018 | 1218 | 406 | S64749 | 114 | 6.2(10)-7 | Saccharomyces cerevisiae | probable membrane protein yll007c - yeast (saccharomycescerevisiae) |
| CONTIG4424 | 22287825_c3_8 | 1916 | 16019 | 351 | 117 | S64756 | 184 | 1.8(10)-14 | Saccharomyces cerevisiae | probable membrane protein yll014w - yeast (saccharomycescerevisiae) |
| CONTIG3955 | 2134385_c2_6 | 1917 | 16020 | 1125 | 375 | S64782 | 401 | 6.5(10)-63 | Saccharomyces cerevisiae | probable membrane protein yll031c - yeast (saccharomycescerevisiae) |
| CONTIG3955 | 173811_c1_3 | 1918 | 16021 | 378 | 126 | S64782 | 134 | 9.4(10)-8 | Saccharomyces cerevisiae | probable membrane protein yll031c - yeast (saccharomycescerevisiae) |
| CONTIG3955 | 13907813_c3_7 | 1919 | 16022 | 921 | 307 | S64782 | 516 | 1.2(10)-48 | Saccharomyces cerevisiae | probable membrane protein yll031c - yeast (saccharomycescerevisiae) |
| CONTIG3955 | 22525036_c2_5 | 1920 | 16023 | 270 | 90 | S64782 | 103 | 0.00019 | Saccharomyces cerevisiae | probable membrane protein yll031c - yeast (saccharomycescerevisiae) |
| CONTIG490 | 22447182_c2_2 | 1921 | 16024 | 489 | 163 | S64782 | 320 | 1.3(10)-27 | Saccharomyces cerevisiae | probable membrane protein yll031c - yeast (saccharomycescerevisiae) |
| CONTIG677 | 20595325_f1_1 | 1922 | 16025 | 792 | 264 | S64783 | 122 | 0.00011 | Saccharomyces cerevisiae | probable membrane protein yll032c - yeast (saccharomycescerevisiae) |
| CONTIG3532 | 29417632_c1_9 | 1923 | 16026 | 1008 | 336 | S64821 | 165 | 3.1(10)-9 | Saccharomyces cerevisiae | probable membrane protein ylr001c - yeast |
| CONTIG3532 | 13885817_c3_11 | 1924 | 16027 | 681 | 227 | S64821 | 118 | 0.00025 | Saccharomyces cerevisiae | probable membrane protein ylr001c - yeast |
| CONTIG5361 | 24413557_f3_4 | 1925 | 16028 | 1185 | 395 | S64821 | 157 | 3.2(10)-8 | Saccharomyces cerevisiae | probable membrane protein ylr001c - yeast (saccharomycescerevisiae) |
| CONTIG1738 | 21540800_f3_4 | 1926 | 16029 | 738 | 246 | S64850 | 212 | 1.8(10)-30 | Saccharomyces cerevisiae | probable membrane protein ylr023c - yeast |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2702 | 21535661_f2_3 | 1927 | 16030 | 753 | 251 | S61621 | 497 | 1.3(10)-47 | *Saccharomyces cerevisiae* | probable membrane protein ylr047c - yeast (*saccharomycescerevisiae*) |
| CONTIG3389 | 30704662_c3_5 | 1928 | 16031 | 231 | 77 | S61621 | 131 | 1.2(10)-7 | *Saccharomyces cerevisiae* | probable membrane protein ylr047c - yeast (*saccharomycescerevisiae*) |
| CONTIG4951 | 22378806_c1_11 | 1929 | 16032 | 540 | 180 | S61624 | 272 | 9.0(10)-24 | *Saccharomyces cerevisiae* | probable membrane protein ylr050c - yeast (*saccharomycescerevisiae*) |
| CONTIG4625 | 788876_c2_7 | 1930 | 16033 | 840 | 280 | S61637 | 128 | 3.1(10)-6 | *Saccharomyces cerevisiae* | probable membrane protein ylr064w - yeast (*saccharomycescerevisiae*) |
| CONTIG569 | 437802_f1_1 | 1931 | 16034 | 528 | 176 | S61637 | 105 | 0.00016 | *Saccharomyces cerevisiae* | probable membrane protein ylr064w - yeast (*saccharomycescerevisiae*) |
| CONTIG4013 | 12911436_c2_3 | 1932 | 16035 | 600 | 200 | S61638 | 134 | 3.7(10)-9 | *Saccharomyces cerevisiae* | probable membrane protein ylr065c - yeast (*saccharomycescerevisiae*) |
| CONTIG2334 | 12148388_c2_5 | 1933 | 16036 | 837 | 279 | S64909 | 94 | 0.00024 | *Saccharomyces cerevisiae* | probable membrane protein ylr077w - yeast (*saccharomycescerevisiae*) |
| CONTIG1328 | 24398567_c1_2 | 1934 | 16037 | 360 | 120 | S64916 | 110 | 4.2(10)-5 | *Saccharomyces cerevisiae* | probable membrane protein ylr084c - yeast (*saccharomycescerevisiae*) |
| CONTIG2422 | 24256955_c2_1 | 1935 | 16038 | 1251 | 417 | S64916 | 113 | 0.00479 | *Saccharomyces cerevisiae* | probable membrane protein ylr084c - yeast (*saccharomycescerevisiae*) |
| CONTIG3100 | 9803588_c1_3 | 1936 | 16039 | 1428 | 476 | S64916 | 245 | 1.0(10)-31 | *Saccharomyces cerevisiae* | probable membrane protein ylr084c - yeast (*saccharomycescerevisiae*) |
| CONTIG3100 | 6702_c3_4 | 1937 | 16040 | 306 | 102 | S64916 | 98 | 0.0008 | *Saccharomyces cerevisiae* | probable membrane protein ylr084c - yeast (*saccharomycescerevisiae*) |
| CONTIG2569 | 33245403_f1_1 | 1938 | 16041 | 1158 | 386 | S64921 | 403 | 3.3(10)-43 | *Saccharomyces cerevisiae* | probable membrane protein ylr087c - yeast (*saccharomycescerevisiae*) |
| CONTIG3051 | 3179660_c2_3 | 1939 | 16042 | 1173 | 391 | S64921 | 682 | 2.0(10)-65 | *Saccharomyces cerevisiae* | probable membrane protein ylr087c - yeast (*saccharomycescerevisiae*) |
| CONTIG4581 | 1204592_c3_9 | 1940 | 16043 | 3516 | 1172 | S64921 | 522 | 5.2(10)-70 | *Saccharomyces cerevisiae* | probable membrane protein ylr087c - yeast (*saccharomycescerevisiae*) |
| CONTIG5053 | 26438163_f1_1 | 1941 | 16044 | 1755 | 585 | S64921 | 470 | 3.7(10)-62 | *Saccharomyces cerevisiae* | probable membrane protein ylr087c - yeast (*saccharomycescerevisiae*) |
| b9x12p78.x | 5860930_f2_1 | 1942 | 16045 | 774 | 258 | S64921 | 259 | 1.7(10)-20 | *Saccharomyces cerevisiae* | probable membrane protein ylr087c - yeast (*saccharomycescerevisiae*) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5784 | 24407557_f3_10 | 1943 | 16046 | 1125 | 375 | S64936 | 1022 | 3.0(10)-103 | Saccharomyces cerevisiae | probable membrane protein yll100w - yeast (saccharomycescerevisiae) |
| CONTIG3642 | 24082581_c3_8 | 1944 | 16047 | 435 | 145 | S64940 | 286 | 2.8(10)-25 | Saccharomyces cerevisiae | probable membrane protein ylr104w - yeast (saccharomycescerevisiae) |
| CONTIG1723 | 2456527_c3_6 | 1945 | 16048 | 555 | 185 | S64942 | 106 | 0.02 | Saccharomyces cerevisiae | probable membrane protein ylr106c - yeast (saccharomycescerevisiae) |
| CONTIG2171 | 20523377_c1_2 | 1946 | 16049 | 1350 | 450 | S64942 | 453 | 7.5(10)-41 | Saccharomyces cerevisiae | probable membrane protein ylr106c - yeast (saccharomycescerevisiae) |
| CONTIG3775 | 36523586_c1_5 | 1947 | 16050 | 2103 | 701 | S64942 | 1778 | 1.7(10)-181 | Saccharomyces cerevisiae | probable membrane protein ylr106c - yeast (saccharomycescerevisiae) |
| CONTIG5074 | 15911718_f1_1 | 1948 | 16051 | 4014 | 1338 | S64942 | 4108 | 0 | Saccharomyces cerevisiae | probable membrane protein ylr106c - yeast (saccharomycescerevisiae) |
| CONTIG822 | 33242937_f2_1 | 1949 | 16052 | 621 | 207 | S64942 | 211 | 3.6(10)-15 | Saccharomyces cerevisiae | probable membrane protein ylr106c - yeast (saccharomycescerevisiae) |
| b2x10142.x | 22367126_c3_2 | 1950 | 16053 | 528 | 176 | S64942 | 235 | 1.0(10)-17 | Saccharomyces cerevisiae | probable membrane protein ylr106c - yeast (saccharomycescerevisiae) |
| CONTIG4818 | 19569183_f2_3 | 1951 | 16054 | 774 | 258 | S64955 | 341 | 4.4(10)-31 | Saccharomyces cerevisiae | probable membrane protein ylr118c - yeast (saccharomycescerevisiae) |
| CONTIG5000 | 31144042_c3_10 | 1952 | 16055 | 255 | 85 | S64955 | 144 | 3.2(10)-10 | Saccharomyces cerevisiae | probable membrane protein ylr118c - yeast (saccharomycescerevisiae) |
| CONTIG4241 | 4980393_f1_1 | 1953 | 16056 | 657 | 219 | S59329 | 114 | 4.2(10)-11 | Saccharomyces cerevisiae | probable membrane protein ylr137w - yeast (saccharomycescerevisiae) |
| CONTIG27 | 22464832_c1_6 | 1954 | 16057 | 441 | 147 | S64994 | 93 | 0.00018 | Saccharomyces cerevisiae | probable membrane protein ylr145w - yeast (saccharomycescerevisiae) |
| CONTIG82 | 35816255_f1_1 | 1955 | 16058 | 624 | 208 | S64994 | 97 | 5.4(10)-7 | Saccharomyces cerevisiae | probable membrane protein ylr145w - yeast (saccharomycescerevisiae) |
| CONTIG3333 | 11804556_c1_3 | 1956 | 16059 | 1584 | 528 | S51422 | 417 | 7.2(10)-39 | Saccharomyces cerevisiae | probable membrane protein ylr177w - yeast (saccharomycescerevisiae) |
| CONTIG5437 | 23546930_c3_20 | 1957 | 16060 | 915 | 305 | S48556 | 348 | 7.9(10)-32 | Saccharomyces cerevisiae | probable membrane protein ylr205c - yeast (saccharomycescerevisiae) |
| CONTIG1471 | 10833318_f1_1 | 1958 | 16061 | 243 | 81 | S51445 | 178 | 1.3(10)-12 | Saccharomyces cerevisiae | probable membrane protein ylr222c - yeast (saccharomycescerevisiae) |
| CONTIG3451 | 4407635_c3_6 | 1959 | 16062 | 693 | 231 | S51445 | 560 | 4.5(10)-54 | Saccharomyces cerevisiae | probable membrane protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG602 | 433267_f1_1 | 1960 | 16063 | 744 | 248 | S51445 | 649 | 1.0(10)-63 | Saccharomyces cerevisiae | ylr222c - yeast (saccharomycescerevisiae) |
| CONTIG4367 | 422500_c1_4 | 1961 | 16064 | 2217 | 739 | S59387 | 1099 | 2.5(10)-153 | Saccharomyces cerevisiae | probable membrane protein ylr222c - yeast (saccharomycescerevisiae) |
| CONTIG4897 | 4688425_c3_5 | 1962 | 16065 | 1989 | 663 | S59387 | 828 | 6.7(10)-124 | Saccharomyces cerevisiae | probable membrane protein ylr241w - yeast (saccharomycescerevisiae) |
| CONTIG1938 | 14219817_c3_7 | 1963 | 16066 | 939 | 313 | S59388 | 219 | 6.0(10)-29 | Saccharomyces cerevisiae | probable membrane protein ylr241w - yeast (saccharomycescerevisiae) |
| CONTIG5794 | 7047711_f2_9 | 1964 | 16067 | 1011 | 337 | S59389 | 1059 | 3.6(10)-107 | Saccharomyces cerevisiae | probable membrane protein ylr242c - yeast (saccharomycescerevisiae) |
| CONTIG4249 | 14089037_f2_3 | 1965 | 16068 | 1227 | 409 | S59392 | 308 | 8.3(10)-35 | Saccharomyces cerevisiae | probable membrane protein ylr243w - yeast (saccharomycescerevisiae) |
| CONTIG1033 | 34120706_f1_1 | 1966 | 16069 | 807 | 269 | S59398 | 432 | 1.3(10)-59 | Saccharomyces cerevisiae | probable membrane protein ylr246w - yeast (saccharomycescerevisiae) |
| CONTIG853 | 10631937_c3_1 | 1967 | 16070 | 660 | 220 | S59398 | 609 | 1.7(10)-59 | Saccharomyces cerevisiae | probable membrane protein ylr253w - yeast (saccharomycescerevisiae) |
| CONTIG5234 | 24788282_c3_18 | 1968 | 16071 | 957 | 319 | S50369 | 475 | 2.7(10)-45 | Saccharomyces cerevisiae | probable membrane protein ylr253w - yeast (saccharomycescerevisiae) |
| CONTIG705 | 14629812_c2_4 | 1969 | 16072 | 687 | 229 | S50369 | 363 | 2.0(10)-33 | Saccharomyces cerevisiae | probable membrane protein ylr284c - yeast (saccharomycescerevisiae) |
| CONTIG3605 | 34042781_c2_4 | 1970 | 16073 | 561 | 187 | S50370 | 472 | 5.7(10)-45 | Saccharomyces cerevisiae | probable membrane protein ylr284c - yeast (saccharomycescerevisiae) |
| CONTIG5400 | 1273406_f1_3 | 1971 | 16074 | 846 | 282 | S50370 | 679 | 6.7(10)-67 | Saccharomyces cerevisiae | probable membrane protein ylr285w - yeast (saccharomycescerevisiae) |
| CONTIG1981 | 3956555_c2_5 | 1972 | 16075 | 432 | 144 | S53401 | 178 | 6.9(10)-13 | Saccharomyces cerevisiae | probable membrane protein ylr285w - yeast (saccharomycescerevisiae) |
| CONTIG5688 | 6069426_f3_10 | 1973 | 16076 | 564 | 188 | S53401 | 201 | 2.2(10)-15 | Saccharomyces cerevisiae | probable membrane protein ylr324w - yeast (saccharomycescerevisiae) |
| CONTIG5245 | 23851458_c3_25 | 1974 | 16077 | 492 | 164 | S53403 | 211 | 2.6(10)-17 | Saccharomyces cerevisiae | probable membrane protein ylr324w - yeast (saccharomycescerevisiae) |
| CONTIG5756 | 26192182_f2_10 | 1975 | 16078 | 630 | 210 | S53403 | 167 | 1.2(10)-12 | Saccharomyces cerevisiae | probable membrane protein ylr326w - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4886 | 1461032_c3_8 | 1976 | 16079 | 1152 | 384 | S53405 | 1239 | 3.9(10)-126 | Saccharomyces cerevisiae | probable membrane protein yll328w - yeast (saccharomycescerevisiae) |
| CONTIG5803 | 3172150_f1_3 | 1977 | 16080 | 630 | 210 | S51341 | 173 | 5.5(10)-12 | Saccharomyces cerevisiae | probable membrane protein yll335w - yeast (saccharomycescerevisiae) |
| CONTIG4350 | 31682632_f1_1 | 1978 | 16081 | 1581 | 527 | S51379 | 728 | 4.2(10)-72 | Saccharomyces cerevisiae | probable membrane protein yll361c - yeast (saccharomycescerevisiae) |
| CONTIG5753 | 7085932_f3_11 | 1979 | 16082 | 2820 | 940 | S51473 | 608 | 3.2(10)-101 | Saccharomyces cerevisiae | probable membrane protein yll386w - yeast (saccharomycescerevisiae) |
| CONTIG4081 | 20336503_c2_4 | 1980 | 16083 | 993 | 331 | S55960 | 91 | 0.08799 | Saccharomyces cerevisiae | probable membrane protein yll404w - yeast (saccharomycescerevisiae) |
| CONTIG1974 | 7125827_c3_8 | 1981 | 16084 | 1422 | 474 | S55965 | 1270 | 1.6(10)-129 | Saccharomyces cerevisiae | probable membrane protein yll409c - yeast (saccharomycescerevisiae) |
| CONTIG762 | 16609561_f2_1 | 1982 | 16085 | 918 | 306 | S55965 | 828 | 1.1(10)-82 | Saccharomyces cerevisiae | probable membrane protein yll409c - yeast (saccharomycescerevisiae) |
| CONTIG4777 | 3615632_c3_9 | 1983 | 16086 | 954 | 318 | S59380 | 115 | 0.00016 | Saccharomyces cerevisiae | probable membrane protein yll414c - yeast (saccharomycescerevisiae) |
| CONTIG1923 | 21504631_c2_1 | 1984 | 16087 | 930 | 310 | S53409 | 285 | 1.7(10)-23 | Saccharomyces cerevisiae | probable membrane protein yll422w - yeast (saccharomycescerevisiae) |
| CONTIG2533 | 4157252_f2_1 | 1985 | 16088 | 1089 | 363 | S53409 | 203 | 6.7(10)-13 | Saccharomyces cerevisiae | probable membrane protein yll422w - yeast (saccharomycescerevisiae) |
| CONTIG3801 | 20079760_c3_5 | 1986 | 16089 | 2571 | 857 | S53409 | 395 | 5.5(10)-41 | Saccharomyces cerevisiae | probable membrane protein yll422w - yeast (saccharomycescerevisiae) |
| CONTIG4358 | 14850025_c3_8 | 1987 | 16090 | 2955 | 985 | S53409 | 1189 | 5.7(10)-120 | Saccharomyces cerevisiae | probable membrane protein yll422w - yeast (saccharomycescerevisiae) |
| CONTIG615 | 6307812_f3_2 | 1988 | 16091 | 948 | 316 | S53409 | 371 | 1.2(10)-32 | Saccharomyces cerevisiae | probable membrane protein yll422w - yeast (saccharomycescerevisiae) |
| CONTIG5196 | 3916515_c1_8 | 1989 | 16092 | 981 | 327 | S53413 | 367 | 7.7(10)-34 | Saccharomyces cerevisiae | probable membrane protein yll426w - yeast (saccharomycescerevisiae) |
| CONTIG3427 | 10351077_f3_4 | 1990 | 16093 | 1383 | 461 | S53414 | 642 | 5.5(10)-63 | Saccharomyces cerevisiae | probable membrane protein yll427w - yeast (saccharomycescerevisiae) |
| CONTIG5801 | 15893763_f2_8 | 1991 | 16094 | 2040 | 680 | S59408 | 171 | 2.6(10)-9 | Saccharomyces cerevisiae | probable membrane protein yll440c - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1242 | 6093816_c3_5 | 1992 | 16095 | 1395 | 465 | S59413 | 713 | 1.3(10)-74 | *Saccharomyces cerevisiae* | probable membrane protein yll454w - yeast (*saccharomycescerevisiae*) |
| CONTIG2220 | 35708128_f1_1 | 1993 | 16096 | 1149 | 383 | S59413 | 254 | 1.8(10)-18 | *Saccharomyces cerevisiae* | probable membrane protein yll454w - yeast (*saccharomycescerevisiae*) |
| CONTIG2264 | 22322168_f1_1 | 1994 | 16097 | 801 | 267 | S59413 | 115 | 5.0(10)-7 | *Saccharomyces cerevisiae* | probable membrane protein yll454w - yeast (*saccharomycescerevisiae*) |
| CONTIG5609 | 18752_c2_8 | 1995 | 16098 | 1059 | 353 | S61982 | 498 | 1.0(10)-47 | *Saccharomyces cerevisiae* | probable membrane protein yol002c - yeast (*saccharomycescerevisiae*) |
| CONTIG5711 | 16831552_c2_10 | 1996 | 16099 | 1347 | 449 | S61981 | 423 | 6.0(10)-71 | *Saccharomyces cerevisiae* | probable membrane protein yol003c - yeast (*saccharomycescerevisiae*) |
| CONTIG2341 | 433207_f3_3 | 1997 | 16100 | 1020 | 340 | S66695 | 177 | 9.6(10)-13 | *Saccharomyces cerevisiae* | probable membrane protein yol013c - yeast (*saccharomycescerevisiae*) |
| CONTIG438 | 21657782_c1_2 | 1998 | 16101 | 609 | 203 | S66695 | 121 | 1.0(10)-6 | *Saccharomyces cerevisiae* | probable membrane protein yol013c - yeast (*saccharomycescerevisiae*) |
| CONTIG5810 | 12613926_c3_41 | 1999 | 16102 | 405 | 135 | S66709 | 136 | 2.2(10)-9 | *Saccharomyces cerevisiae* | probable membrane protein yol026c - yeast (*saccharomycescerevisiae*) |
| CONTIG5028 | 4788961_f1_2 | 2000 | 16103 | 1161 | 387 | S66710 | 746 | 5.2(10)-74 | *Saccharomyces cerevisiae* | probable membrane protein yol027c - yeast (*saccharomycescerevisiae*) |
| CONTIG1072 | 471026_f2_1 | 2001 | 16104 | 546 | 182 | S66714 | 110 | 0.00033 | *Saccharomyces cerevisiae* | probable membrane protein yol031c - yeast (*saccharomycescerevisiae*) |
| CONTIG5165 | 24489161_f1_4 | 2002 | 16105 | 852 | 284 | S66733 | 133 | 8.5(10)-9 | *Saccharomyces cerevisiae* | probable membrane protein yol048c - yeast (*saccharomycescerevisiae*) |
| CONTIG5483 | 206562_c3_10 | 2003 | 16106 | 1929 | 643 | S61717 | 1353 | 7.0(10)-145 | *Saccharomyces cerevisiae* | probable membrane protein yol060c - yeast (*saccharomycescerevisiae*) |
| CONTIG5791 | 4070125_f3_15 | 2004 | 16107 | 2277 | 759 | S66755 | 126 | 2.1(10)-10 | *Saccharomyces cerevisiae* | probable membrane protein yol063c - yeast (*saccharomycescerevisiae*) |
| CONTIG3291 | 16835067_f3_4 | 2005 | 16108 | 339 | 113 | S66766 | 207 | 8.5(10)-17 | *Saccharomyces cerevisiae* | probable membrane protein yol073c - yeast (*saccharomycescerevisiae*) |
| CONTIG5521 | 9861083_f1_1 | 2006 | 16109 | 615 | 205 | S66766 | 123 | 3.6(10)-6 | *Saccharomyces cerevisiae* | probable membrane protein yol073c - yeast (*saccharomycescerevisiae*) |
| CONTIG5270 | 19723162_f3_6 | 2007 | 16110 | 948 | 316 | S66770 | 970 | 9.6(10)-98 | *Saccharomyces cerevisiae* | probable membrane protein yol077c - yeast (*saccharomycescerevisiae*) |
| CONTIG1978 | 4807688_c2_1 | 2008 | 16111 | 396 | 132 | S57385 | 157 | 3.1(10)-10 | *Saccharomyces cerevisiae* | probable membrane protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3150 | 4173188_f1_1 | 2009 | 16112 | 984 | 328 | S57377 | 97 | 0.025 | Saccharomyces cerevisiae | yol084w - yeast (saccharomycescerevisiae) |
| CONTIG124 | 15631555_f1_2 | 2010 | 16113 | 246 | 82 | S51891 | 93 | 0.00054 | Saccharomyces cerevisiae | probable membrane protein yol092w - yeast (saccharomycescerevisiae) |
| CONTIG2370 | 6836502_f1_1 | 2011 | 16114 | 1326 | 442 | S51891 | 96 | 0.00021 | Saccharomyces cerevisiae | probable membrane protein yol107w - yeast (saccharomycescerevisiae) |
| CONTIG2884 | 11767062_c2_5 | 2012 | 16115 | 546 | 182 | S51891 | 178 | 2.5(10)-13 | Saccharomyces cerevisiae | probable membrane protein yol107w - yeast (saccharomycescerevisiae) |
| CONTIG700 | 10162937_c3_2 | 2013 | 16116 | 564 | 188 | S63441 | 408 | 3.5(10)-38 | Saccharomyces cerevisiae | probable membrane protein yol129w - yeast (saccharomycescerevisiae) |
| CONTIG1741 | 4329062_c3_1 | 2014 | 16117 | 1242 | 414 | S66834 | 264 | 5.7(10)-37 | Saccharomyces cerevisiae | probable membrane protein yol137w - yeast (saccharomycescerevisiae) |
| CONTIG4573 | 24298150_c1_10 | 2015 | 16118 | 1518 | 506 | S66834 | 188 | 8.5(10)-19 | Saccharomyces cerevisiae | probable membrane protein yol137w - yeast (saccharomycescerevisiae) |
| CONTIG4930 | 33984693_f1_1 | 2016 | 16119 | 3207 | 1069 | S66835 | 315 | 1.1(10)-47 | Saccharomyces cerevisiae | probable membrane protein yol138c - yeast (saccharomycescerevisiae) |
| CONTIG5381 | 975390_f3_7 | 2017 | 16120 | 648 | 216 | S60390 | 343 | 2.7(10)-31 | Saccharomyces cerevisiae | probable membrane protein yol146w - yeast (saccharomycescerevisiae) |
| b1x18291.x | 14275043_f2_1 | 2018 | 16121 | 507 | 169 | S61984 | 333 | 2.6(10)-29 | Saccharomyces cerevisiae | probable membrane protein yor001w - yeast (saccharomycescerevisiae) |
| b3x16041.x | 23640785_f3_2 | 2019 | 16122 | 312 | 104 | S61984 | 194 | 2.2(10)-14 | Saccharomyces cerevisiae | probable membrane protein yor001w - yeast (saccharomycescerevisiae) |
| CONTIG2420 | 24615927_f3_2 | 2020 | 16123 | 975 | 325 | S66942 | 144 | 2.6(10)-7 | Saccharomyces cerevisiae | probable membrane protein yor059c - yeast (saccharomycescerevisiae) |
| CONTIG4528 | 5870312_c1_8 | 2021 | 16124 | 669 | 223 | S66942 | 128 | 6.5(10)-6 | Saccharomyces cerevisiae | probable membrane protein yor059c - yeast (saccharomycescerevisiae) |
| CONTIG4528 | 3938875_c3_13 | 2022 | 16125 | 1086 | 362 | S66942 | 380 | 3.2(10)-35 | Saccharomyces cerevisiae | probable membrane protein yor059c - yeast (saccharomycescerevisiae) |
| CONTIG5159 | 2361537_f1_2 | 2023 | 16126 | 669 | 223 | S61645 | 316 | 1.8(10)-28 | Saccharomyces cerevisiae | probable membrane protein yor084w - yeast (saccharomycescerevisiae) |
| CONTIG3622 | 5253760_c2_3 | 2024 | 16127 | 921 | 307 | S61645 | 236 | 1.2(10)-19 | Saccharomyces cerevisiae | probable membrane protein yor084w - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5177 | 25581936_f2_2 | 2025 | 16128 | 3081 | 1027 | S61647 | 852 | 3.1(10)-85 | *Saccharomyces cerevisiae* | probable membrane protein yor086c - yeast (*saccharomycescerevisiae*) |
| CONTIG5747 | 34064056_c1_31 | 2026 | 16129 | 1923 | 641 | S61648 | 827 | 1.3(10)-82 | *Saccharomyces cerevisiae* | probable membrane protein yor088w - yeast (*saccharomycescerevisiae*) |
| CONTIG4674 | 5890885_c3_7 | 2027 | 16130 | 1833 | 611 | S61692 | 187 | 2.2(10)-18 | *Saccharomyces cerevisiae* | probable membrane protein yor137c - yeast (*saccharomycescerevisiae*) |
| CONTIG5499 | 33378936_f1_1 | 2028 | 16131 | 1884 | 628 | S61693 | 101 | 2.2(10)-7 | *Saccharomyces cerevisiae* | probable membrane protein yor138c - yeast (*saccharomycescerevisiae*) |
| CONTIG5076 | 31331312_f2_2 | 2029 | 16132 | 1629 | 543 | S67042 | 658 | 1.1(10)-64 | *Saccharomyces cerevisiae* | probable membrane protein yor154w - yeast (*saccharomycescerevisiae*) |
| CONTIG5437 | 477290_f3_7 | 2030 | 16133 | 378 | 126 | S67049 | 270 | 7.5(10)-23 | *Saccharomyces cerevisiae* | probable membrane protein yor161c - yeast (*saccharomycescerevisiae*) |
| CONTIG3077 | 5956628_f2_1 | 2031 | 16134 | 2292 | 764 | S67053 | 1475 | 3.0(10)-151 | *Saccharomyces cerevisiae* | probable membrane protein yor165w - yeast (*saccharomycescerevisiae*) |
| CONTIG4759 | 34577677_f2_3 | 2032 | 16135 | 453 | 151 | S67054 | 163 | 2.2(10)-11 | *Saccharomyces cerevisiae* | probable membrane protein yor166c - yeast (*saccharomycescerevisiae*) |
| CONTIG519 | 4038302_c3_2 | 2033 | 16136 | 885 | 295 | S67054 | 435 | 4.7(10)-41 | *Saccharomyces cerevisiae* | probable membrane protein yor166c - yeast (*saccharomycescerevisiae*) |
| CONTIG5788 | 24781502_f1_1 | 2034 | 16137 | 1800 | 600 | S67067 | 1250 | 2.1(10)-127 | *Saccharomyces cerevisiae* | probable membrane protein yor175c - yeast (*saccharomycescerevisiae*) |
| CONTIG3901 | 25973936_c3_5 | 2035 | 16138 | 192 | 64 | S67097 | 102 | 0.00012 | *Saccharomyces cerevisiae* | probable membrane protein yor205c - yeast (*saccharomycescerevisiae*) |
| CONTIG3901 | 14255287_c3_4 | 2036 | 16139 | 1383 | 461 | S67097 | 271 | 8.1(10)-27 | *Saccharomyces cerevisiae* | probable membrane protein yor205c - yeast (*saccharomycescerevisiae*) |
| CONTIG404 | 31274166_c1_3 | 2037 | 16140 | 1020 | 340 | S60954 | 246 | 1.3(10)-19 | *Saccharomyces cerevisiae* | probable membrane protein yor227w - yeast (*saccharomycescerevisiae*) |
| CONTIG5155 | 20735907_f2_5 | 2038 | 16141 | 618 | 206 | S60955 | 154 | 8.0(10)-11 | *Saccharomyces cerevisiae* | probable membrane protein yor228c - yeast (*saccharomycescerevisiae*) |
| CONTIG4877 | 29303252_c3_7 | 2039 | 16142 | 1065 | 355 | S67133 | 984 | 3.2(10)-99 | *Saccharomyces cerevisiae* | probable membrane protein yor240w - yeast (*saccharomycescerevisiae*) |
| CONTIG4475 | 36344386_f1_1 | 2040 | 16143 | 1131 | 377 | S67138 | 309 | 6.4(10)-62 | *Saccharomyces cerevisiae* | probable membrane protein yor245c - yeast (*saccharomycescerevisiae*) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1828 | 3915692_c1_4 | 2041 | 16144 | 603 | 201 | S67139 | 404 | 9.1(10)-38 | Saccharomyces cerevisiae | probable membrane protein yor246c - yeast (saccharomycescerevisiae) |
| CONTIG4410 | 20751950_c2_7 | 2042 | 16145 | 1206 | 402 | S67139 | 751 | 1.6(10)-74 | Saccharomyces cerevisiae | probable membrane protein yor246c - yeast (saccharomycescerevisiae) |
| CONTIG5047 | 6262_c2_7 | 2043 | 16146 | 201 | 67 | S67139 | 143 | 1.7(10)-9 | Saccharomyces cerevisiae | probable membrane protein yor246c - yeast (saccharomycescerevisiae) |
| CONTIG175 | 5083338_f2_1 | 2044 | 16147 | 546 | 182 | S67146 | 220 | 3.3(10)-17 | Saccharomyces cerevisiae | probable membrane protein yor249c - yeast (saccharomycescerevisiae) |
| CONTIG568 | 31812638_f2_1 | 2045 | 16148 | 1110 | 370 | S67146 | 232 | 1.7(10)-18 | Saccharomyces cerevisiae | probable membrane protein yor249c - yeast (saccharomycescerevisiae) |
| CONTIG5559 | 23828436_c3_25 | 2046 | 16149 | 699 | 233 | S67159 | 734 | 9.9(10)-73 | Saccharomyces cerevisiae | probable membrane protein yor262w - yeast (saccharomycescerevisiae) |
| CONTIG5559 | 156640_c2_19 | 2047 | 16150 | 225 | 75 | S67159 | 249 | 2.3(10)-21 | Saccharomyces cerevisiae | probable membrane protein yor262w - yeast (saccharomycescerevisiae) |
| CONTIG1508 | 36365900_f3_1 | 2048 | 16151 | 363 | 121 | S67196 | 344 | 2.1(10)-31 | Saccharomyces cerevisiae | probable membrane protein yor292c - yeast (saccharomycescerevisiae) |
| CONTIG5370 | 4416032_f1_2 | 2049 | 16152 | 1662 | 554 | S67205 | 177 | 1.8(10)-27 | Saccharomyces cerevisiae | probable membrane protein yor301w - yeast (saccharomycescerevisiae) |
| CONTIG5068 | 33439062_c2_10 | 2050 | 16153 | 495 | 165 | S58323 | 351 | 3.7(10)-32 | Saccharomyces cerevisiae | probable membrane protein yor311c - yeast (saccharomycescerevisiae) |
| CONTIG5068 | 46900_c3_12 | 2051 | 16154 | 711 | 237 | S58323 | 121 | 2.7(10)-6 | Saccharomyces cerevisiae | probable membrane protein yor311c - yeast (saccharomycescerevisiae) |
| CONTIG4043 | 31675632_f3_2 | 2052 | 16155 | 1368 | 456 | S58330 | 200 | 4.4(10)-13 | Saccharomyces cerevisiae | probable membrane protein yor320c - yeast (saccharomycescerevisiae) |
| CONTIG1017 | 5089681_f3_1 | 2053 | 16156 | 372 | 124 | S58333 | 211 | 4.2(10)-16 | Saccharomyces cerevisiae | probable membrane protein yor322c - yeast (saccharomycescerevisiae) |
| CONTIG3368 | 275933_f1_1 | 2054 | 16157 | 1512 | 504 | S58333 | 532 | 6.7(10)-83 | Saccharomyces cerevisiae | probable membrane protein yor322c - yeast (saccharomycescerevisiae) |
| CONTIG3017 | 22460778_c3_2 | 2055 | 16158 | 1035 | 345 | S67264 | 127 | 7.5(10)-10 | Saccharomyces cerevisiae | probable membrane protein yor352w - yeast (saccharomycescerevisiae) |
| CONTIG5361 | 23933500_c1_6 | 2056 | 16159 | 855 | 285 | S67302 | 238 | 1.3(10)-26 | Saccharomyces cerevisiae | probable membrane protein yor390w - yeast (saccharomycescerevisiae) |
| CONTIG4922 | 23831555_c3_11 | 2057 | 16160 | 1593 | 531 | S52525 | 689 | 2.7(10)-94 | Saccharomyces cerevisiae | probable membrane protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4922 | 33206313_c1_8 | 2058 | 16161 | 1929 | 643 | S52525 | 547 | 5.2(10)-104 | Saccharomyces cerevisiae | ypl006w - yeast (saccharomycescerevisiae) probable membrane protein ypl006w - yeast |
| CONTIG4084 | 15829753_f3_1 | 2059 | 16162 | 1722 | 574 | S59681 | 1309 | 1.2(10)-133 | Saccharomyces cerevisiae | (saccharomycescerevisiae) probable membrane protein ypl012w - yeast |
| CONTIG2861 | 33413437_f3_2 | 2060 | 16163 | 969 | 323 | S59681 | 563 | 1.8(10)-53 | Saccharomyces cerevisiae | (saccharomycescerevisiae) probable membrane protein ypl012w - yeast |
| CONTIG3664 | 601438_c3_9 | 2061 | 16164 | 786 | 262 | S59681 | 507 | 1.8(10)-47 | Saccharomyces cerevisiae | (saccharomycescerevisiae) probable membrane protein ypl012w - yeast |
| CONTIG4451 | 14473413_c2_5 | 2062 | 16165 | 2727 | 909 | S62042 | 409 | 3.6(10)-35 | Saccharomyces cerevisiae | (saccharomycescerevisiae) probable membrane protein ypl032c - yeast |
| b2x13426.y | 32225262_f2_1 | 2063 | 16166 | 495 | 165 | S62034 | 160 | 6.5(10)-12 | Saccharomyces cerevisiae | (saccharomycescerevisiae) probable membrane protein ypl041c - yeast |
| CONTIG2908 | 25677281_f1_1 | 2064 | 16167 | 1470 | 490 | S61114 | 185 | 6.7(10)-19 | Saccharomyces cerevisiae | (saccharomycescerevisiae) probable membrane protein ypl072w - yeast |
| CONTIG4426 | 24261700_f3_4 | 2065 | 16168 | 279 | 93 | S61968 | 139 | 1.1(10)-9 | Saccharomyces cerevisiae | (saccharomycescerevisiae) probable membrane protein ypl098c - yeast |
| CONTIG1047 | 32160156_f1_1 | 2066 | 16169 | 696 | 232 | S61965 | 448 | 2.0(10)-42 | Saccharomyces cerevisiae | (saccharomycescerevisiae) probable membrane protein ypl101w - yeast |
| b9x13c67.y | 12601016_f1_1 | 2067 | 16170 | 360 | 120 | S61965 | 188 | 4.2(10)-14 | Saccharomyces cerevisiae | (saccharomycescerevisiae) probable membrane protein ypl101w - yeast |
| CONTIG4426 | 2538302_c3_7 | 2068 | 16171 | 1359 | 453 | S61964 | 741 | 1.8(10)-73 | Saccharomyces cerevisiae | (saccharomycescerevisiae) probable membrane protein ypl103c - yeast |
| CONTIG3243 | 4385942_f1_1 | 2069 | 16172 | 1251 | 417 | S62012 | 1060 | 8.0(10)-112 | Saccharomyces cerevisiae | (saccharomycescerevisiae) probable membrane protein ypl109c - yeast |
| CONTIG703 | 24694567_f1_1 | 2070 | 16173 | 912 | 304 | S62009 | 158 | 1.3(10)-9 | Saccharomyces cerevisiae | (saccharomycescerevisiae) probable membrane protein ypl112c - yeast |
| CONTIG4453 | 6650325_c2_4 | 2071 | 16174 | 1497 | 499 | S61996 | 386 | 8.3(10)-35 | Saccharomyces cerevisiae | (saccharomycescerevisiae) probable membrane protein ypl126w - yeast |
| CONTIG5473 | 10628407_f2_2 | 2072 | 16175 | 1035 | 345 | S61996 | 156 | 4.5(10)-15 | Saccharomyces cerevisiae | (saccharomycescerevisiae) probable membrane protein ypl126w - yeast |
| CONTIG4949 | 2929517_c1_6 | 2073 | 16176 | 1056 | 352 | S65173 | 336 | 1.5(10)-30 | Saccharomyces cerevisiae | (saccharomycescerevisiae) probable membrane protein ypl162c - yeast |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1969 | 10165718_f2_1 | 2074 | 16177 | 1002 | 334 | S65195 | 110 | 0.0038 | Saccharomyces cerevisiae | probable membrane protein ypl183c - yeast (saccharomycescerevisiae) |
| CONTIG492 | 36618903_c3_4 | 2075 | 16178 | 933 | 311 | S65195 | 195 | 1.3(10)-12 | Saccharomyces cerevisiae | probable membrane protein ypl183c - yeast (saccharomycescerevisiae) |
| b3x12259.y | 12897660_c2_5 | 2076 | 16179 | 828 | 276 | S65195 | 345 | 2.7(10)-30 | Saccharomyces cerevisiae | probable membrane protein ypl183c - yeast (saccharomycescerevisiae) |
| CONTIG3084 | 22448317_c3_2 | 2077 | 16180 | 1455 | 485 | S65196 | 1131 | 8.4(10)-115 | Saccharomyces cerevisiae | probable membrane protein ypl184c - yeast (saccharomycescerevisiae) |
| b2x12011.y | 5285155_f1_1 | 2078 | 16181 | 624 | 208 | S65225 | 109 | 3.2(10)-9 | Saccharomyces cerevisiae | probable membrane protein ypl206c - yeast (saccharomycescerevisiae) |
| b1x16281.x | 25408182_f3_3 | 2079 | 16182 | 681 | 227 | S65235 | 109 | 0.00058 | Saccharomyces cerevisiae | probable membrane protein ypl216w - yeast (saccharomycescerevisiae) |
| CONTIG5569 | 22462888_f3_4 | 2080 | 16183 | 3561 | 1187 | S65236 | 1452 | 7.9(10)-293 | Saccharomyces cerevisiae | probable membrane protein ypl217c - yeast (saccharomycescerevisiae) |
| CONTIG5569 | 15672192_f1_1 | 2081 | 16184 | 1467 | 489 | S65240 | 577 | 4.2(10)-56 | Saccharomyces cerevisiae | probable membrane protein ypl221w - yeast (saccharomycescerevisiae) |
| CONTIG1113 | 14275011_c1_3 | 2082 | 16185 | 642 | 214 | S65243 | 165 | 1.3(10)-11 | Saccharomyces cerevisiae | probable membrane protein ypl224c - yeast (saccharomycescerevisiae) |
| CONTIG5428 | 511627_c2_13 | 2083 | 16186 | 561 | 187 | S61020 | 197 | 1.7(10)-15 | Saccharomyces cerevisiae | probable membrane protein ypl244c - yeast (saccharomycescerevisiae) |
| CONTIG361 | 4484385_c3_2 | 2084 | 16187 | 630 | 210 | S61018 | 238 | 3.6(10)-20 | Saccharomyces cerevisiae | probable membrane protein ypl246c - yeast (saccharomycescerevisiae) |
| CONTIG1801 | 21640917_c3_3 | 2085 | 16188 | 564 | 188 | S65293 | 204 | 1.2(10)-15 | Saccharomyces cerevisiae | probable membrane protein ypl260w - yeast (saccharomycescerevisiae) |
| CONTIG3475 | 15792062_c1_5 | 2086 | 16189 | 705 | 235 | S65293 | 441 | 1.1(10)-41 | Saccharomyces cerevisiae | probable membrane protein ypl260w - yeast (saccharomycescerevisiae) |
| CONTIG1972 | 24017205_f2_1 | 2087 | 16190 | 1248 | 416 | S65297 | 647 | 1.6(10)-63 | Saccharomyces cerevisiae | probable membrane protein ypl264c - yeast (saccharomycescerevisiae) |
| CONTIG4970 | 24250780_f2_3 | 2088 | 16191 | 2913 | 971 | S54496 | 164 | 1.5(10)-20 | Saccharomyces cerevisiae | probable membrane protein ypr022c - yeast (saccharomycescerevisiae) |
| CONTIG5657 | 12994062_f2_8 | 2089 | 16192 | 303 | 101 | S54496 | 150 | 2.1(10)-9 | Saccharomyces cerevisiae | probable membrane protein ypr022c - yeast (saccharomycescerevisiae) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4752 | 24407130_c3_8 | 2090 | 16193 | 471 | 157 | S54502 | 360 | 4.2(10)-33 | Saccharomyces cerevisiae | probable membrane protein ypr028w - yeast (saccharomycescerevisiae) |
| CONTIG4783 | 2158316_f1_1 | 2091 | 16194 | 1737 | 579 | S54506 | 725 | 5.7(10)-81 | Saccharomyces cerevisiae | probable membrane protein ypr032w - yeast (saccharomycescerevisiae) |
| CONTIG2577 | 34000177_c2_3 | 2092 | 16195 | 813 | 271 | S54073 | 102 | 0.03699 | Saccharomyces cerevisiae | probable membrane protein ypr049c - yeast (saccharomycescerevisiae) |
| CONTIG3870 | 26773300_f3_2 | 2093 | 16196 | 345 | 115 | S54073 | 117 | 7.2(10)-6 | Saccharomyces cerevisiae | probable membrane protein ypr049c - yeast (saccharomycescerevisiae) |
| CONTIG5403 | 3954028_c3_13 | 2094 | 16197 | 366 | 122 | S54084 | 159 | 8.4(10)-12 | Saccharomyces cerevisiae | probable membrane protein ypr063c - yeast (saccharomycescerevisiae) |
| CONTIG5797 | 12195183_f2_4 | 2095 | 16198 | 2175 | 725 | S59770 | 347 | 1.8(10)-28 | Saccharomyces cerevisiae | probable membrane protein ypr105c - yeast (saccharomycescerevisiae) |
| CONTIG3916 | 15682288_c3_5 | 2096 | 16199 | 1329 | 443 | S59782 | 407 | 2.6(10)-36 | Saccharomyces cerevisiae | probable membrane protein ypr117w - yeast (saccharomycescerevisiae) |
| b1x19271.y | 24321885_c3_3 | 2097 | 16200 | 702 | 234 | S59782 | 167 | 8.0(10)-11 | Saccharomyces cerevisiae | probable membrane protein ypr117w - yeast (saccharomycescerevisiae) |
| CONTIG1995 | 9846041_f1_1 | 2098 | 16201 | 693 | 231 | S58824 | 492 | 2.7(10)-46 | Saccharomyces cerevisiae | probable membrane protein ypr194c - yeast (saccharomycescerevisiae) |
| CONTIG4127 | 402001_f3_3 | 2099 | 16202 | 1041 | 347 | S58824 | 807 | 1.8(10)-80 | Saccharomyces cerevisiae | probable membrane protein ypr194c - yeast (saccharomycescerevisiae) |
| CONTIG4140 | 14720917_c3_7 | 2100 | 16203 | 516 | 172 | S58824 | 390 | 2.8(10)-35 | Saccharomyces cerevisiae | probable membrane protein ypr194c - yeast (saccharomycescerevisiae) |
| CONTIG2865 | 6846082_f1_1 | 2101 | 16204 | 1524 | 508 | S58824 | 897 | 5.2(10)-90 | Saccharomyces cerevisiae | probable membrane protein ypr194c - yeast (saccharomycescerevisiae) |
| CONTIG3340 | 13063143_c3_5 | 2102 | 16205 | 2088 | 696 | S58824 | 1581 | 1.7(10)-162 | Saccharomyces cerevisiae | probable membrane protein ypr194c - yeast (saccharomycescerevisiae) |
| CONTIG3983 | 2362600_c3_7 | 2103 | 16206 | 1023 | 341 | S58824 | 294 | 6.0(10)-25 | Saccharomyces cerevisiae | probable membrane protein ypr194c - yeast (saccharomycescerevisiae) |
| CONTIG4488 | 4708127_c3_4 | 2104 | 16207 | 1407 | 469 | S58824 | 724 | 1.1(10)-71 | Saccharomyces cerevisiae | probable membrane protein ypr194c - yeast (saccharomycescerevisiae) |
| CONTIG732 | 12635400_f3_2 | 2105 | 16208 | 1023 | 341 | S58824 | 883 | 1.6(10)-88 | Saccharomyces cerevisiae | probable membrane protein ypr194c - yeast (saccharomycescerevisiae) |
| CONTIG875 | 23468752_f2_2 | 2106 | 16209 | 615 | 205 | S58824 | 342 | 4.2(10)-30 | Saccharomyces cerevisiae | probable membrane protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3031 | 4876300_c2_6 | 2107 | 16210 | 972 | 324 | S50979 | 148 | 9.5(10)-8 | Saccharomyces cerevisiae | ypr194c - yeast (saccharomycescerevisiae) |
| CONTIG3166 | 24412811_f3_6 | 2108 | 16211 | 585 | 195 | S50979 | 106 | 0.0022 | Saccharomyces cerevisiae | rhc21 protein - yeast (saccharomycescerevisiae) |
| CONTIG3179 | 9954712_f2_1 | 2109 | 16212 | 1425 | 475 | S56295 | 459 | 1.2(10)-42 | Saccharomyces cerevisiae | rhc21 protein - yeast (saccharomyces cerevisiae) |
| CONTIG4472 | 23991312_f3_3 | 2110 | 16213 | 729 | 243 | S56295 | 193 | 4.0(10)-14 | Saccharomyces cerevisiae | sap155 protein - yeast (saccharomyces cerevisiae) |
| CONTIG2107 | 20943812_c2_5 | 2111 | 16214 | 1395 | 465 | S64745 | 210 | 1.0(10)-13 | Saccharomyces cerevisiae | sap155 protein - yeast (saccharomyces cerevisiae) |
| CONTIG2904 | 12145287_f3_2 | 2112 | 16215 | 876 | 292 | S30839 | 698 | 6.4(10)-69 | Saccharomyces cerevisiae | sfl1 protein - yeast (saccharomyces cerevisiae) |
| CONTIG3856 | 26423400_f1_1 | 2113 | 16216 | 1335 | 445 | B26955 | 564 | 3.3(10)-65 | Yarrowia lipolytica | utr2 protein - yeast (saccharomyces cerevisiae) |
| CONTIG5820 | 5907001_f3_60 | 2114 | 16217 | 699 | 233 | S51503 | 712 | 2.1(10)-70 | Yarrowia lipolytica | hypothetical protein - yeast (yarrowia lipolytica) (fragment) |
| CONTIG3215 | 4406555_f3_3 | 2115 | 16218 | 459 | 153 | JC4589 | 93 | 0.00017 | Coccidioides immitis | nadh dehydrogenase (ubiquinone) (ec 1.6.5.3) chain 4 - yeast(yarrowia lipolytica) mitochondrion (sgc2) |
| CONTIG3499 | 13962542_c3_11 | 2116 | 16219 | 1356 | 452 | JC4589 | 116 | 3.7(10)-5 | Coccidioides immitis | immunoreactive protein - coccidioides immitis this protein is an immunogenic protein, and has the roles in human immunity to coccidioidomycosis. |
| CONTIG2529 | 4823262_c3_4 | 2117 | 16220 | 1434 | 478 | S20466 | 463 | 5.2(10)-44 | Fusarium oxysporum | immunoreactive protein - coccidioides immitis this protein is an immunogenic protein, and has the roles in human immunity to coccidioidomycosis. |
| CONTIG4977 | 15672630_c2_10 | 2118 | 16221 | 558 | 186 | S60179 | 121 | 6.4(10)-5 | Fusarium oxysporum | hypothetical protein - fungus (fusarium oxysporum) |
| CONTIG3570 | 33210062_c3_4 | 2119 | 16222 | 1089 | 363 | S45583 | 156 | 1.7(10)-8 | Nectria haematococca | pol polyprotein homolog - fungus (fusarium oxysporum)retrotransposon skippy |
| CONTIG3685 | 32113382_c2_5 | 2120 | 16223 | 747 | 249 | S51577 | 138 | 3.3(10)-7 | Magnaporthe grisea | pisatin demethylase - fungus (nectria haematococca) |
| CONTIG4956 | 117793_f3_4 | 2121 | 16224 | 1044 | 348 | S51577 | 187 | 4.7(10)-12 | Magnaporthe grisea | transposase - rice blast fungus |
| CONTIG5318 | 5084575_c3_9 | 2122 | 16225 | 1644 | 548 | S51577 | 478 | 1.3(10)-45 | Magnaporthe grisea | transposase - rice blast fungus |
| CONTIG3379 | 2925687_c3_6 | 2123 | 16226 | 183 | 61 | JC4255 | 93 | 0.00087 | Neurospora crassa | transposase - rice blast fungus |
| CONTIG3478 | 36337777_f2_2 | 2124 | 16227 | 231 | 77 | A36621 | 157 | 1.3(10)-11 | Neurospora crassa | met-10+ protein - neurospora crassa this protein is involved in methionine biosynthesis, transport and utilization. |
| | | | | | | | | | | nadh dehydrogenase (ubiquinone) (ec 1.6.5.3) 22k chainprecursor - |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG793 | 25399213_f2_1 | 2125 | 16228 | 528 | 176 | S59926 | 499 | 1.6(10)-47 | Neurospora crassa | nadh dehydrogenase (ubiquinone) (ec 1.6.5.3) 78k chainprecursor - neurospora crassa |
| CONTIG616 | 16601449_c1_2 | 2126 | 16229 | 618 | 206 | S59926 | 819 | 9.6(10)-82 | Neurospora crassa | nadh dehydrogenase (ubiquinone) (ec 1.6.5.3) 78k chainprecursor - neurospora crassa |
| CONTIG5820 | 22267263_f1_14 | 2127 | 16230 | 807 | 269 | S03127 | 355 | 1.3(10)-32 | Neurospora crassa | gene cob intron protein - neurospora crassa mitochondrion(sgc3) |
| CONTIG4819 | 24726632_f3_6 | 2128 | 16231 | 1476 | 492 | S49876 | 1162 | 4.4(10)-118 | Ustilago maydis | gamma-adaptin - smut fungus (ustilago maydis) |
| CONTIG5046 | 11025127_c3_7 | 2129 | 16232 | 1275 | 425 | S41649 | 102 | 0.12 | Plasmodium falciparum | dna polymerase - plasmodium falciparum |
| CONTIG5330 | 4307778_c3_13 | 2130 | 16233 | 873 | 291 | S41649 | 94 | 0.28 | Plasmodium falciparum | dna polymerase - plasmodium falciparum |
| CONTIG5626 | 23941882_c2_12 | 2131 | 16234 | 834 | 278 | A45555 | 91 | 0.42999 | Plasmodium falciparum | glutamate rich protein - plasmodium falciparum |
| CONTIG1310 | 24080308_f3_2 | 2132 | 16235 | 564 | 188 | A54523 | 93 | 0.001 | Plasmodium lophurae | histidine-rich protein - plasmodium lophurae (fragment) |
| CONTIG5537 | 29412762_f1_1 | 2133 | 16236 | 282 | 94 | I50099 | 125 | 8.8(10)-7 | Bufo marinus | h,k-atpase - giant toad csa protein - human |
| CONTIG3966 | 3134802_c3_4 | 2134 | 16237 | 1104 | 368 | A57090 | 380 | 1.3(10)-40 | Homo sapiens | |
| CONTIG3217 | 17032510_c3_5 | 2135 | 16238 | 477 | 159 | A48024 | 121 | 9.0(10)-8 | Homo sapiens | glycosylphosphatidylinositol anchor class h biosynthesisprotein - human |
| CONTIG3106 | 32553432_f3_5 | 2136 | 16239 | 939 | 313 | I54209 | 222 | 1.8(10)-18 | Homo sapiens | hypothetical protein - human (fragment) |
| CONTIG5607 | 13672785_f1_2 | 2137 | 16240 | 597 | 199 | A38919 | 94 | 0.1 | Homo sapiens | hypothetical protein 1 - human |
| CONTIG1459 | 33234812_f3_3 | 2138 | 16241 | 738 | 246 | I70160 | 157 | 1.6(10)-12 | Homo sapiens | pyruvate dehydrogenase kinase - human |
| CONTIG1996 | 16287537_f3_1 | 2139 | 16242 | 1041 | 347 | I49272 | 163 | 3.5(10)-9 | Mus musculus | cd40 receptor-associated factor 1 - mouse |
| CONTIG4137 | 3167010_c1_9 | 2140 | 16243 | 3573 | 1191 | S60896 | 2713 | 1.3(10)-286 | Candida albicans | agglutinin-like protein - yeast (candida albicans) |
| CONTIG4507 | 4797561_c3_5 | 2141 | 16244 | 2436 | 812 | S60896 | 2267 | 3.5(10)-235 | Candida albicans | agglutinin-like protein - yeast (candida albicans) |
| CONTIG5246 | 601391_f2_5 | 2142 | 16245 | 900 | 300 | S60896 | 777 | 1.7(10)-76 | Candida albicans | agglutinin-like protein - yeast (candida albicans) |
| CONTIG5331 | 34414057_f3_4 | 2143 | 16246 | 864 | 288 | S20538 | 1256 | 4.7(10)-128 | Candida albicans | chitin synthase (ec 2.4.1.16) - imperfect fungus (candidaalbicans) |
| CONTIG2575 | 10598500_c2_3 | 2144 | 16247 | 909 | 303 | S17517 | 922 | 1.2(10)-92 | Pichia anomala | hypothetical protein - yeast (pichia anomala) |
| CONTIG4918 | 5112925_f1_1 | 2145 | 16248 | 966 | 322 | S17517 | 759 | 2.2(10)-75 | Pichia anomala | hypothetical protein - yeast (pichia anomala) |
| CONTIG4050 | 6820250_f3_3 | 2146 | 16249 | 675 | 225 | S72159 | 314 | 3.2(10)-28 | Saccharomyces cerevisiae | ribosomal protein yl15, mitochondrial - yeast (saccharomycescerevisiae) |
| b3x16011.y | 485135_c3_6 | 2147 | 16250 | 435 | 145 | S63587 | 126 | 3.8(10)-7 | Aspergillus niger | gene pacc protein - aspergillus niger |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1874 | 4425681_f3_1 | 2148 | 16251 | 603 | 201 | S55930 | 442 | 8.6(10)-42 | *Podospora anserina* | het-c4 protein - podospora anserina |
| CONTIG3601 | 14844627_c1_6 | 2149 | 16252 | 402 | 134 | S23693 | 110 | 7.0(10)-6 | *Plasmodium falciparum* | hypothetical protein 10 - plasmodium falciparum |
| CONTIG3050 | 7078326_f3_1 | 2150 | 16253 | 216 | 72 | S23693 | 125 | 1.6(10)-7 | *Plasmodium falciparum* | hypothetical protein 10 - plasmodium falciparum |
| CONTIG1686 | 26679703_f3_3 | 2151 | 16254 | 282 | 94 | S51376 | 141 | 2.7(10)-9 | *Solanum tuberosum* | sucrose cleavage protein - potato |
| CONTIG592 | 892752_f3_2 | 2152 | 16255 | 342 | 114 | S57792 | 129 | 9.6(10)-8 | *Mangifera indica* | thiolase precursor, peroxisomal - ripe mango |
| b3x10691.x | 4164583_f3_4 | 2153 | 16256 | 471 | 157 | S48094 | 810 | 8.6(10)-81 | synthetic construct | chloramphenicol o-acetyltransferase (ec 2.3.1.28) - synthetic |
| CONTIG5474 | 14541057_c3_18 | 2154 | 16257 | 300 | 100 | S61720 | 189 | 5.5(10)-15 | *Saccharomyces cerevisiae* | hypothetical protein or f1224 - yeast (*saccharomyces cerevisiae*) |
| CONTIG2235 | 4878400_c2_5 | 2155 | 16258 | 354 | 118 | X70360 | 105 | 4.5(10)-6 | *Azospirillum brasilense* | or:azospirillum brasilense gn:carr le:59 re:580 di:direct nt:orf2 |
| CONTIG3474 | 10941077_c2_4 | 2156 | 16259 | 372 | 124 | X70360 | 164 | 2.5(10)-12 | *Azospirillum brasilense* | or:azospirillum brasilense gn:carr le:59 re:580 di:direct nt:orf2 |
| CONTIG3446 | 35834641_f3_1 | 2157 | 16260 | 1761 | 587 | U45424 | 106 | 0.00068 | *Borrelia burgdorferi* | or:borrelia burgdorferi gn:rep-le:818 re:1303 di:complement sr:lyme disease spirochete strain=297 nt:minus strand repeat motif-containing gene |
| CONTIG3673 | 29500325_c2_5 | 2158 | 16261 | 555 | 185 | D49537 | 189 | 5.5(10)-15 | *Clostridium perfringens* | or:clostridium perfringens pn:unknown gn:orf18 le:225 re:683 di:direct sr:clostridium perfringens (strain:nctc8237) dna, clone:ptsd10 |
| CONTIG5316 | 2751375_f2_5 | 2159 | 16262 | 477 | 159 | D86544 | 272 | 9.0(10)-24 | *Ralstonia pickettii* | or:ralstonia pickettii pn:hydroxyquinol-1,2-dioxygenase gn:hadc le:2659 re:3606 di:direct sr:burkholderia pickettii (strain:dfp0602) dna |
| CONTIG5723 | 1050063_c2_25 | 2160 | 16263 | 990 | 330 | D86544 | 452 | 7.5(10)-43 | *Ralstonia pickettii* | or:ralstonia pickettii pn:hydroxyquinol-1,2-dioxygenase gn:hadc le:2659 re:3606 di:direct sr:burkholderia pickettii (strain:dfp0602) dna |
| CONTIG1116 | 3017257_c3_5 | 2161 | 16264 | 246 | 82 | M26308 | 102 | 9.3(10)-6 | Plasmid IncF | or:plasmid srplasmid incf dna nt:orf5 di:direct srplasmid incf dna le:3577 re:3894 |
| CONTIG555 | 14460883_c1_2 | 2162 | 16265 | 390 | 130 | X97263 | 91 | 0.01099 | *Lactococcus lactis* | or:lactococcus lactis gn:abim le:189 re:1931 di:complement |
| CONTIG3261 | 3938936_f1_1 | 2163 | 16266 | 687 | 229 | X73834 | 99 | 0.0057 | *Mycoplasma hominis* | or:mycoplasma hominis pn:adhesin gn:p50 le:362 re:1765 di:direct |
| CONTIG2240 | 3338933_f1_1 | 2164 | 16267 | 564 | 188 | U22020 | 106 | 0.0001 | *Mycoplasma hominis* | or:mycoplasma hominis pn:p120 gn:p120 le:1 re:>561 di:direct |
| CONTIG5813 | 10322186_f2_15 | 2165 | 16268 | 612 | 204 | L16627 | 90 | 0.057 | *Pasteurella haemolytica* | or:pasteurella haemolytica pn:lipoprotein 3 gn:plpc le:3521 re:4300 di:direct sr:pasteurella |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5678 | 10625252_c1_13 | 2166 | 16269 | 2766 | 922 | X94909 | 103 | 0.23 | Streptococcus pneumoniae | haemolytica (strain al) dna nt:putative or:streptoococcus pneumoniae pn:iga1 protease gn:iga le:259 re:6042 di:direct |
| CONTIG1197 | 34242817_c1_2 | 2167 | 16270 | 837 | 279 | U28142 | 94 | 0.0073 | Streptococcus pyogenes | or:streptoococcus pyogenes pn:emm12(a207) gn:emm12(a207) le:1 re:>459 di:direct nt:igg3-binding protein |
| CONTIG5815 | 2745675_f3_25 | 2168 | 16271 | 372 | 124 | U63134 | 91 | 0.00051 | Streptococcus pyogenes | or:streptococcus pyogenes le:<1 re:756 di:complement nt:the 5' end of the open reading frame shows |
| CONTIG3669 | 4485750_c2_6 | 2169 | 16272 | 1914 | 638 | Z69926 | 101 | 0.039 | Yersinia enterocolitica | or:yersinia enterocolitica pn:yopm gn:yopm le:162 re:1265 di:direct |
| CONTIG3534 | 4335152_f1_1 | 2170 | 16273 | 732 | 244 | Z83316 | 92 | 0.2 | Caenorhabditis elegans | or:caenorhabditis elegans pn:b0379.f1 le;join(13467 re:13706, 13751 di:direct nt:protein predicted using genefinder |
| CONTIG5300 | 24804712_c3_9 | 2171 | 16274 | 729 | 243 | Z50109 | 117 | 6.7(10)-8 | Caenorhabditis elegans | or:caenorhabditis elegans pn:c09h10.6 le;join(35101 re:35213, 35265 di:direct nt:similar to histone binding protein; cdna est |
| CONTIG3861 | 4001556_f3_6 | 2172 | 16275 | 642 | 214 | Z78540 | 215 | 1.8(10)-16 | Caenorhabditis elegans | or:caenorhabditis elegans pn:c33g3,4 le;join(19807 re:19939,20519 di:direct nt:protein predicted using genefinder; similarity to |
| CONTIG4902 | 33397187_f2_2 | 2173 | 16276 | 408 | 136 | Z74030 | 130 | 4.2(10)-8 | Caenorhabditis elegans | or:caenorhabditis elegans pn:d1054.14 le;join(36950 re:37074,3726 di:complement nt:protein predicted using genefinder; cdna est |
| CONTIG4403 | 23915962_c2_17 | 2174 | 16277 | 609 | 203 | Z66496 | 151 | 7.4(10)-10 | Caenorhabditis elegans | or:caenorhabditis elegans pn:e04d5.1 le;join(6082 re:6250,6307 di:direct nt:cdna est yk84b6.3 comes from this gene; cdna est |
| CONTIG710 | 954507_c3_2 | 2175 | 16278 | 603 | 201 | Z68760 | 119 | 0.00011 | Caenorhabditis elegans | or:caenorhabditis elegans pn:f36h1.2 le;join(15689 re:15802,16087 di:direct nt:similarity to human ankaryin (sw:ankb_human); cdna |
| CONTIG3772 | 35366700_c1_6 | 2176 | 16279 | 582 | 194 | Z49938 | 161 | 1.3(10)-11 | Caenorhabditis elegans | or:caenorhabditis elegans pn:f38a3.2 le;join(15042 re:15879,1609 di:complement nt:similar to collagen; cdna est yk73f3.5 comes from |
| CONTIG5062 | 22063767_c1_6 | 2177 | 16280 | 309 | 103 | Z68218 | 218 | 4.7(10)-18 | Caenorhabditis elegans | or:caenorhabditis elegans pn:k01h12.1 le;join(7129 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2906 | 1039628_c2_8 | 2178 | 16281 | 492 | 164 | Z78544 | 90 | 0.058 | Caenorhabditis elegans | re:7235,7494 di:direct or:caenorhabditis elegans pn:k04g11.4 le:join(16299 re:16406,16931 di:direct nt:protein predicted using genefinder; similarity to |
| CONTIG5019 | 3985212_f1_1 | 2179 | 16282 | 246 | 82 | Z70284 | 107 | 3.2(10)-5 | Caenorhabditis elegans | or:caenorhabditis elegans pn:k07f5.14 le:join(28537 re:28761,28876 di:direct nt:cdna est ceesq6rt comes from this gene |
| CONTIG1504 | 10052018_c3_3 | 2180 | 16283 | 885 | 295 | U61957 | 123 | 8.2(10)-5 | Caenorhabditis elegans | or:caenorhabditis elegans gn:ac7.2 le:join(2255 re:2437,3752 di:direct sr:caenorhabditis elegans strain=bristol n2 nt:coded for by c. elegans cdna cm06e9; contains |
| CONTIG1620 | 15890968_c3_7 | 2181 | 16284 | 636 | 212 | U23453 | 199 | 4.9(10)-15 | Caenorhabditis elegans | or:caenorhabditis elegans gn:b0252.2 le:join(10366 re:10558,10610 di:direct sr:caenorhabditis elegans strain=bristol n2 nt:similar to sphingomyelin phosphodiesterase |
| CONTIG4806 | 26597307_c2_11 | 2182 | 16285 | 1335 | 445 | U80836 | 109 | 0.0032 | Caenorhabditis elegans | or:caenorhabditis elegans gn:b0432.9 le:join(22295 re:22415,2245 di:complement sr:caenorhabditis elegans strain=bristol n2 nt:contains similarity to a c3hc4-class zinc finger |
| CONTIG5287 | 4462_f3_4 | 2183 | 16286 | 1182 | 394 | L07143 | 105 | 0.032 | Caenorhabditis elegans | or:caenorhabditis elegans gn:b0523.5 le:join(10015 re:10029,1014 di:complement sr:caenorhabditis elegans strain=bristol n2 nt:leu repeats and gelsolin (d. melanogaster |
| CONTIG549 | 25446013_c3_4 | 2184 | 16287 | 606 | 202 | U53338 | 107 | 0.00051 | Caenorhabditis elegans | or:caenorhabditis elegans gn:c05c11.1 le:join(33372 re:33614,33670 di:direct sr:caenorhabditis elegans strain=bristol n2 |
| CONTIG4644 | 10812676_f3_6 | 2185 | 16288 | 366 | 122 | U61947 | 155 | 2.2(10)-11 | Caenorhabditis elegans | or:caenorhabditis elegans gn:c06g3.11 le:join(30495 re:30534,3072 di:complement sr:caenorhabditis elegans strain=bristol n2 |
| CONTIG3689 | 12994052_f2_2 | 2186 | 16289 | 1503 | 501 | U56965 | 90 | 0.41999 | Caenorhabditis elegans | or:caenorhabditis elegans gn:c15h9.4 le:join(12284 re:12437,12488 di:direct sr:caenorhabditis elegans strain=bristol n2 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5058 | 21994161_c2_6 | 2187 | 16290 | 666 | 222 | U23169 | 193 | 8.2(10)-15 | Caenorhabditis elegans | or:caenorhabditis elegans gn:c29h12.2 le:join(19961 re:20183,20227 di:direct sr:caenorhabditis elegans strain=bristol n2 nt:coded for by c. elegans cdna cm14g11 |
| b2x10185.x | 10991428_f2_1 | 2188 | 16291 | 492 | 164 | U88314 | 93 | 0.017 | Caenorhabditis elegans | or:caenorhabditis elegans gn:c46h11.2 le:join(30376 re:30456,30710 di:direct sr:caenorhabditis elegans strain=bristol n2 nt:coded for by c. elegans cdna yk167c11.5; coded for |
| CONTIG3886 | 6650763_f3_2 | 2189 | 16292 | 2115 | 705 | U80445 | 461 | 3.8(10)-45 | Caenorhabditis elegans | or:caenorhabditis elegans gn:c50f2.3 le:join(771 re:836,884 di:direct sr:caenorhabditis elegans strain=bristol n2 nt:coded for by c. elegans cdna yk13g5.3; coded for by |
| CONTIG5264 | 10938957_f3_3 | 2190 | 16293 | 744 | 248 | U39996 | 102 | 0.028 | Caenorhabditis elegans | or:caenorhabditis elegans gn:c56e6.6 le:join(28904 re:29200,2925 di:complement sr:caenorhabditis elegans strain=bristol n2 nt:coded for by c. elegans cdna yk132e5.5; coded for |
| CONTIG5283 | 34657540_f3_7 | 2191 | 16294 | 1569 | 523 | U13070 | 353 | 1.1(10)-31 | Caenorhabditis elegans | or:caenorhabditis elegans gn:f01f1.1 le:join(37237 re:37241,37471 di:direct sr:caenorhabditis elegans strain=bristol n2 nt:coded for by c. elegans cdna ceesb68f; coded for by |
| CONTIG2036 | 21523378_c3_5 | 2192 | 16295 | 939 | 313 | U40029 | 174 | 5.7(10)-14 | Caenorhabditis elegans | or:caenorhabditis elegans gn:f10g7.2 le:join(22509 re:22942,23020 di:direct sr:caenorhabditis elegans strain=bristol n2 nt:similar to human 100 kda coactivator (u22055) |
| CONTIG5638 | 2908260_f2_11 | 2193 | 16296 | 663 | 221 | U88176 | 149 | 3.5(10)-19 | Caenorhabditis elegans | or:caenorhabditis elegans gn:f18f11.1 le:join(12152 re:12273,12319 di:direct sr:caenorhabditis elegans strain=bristol n2 |
| CONTIG2278 | 10735912_c1_2 | 2194 | 16297 | 1554 | 518 | U53343 | 179 | 1.8(10)-10 | Caenorhabditis elegans | or:caenorhabditis elegans gn:f22f4.3 le:join(4805 re:4831,6545 di:direct sr:caenorhabditis elegans strain=bristol n2 nt:coded for by c. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x12379.x | 26252252_c1_2 | 2195 | 16298 | 834 | 278 | U40934 | 91 | 0.34999 | Caenorhabditis elegans | elegans cdna yk53c5.3; coded for by or:caenorhabditis elegans gn:f35h10.4 le:join(8199 re:8315,8607 di:direct sr:caenorhabditis elegans strain=bristol n2 nt:coded for by c. elegans cdna yk49d12.5; similar to |
| CONTIG3153 | 36366526_f3_2 | 2196 | 16299 | 843 | 281 | U41996 | 117 | 6.0(10)-5 | Caenorhabditis elegans | or:caenorhabditis elegans gn:f38e1.9 le:join(7863 re:8099,814 di:complement sr:caenorhabditis elegans strain=bristol n2 |
| b9x10190.x | 36573918_c3_8 | 2197 | 16300 | 486 | 162 | U55366 | 90 | 0.00097 | Caenorhabditis elegans | or:caenorhabditis elegans gn:f41f3.4 le:join(13544 re:14272,1433 di:complement sr:caenorhabditis elegans strain=bristol n2 nt:similar to cuticle collagen |
| CONTIG5810 | 14630378_f1_4 | 2198 | 16301 | 972 | 324 | U50313 | 470 | 9.3(10)-45 | Caenorhabditis elegans | or:caenorhabditis elegans gn:f44c4.5 le:join(17781 re:17978,1819 di:complement sr:caenorhabditis elegans strain=bristol n2 nt:similar to palmitoyl-protein thioesterase |
| CONTIG2346 | 5120306_c3_4 | 2199 | 16302 | 228 | 76 | U88173 | 277 | 2.6(10)-24 | Caenorhabditis elegans | or:caenorhabditis elegans gn:f46f11.4 le:join(6769 re:6877,756 di:complement sr:caenorhabditis elegans strain=bristol n2 nt:weak similarity to arabidopsis thaliana |
| CONTIG2566 | 21495953_c2_4 | 2200 | 16303 | 888 | 296 | U41109 | 91 | 0.5 | Caenorhabditis elegans | or:caenorhabditis elegans gn:f52e1.4 le:join(5058 re:5105,5154 di:direct sr:caenorhabditis elegans strain=bristol n2 nt:coded for by c. elegans cdna yk11c7.3; coded for by |
| CONTIG5603 | 859388_c2_10 | 2201 | 16304 | 1017 | 339 | U80436 | 96 | 0.29999 | Caenorhabditis elegans | or:caenorhabditis elegans gn:f55c7.7 le:join(24700 re:24729,2533 di:complement sr:caenorhabditis elegans strain=bristol n2 nt:strong similarity to human proto-oncogene dbl |
| CONTIG5500 | 16408425_c1_9 | 2202 | 16305 | 894 | 298 | U51993 | 304 | 3.6(10)-27 | Caenorhabditis elegans | or:caenorhabditis elegans gn:f56f10.3 le:join(10544 re:10633,1068 di:complement sr:caenorhabditis elegans |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5785 | 2343930_f1_6 | 2203 | 16306 | 546 | 182 | U70856 | 100 | 0.0067 | *Caenorhabditis elegans* | strain=bristol n2 nt:coded for by c. elegans cdna cm7a8; similar to or:caenorhabditis elegans gn:15f4.1 le:join(13373 re:13441,13488 di:direct sr:caenorhabditis elegans strain=bristol n2 nt:weak similarity to rat cytosolic acyl coenzyme a |
| CONTIG2224 | 9798431_c2_2 | 2204 | 16307 | 969 | 323 | U41625 | 112 | 0.00169 | *Caenorhabditis elegans* | or:caenorhabditis elegans gn:k03a1.2 le:join(15437 re:15775,16143 di:direct sr:caenorhabditis elegans strain=bristol n2 nt:coded for by c. elegans cdna yk133e1.5; coded for |
| CONTIG4454 | 23626542_c3_3 | 2205 | 16308 | 780 | 260 | Z66523 | 417 | 3.8(10)-39 | *Caenorhabditis elegans* | or:caenorhabditis elegans pn:m05d6.7 le:join(17855 re:17891,17945 di:direct nt:similar to gamma-butyrobetaine,2-oxoglutarate |
| CONTIG5572 | 20353186_c2_14 | 2206 | 16309 | 2445 | 815 | Z50796 | 92 | 0.51 | *Caenorhabditis elegans* | or:caenorhabditis elegans pn:t05a6.4 le:join(20406 re:20458,2062 di:complement nt:weak similarity to some rna directed |
| CONTIG4770 | 33632632_f3_5 | 2207 | 16310 | 990 | 330 | Z73098 | 103 | 0.032 | *Caenorhabditis elegans* | or:caenorhabditis elegans pn:t21c9.2 le:join(446 re:548,59 di:complement nt:weak similarity to the yeast kip1 protein (swiss |
| CONTIG5325 | 32437842_f1_1 | 2208 | 16311 | 303 | 101 | Z54238 | 117 | 1.5(10)-5 | *Caenorhabditis elegans* | or:caenorhabditis elegans pn:t28c6.7 le:join(21186 re:21335,21383 di:direct nt:weak similarity to myosin proteins; cdna est |
| CONTIG2858 | 4329057_c1_2 | 2209 | 16312 | 1293 | 431 | U19615 | 392 | 1.8(10)-35 | *Caenorhabditis elegans* | or:caenorhabditis elegans pn:let 858 gn:let-858 le:6 re:2699 di:direct |
| CONTIG3977 | 12131875_c2_7 | 2210 | 16313 | 684 | 228 | U33058 | 95 | 0.38 | *Caenorhabditis elegans* | or:caenorhabditis elegans pn:unc-89 gn:unc-89 le:join(4920 re:4969,5656 di:direct nt:giant ig superfamily member located in the middle |
| CONTIG5001 | 2166663_f1_1 | 2211 | 16314 | 1410 | 470 | U33058 | 114 | 5.0(10)-5 | *Caenorhabditis elegans* | or:caenorhabditis elegans pn:unc-89 gn:unc-89 le:join(4920 re:4969,5656 di:direct nt:giant ig superfamily member located in the middle |
| CONTIG5153 | 34086007_f1_1 | 2212 | 16315 | 216 | 72 | Z49969 | 90 | 0.0035 | *Caenorhabditis elegans* | or:caenorhabditis elegans pn:w01c9.3 le:join(8547 re:8589,8876 di:direct nt:cdna est |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3992 | 2157913_f2_2 | 2213 | 16316 | 495 | 165 | Z50029 | 102 | 0.00068 | Caenorhabditis elegans | yk13c5.3 comes from this gene; cdna est or:caenorhabditis elegans pn:zc504.3 le:join(15177 re:15381,15546 di:complement nt:cell division cycle 2-like protein; cdna est |
| CONTIG3043 | 22551877_c3_14 | 2214 | 16317 | 351 | 117 | Z47357 | 137 | 1.8(10)-8 | Caenorhabditis elegans | or:caenorhabditis elegans pn:zk1128.1 le:join(1289 re:1558,165 di:complement nt:cdna est ceesj77r comes from this gene; cdna est |
| CONTIG5679 | 12126285_c3_22 | 2215 | 16318 | 1425 | 475 | Z47357 | 270 | 1.8(10)-29 | Caenorhabditis elegans | or:caenorhabditis elegans pn:zk1128.1 le:join(1289 re:1558,165 di:complement nt:cdna est ceesj77r comes from this gene; cdna est |
| CONTIG5721 | 24104657_f1_1 | 2216 | 16319 | 198 | 66 | Z69385 | 112 | 8.0(10)-7 | Caenorhabditis elegans | or:caenorhabditis elegans pn:zk593.7 le:join(23733 re:23738,23793 di:direct nt:similarity to yeast jta107 protein (pir acc. no. |
| CONTIG3814 | 9942177_f1_1 | 2217 | 16320 | 678 | 226 | Z73899 | 90 | 0.07499 | Caenorhabditis elegans | or:caenorhabditis elegans pn:zk829.5 le:join(8904 re:9055,9109 di:direct |
| CONTIG3229 | 5892176_f1_1 | 2218 | 16321 | 612 | 204 | U07817 | 119 | 2.8(10)-5 | Dictyostelium discoideum | or:dictyostelium discoideum pn:glutamine-asparagine rich protein le:<1 re:2165 di:direct |
| CONTIG3405 | 24609468_f1_2 | 2219 | 16322 | 273 | 91 | U75467 | 110 | 2.2(10)-5 | Drosophila melanogaster | or:drosophila melanogaster pn:atu le:join(78 re:1373,147 di:complement srfruit fly nt:contains arg-ser and ser-arg dipeptides; c-terminal |
| CONTIG468 | 1953125_f1_1 | 2220 | 16323 | 1041 | 347 | U23930 | 105 | 0.0019 | Drosophila simulans | or:drosophila simulans pn:ref(2)p protein gn:dsim\ref(2)p le:join(137 re:308,949 di:direct nt:allele: im2 |
| CONTIG5388 | 30344201_f2_5 | 2221 | 16324 | 432 | 144 | X15081 | 104 | 3.5(10)-5 | Crithidia fasciculata | or:mitochondrion crithidia fasciculata le:856 re:1898 di:direct sr:crithidia fasciculata nt:murf2 protein (aa 1-348) |
| b2x14270.y | 4063377_c3_1 | 2222 | 16325 | 480 | 160 | U43145 | 91 | 0.03599 | Plasmodium chabaudi | or:plasmodium chabaudi pn:repeat organellar protein le:2158 re:7977 di:direct nt:rope |
| CONTIG4004 | 21662662_f2_3 | 2223 | 16326 | 279 | 93 | L04161 | 105 | 0.0004 | Plasmodium falciparum | or:plasmodium falciparum pn:pfg377 le:43 re:9402 di:direct sr:malaria parasite nt:gametocyte specific antigen |
| CONTIG3019 | 4725375_f3_1 | 2224 | 16327 | 1431 | 477 | L27838 | 90 | 0.96999 | Plasmodium yoelii | or:plasmodium yoelii pn:rhoptry protein le:76 re:6885 di:direct |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | sr:plasmodium yoelii (strain ym) dna |
| CONTIG3018 | 20350786_c1_1 | 2225 | 16328 | 972 | 324 | X95276 | 105 | 0.01499 | Plasmodium falciparum | or:plasmodium falciparum gn:clp (c?) le:10926 re:13226 di:direct sr:malaria parasite |
| CONTIG4690 | 25805_f2_2 | 2226 | 16329 | 912 | 304 | Z26314 | 94 | 0.13 | Plasmodium falciparum | or:plasmodium falciparum pn:starp antigen le;join(735 re:806,982 di:direct sr:malaria parasite |
| CONTIG5672 | 12687510_c3_23 | 2227 | 16330 | 564 | 188 | Z26314 | 100 | 0.01099 | Plasmodium falciparum | or:plasmodium falciparum pn:starp antigen le;join(735 re:806,982 di:direct sr:malaria parasite |
| CONTIG4156 | 13781552_f2_2 | 2228 | 16331 | 1005 | 335 | Z30339 | 101 | 0.029 | Plasmodium reichenowi | or:plasmodium reichenowi pn:starp antigen le;join(1 re:72,243 di:direct |
| CONTIG5768 | 1992062_f2_8 | 2229 | 16332 | 1314 | 438 | U36927 | 131 | 0.00012 | Plasmodium yoelii | or:plasmodium yoelii pn:rhoptry protein le:<1 re:7206 di:direct |
| CONTIG4431 | 9805287_f1_1 | 2230 | 16333 | 2718 | 906 | D28811 | 165 | 1.8(10)-8 | Schistosoma japonicum | or:schistosoma japonicum pn:paramyosin le:50 re:2650 di:direct sr:schistosoma japonicum (strain japanese) adult cdna to mrna, clon |
| b3x16066.y | 36019206_f1_1 | 2231 | 16334 | 585 | 195 | D83125 | 333 | 9.3(10)-30 | Sarcophaga peregrina | or:sarcophaga peregrina pn:secretory component le:169 re:1830 di:direct sr:sarcophaga peregrina cell_line:nih-sape-4 cdna to mrna |
| CONTIG1784 | 25195312_c2_12 | 2232 | 16335 | 279 | 93 | U22376 | 298 | 1.2(10)-25 | Homo sapiens | or:homo sapiens gn:c-myb le;join(2226 re:2248,6595 di:direct sr:human nt:alternatively spliced product using exon 13a |
| CONTIG5675 | 29891911_c2_16 | 2233 | 16336 | 2046 | 682 | U57758 | 262 | 2.2(10)-21 | Drosophila melanogaster | or:drosophila melanogaster pn:putative thyroid receptor interacting protein gn:alien le:58 re:1140 di:direct sr:fruit fly |
| CONTIG1713 | 9845311_c2_4 | 2234 | 16337 | 1035 | 345 | L03534 | 113 | 0.0067 | Entamoeba histolytica | or:entamoeba histolytica pn:myosin heavy chain gn:mhca le:368 re:6787 di:direct |
| CONTIG5429 | 3946957_f2_2 | 2235 | 16338 | 648 | 216 | D89205 | 321 | 5.7(10)-29 | Schizosaccharomyces pombe | or:schizosaccharomyces pombe le:88 re:1089 di:direct sr:schizosaccharomyces pombe (strain:pr745) cdna to mrna nt:similar to saccharomyces cerevisiae auxin-induced |
| CONTIG389 | 4865706_f2_4 | 2236 | 16339 | 558 | 186 | D89240 | 108 | 0.00024 | Schizosaccharomyces pombe | or:schizosaccharomyces pombe le:<1 re:854 di:direct sr:schizosaccharomyces pombe (strain:pr745) cdna to mrna |
| CONTIG4741 | 36360002_c3_14 | 2237 | 16340 | 1200 | 400 | D89245 | 282 | 9.3(10)-24 | Schizosaccharomyces pombe | or:schizosaccharomyces pombe nt:unnamed protein product le:<1 re:1549 di:direct |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4969 | 12554680_c3_11 | 2238 | 16341 | 519 | 173 | X86470 | 309 | 1.1(10)-27 | Saccharomyces cerevisiae | sr:schizosaccharomyces pombe (strain:pr745) cdna to mrna nt:similar to human protein kinase c substrate, 80kd or:saccharomyces cerevisiae pn:unknown gn:odp2 le:19206 re:19571 di:complement sr:baker's yeast nt:n2375, len:121, cai:0.089 |
| CONTIG5614 | 9876532_c1_18 | 2239 | 16342 | 198 | 66 | Z81038 | 184 | 1.8(10)-14 | Caenorhabditis elegans | or:caenorhabditis elegans pn:c25a1.6 le:join(19836 re:20021,20161 di:direct nt:protein predicted using genefinder |
| CONTIG1841 | 12582563_c2_2 | 2240 | 16343 | 372 | 124 | Z83125 | 92 | 0.0011 | Caenorhabditis elegans | or:caenorhabditis elegans pn:15d6.12 le:join(27950 re:28052,2810 di:complement |
| CONTIG4717 | 12582563_f2_3 | 2241 | 16344 | 402 | 134 | Z83125 | 102 | 8.9(10)-5 | Caenorhabditis elegans | or:caenorhabditis elegans pn:15d6.12 le:join(27950 re:28052,2810 di:complement |
| CONTIG2959 | 3319087_c2_7 | 2242 | 16345 | 636 | 212 | Z92770 | 102 | 0.00095 | Mycobacterium tuberculosis | or:mycobacterium tuberculosis pn:unknown gn:mtci5.07 le:6144 re:6749 di:direct nt:mtci5.07, len: 201 aa, most similar to puac_strip |
| CONTIG5443 | 86593_c3_9 | 2243 | 16346 | 1386 | 462 | Z92770 | 100 | 0.00013 | Mycobacterium tuberculosis | or:mycobacterium tuberculosis pn:unknown gn:mtci5.07 le:6144 re:6749 di:direct nt:mtci5.07, len: 201 aa, most similar to puac_strip |
| CONTIG1249 | 35601452_c1_2 | 2244 | 16347 | 1176 | 392 | Z92770 | 740 | 2.2(10)-73 | Mycobacterium tuberculosis | or:mycobacterium tuberculosis pn:unknown gn:mtci5.28c le:27262 re:28473 di:complement nt:mtci5.28c, len:403 aa, c-terminal region similar |
| CONTIG3069 | 30250078_c3_3 | 2245 | 16348 | 1269 | 423 | Z83333 | 439 | 1.1(10)-40 | Emericella nidulans | or:emericella nidulans gn:pala le:join(491 re:498,548 di:direct |
| CONTIG5315 | 4782782_f1_3 | 2246 | 16349 | 1086 | 362 | Z83333 | 549 | 6.2(10)-53 | Emericella nidulans | or:emericella nidulans gn:pala le:join(491 re:498,548 di:direct |
| CONTIG5820 | 13937550_f3_46 | 2247 | 16350 | 297 | 99 | Z72500 | 345 | 3.0(10)-31 | Pylaiella littoralis | or:mitochondrion pylaiella littoralis pn:cytochrome oxidase, subunit i gn:cox1 ec:1.9.3.1 le:join(1 gn:817,3252 di:direct sr:pylaiella littoralis |
| CONTIG1578 | 2914063_c3_4 | 2248 | 16351 | 972 | 324 | X98130 | 179 | 4.4(10)-11 | Arabidopsis thaliana | or:arabidopsis thaliana pn:non-ltr retrotransposon reverse gn:orf7 le:37009 re:39690 di:complement sr:thale cress nt:premature stop codon - likely pseudogene |
| CONTIG1447 | 2353325_f2_1 | 2249 | 16352 | 702 | 234 | Y07867 | 428 | 2.6(10)-40 | Homo sapiens | or:homo sapiens pn:pirin le:205 re:1077 di:direct sr:human |
| CONTIG1289 | 7038417_f2_1 | 2250 | 16353 | 252 | 84 | Y07867 | 131 | 2.6(10)-8 | Homo sapiens | or:homo sapiens pn:pirin le:205 re:1077 di:direct sr:human |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2607 | 23836552_c3_6 | 2251 | 16354 | 588 | 196 | Y07867 | 341 | 4.4(10)-31 | Homo sapiens | or:homo sapiens pn:pirin le:205 re:1077 di:direct sr:human |
| CONTIG5442 | 3001301_c2_19 | 2252 | 16355 | 804 | 268 | Y07867 | 438 | 2.2(10)-41 | Homo sapiens | or:homo sapiens pn:pirin le:205 re:1077 di:direct sr:human |
| CONTIG5442 | 9797327_c1_10 | 2253 | 16356 | 1146 | 382 | Y07867 | 576 | 5.5(10)-56 | Homo sapiens | or:homo sapiens pn:pirin le:205 re:1077 di:direct sr:human |
| CONTIG4664 | 26362552_c3_8 | 2254 | 16357 | 1587 | 529 | U46857 | 94 | 0.029 | Anolis pulchellus | or:anolis pulchellus pn:vitellogenin le:<1 re:>546 di:direct nt:apvg5; similar to chicken and xenopus phosvitin |
| CONTIG4190 | 13931927_c2_9 | 2255 | 16358 | 2334 | 778 | U34662 | 95 | 0.34999 | Danio rerio | or:danio rerio pn:complement factor b le:15 re:2228 di:direct sr:zebrafish |
| CONTIG5650 | 2218826_f2_11 | 2256 | 16359 | 711 | 237 | X95074 | 150 | 1.8(10)-9 | Gallus gallus | or:gallus gallus pn:translin le:5 re:694 di:direct sr:chicken |
| CONTIG5427 | 24296937_f2_3 | 2257 | 16360 | 2883 | 961 | A08564 | 3639 | 0 | unidentified | or:unidentified pn:glucoamylase le:323 re:3199 di:direct |
| CONTIG5305 | 16832785_f3_6 | 2258 | 16361 | 1476 | 492 | U78721 | 95 | 0.09199 | Arabidopsis thaliana | or:arabidopsis thaliana pn:hypothetical protein gn:t01b08.6 le:join(24846 re:25193,2558 di:complement sr:thale cress |
| CONTIG1962 | 11727291_f2_1 | 2259 | 16362 | 876 | 292 | D83006 | 424 | 1.3(10)-38 | Saccharomyces cerevisiae | or:saccharomyces cerevisiae gn:mnn4 le:419 re:3955 di:direct sr:saccharomyces cerevisiae (strain:s288c) dna, clone:atcc70798 nt:gene required for phosphoylation of |
| CONTIG2573 | 3017188_f2_1 | 2260 | 16363 | 1230 | 410 | D83006 | 330 | 3.0(10)-34 | Saccharomyces cerevisiae | or:saccharomyces cerevisiae gn:mnn4 le:419 re:3955 di:direct sr:saccharomyces cerevisiae (strain:s288c) dna, clone:atcc70798 nt:gene required for phosphoylation of |
| CONTIG2738 | 9769380_c2_2 | 2261 | 16364 | 909 | 303 | D83006 | 177 | 6.7(10)-17 | Saccharomyces cerevisiae | or:saccharomyces cerevisiae gn:mnn4 le:419 re:3955 di:direct sr:saccharomyces cerevisiae (strain:s288c) dna, clone:atcc70798 nt:gene required for phosphoylation of |
| CONTIG3780 | 22071885_c1_4 | 2262 | 16365 | 924 | 308 | D83006 | 188 | 8.6(10)-22 | Saccharomyces cerevisiae | or:saccharomyces cerevisiae gn:mnn4 le:419 re:3955 di:direct sr:saccharomyces cerevisiae (strain:s288c) dna, clone:atcc70798 nt:gene required for phosphoylation of |
| CONTIG3780 | 4409760_c1_3 | 2263 | 16366 | 1005 | 335 | D83006 | 164 | 5.0(10)-9 | Saccharomyces cerevisiae | or:saccharomyces cerevisiae gn:mnn4 le:419 re:3955 di:direct sr:saccharomyces cerevisiae |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4825 | 20413430_f1_1 | 2264 | 16367 | 2043 | 681 | D83006 | 460 | 5.0(10)-56 | Saccharomyces cerevisiae | (strain:s288c) dna, clone:atcc70798 nt:gene required for phosphoylation of or:saccharomyces cerevisiae gn:mnn4 le:419 re:3955 di:direct sr:saccharomyces cerevisiae |
| CONTIG5641 | 175092_f1_3 | 2265 | 16368 | 2310 | 770 | D83006 | 324 | 1.6(10)-25 | Saccharomyces cerevisiae | (strain:s288c) dna, clone:atcc70798 nt:gene required for phosphoylation of or:saccharomyces cerevisiae gn:mnn4 le:419 re:3955 di:direct sr:saccharomyces cerevisiae (strain:s288c) dna, clone:atcc70798 nt:gene required for phosphoylation of |
| CONTIG2347 | 10048961_c3_4 | 2266 | 16369 | 258 | 86 | M59935 | 147 | 3.3(10)-10 | Emericella nidulans | or:emericella nidulans le:join(1138 re:1735,179 di:complement sr:emericella nidulans (strain fgsc a4) (clone:117e5) cdna to mrna nt:unidentified gene; orf |
| CONTIG4984 | 5128276_c2_9 | 2267 | 16370 | 783 | 261 | U19882 | 253 | 9.1(10)-22 | Emericella nidulans | or:emericella nidulans pn:flbd gn:flbd le:1278 re:2222 di:direct nt:myb-like dna binding protein |
| CONTIG2706 | 4329830_f3_2 | 2268 | 16371 | 432 | 144 | X95888 | 106 | 3.5(10)-6 | Kluyveromyces lactis | or:kluyveromyces lactis gn:som1 le:218 re:433 di:direct nt:putative or:kluyveromyces lactis pn:golgi |
| CONTIG5025 | 554511_c3_12 | 2269 | 16372 | 819 | 273 | U48413 | 462 | 6.5(10)-44 | Kluyveromyces lactis | upd-glcnac transporter mnn2-2p gn:kl.mnn2-2 le:244 re:1230 di:direct sr:kluyveromyces lactis strain=mg 1/2 |
| CONTIG5384 | 14333137_c3_20 | 2270 | 16373 | 798 | 266 | L35053 | 184 | 5.4(10)-13 | Magnaporthe grisea | or:magnaporthe grisea pn:reverse transcriptase gn:pol le:1757 re:5357 di:direct sr:magnaporthe grisea dna nt:homologue of retroviral pol genes; protease; |
| CONTIG5603 | 26445192_f3_6 | 2271 | 16374 | 3369 | 1123 | L35053 | 578 | 9.0(10)-53 | Magnaporthe grisea | or:magnaporthe grisea pn:reverse transcriptase gn:pol le:1757 re:5357 di:direct sr:magnaporthe grisea dna nt:homologue of retroviral pol genes; protease; |
| CONTIG5820 | 35991431_c2_74 | 2272 | 16375 | 312 | 104 | X75679 | 323 | 3.5(10)-29 | Candida parapsilosis | or:mitochondrion candida parapsilosis pn:cytochrome oxidase subunit 3 gn:cox3 le:62 re:871 di:direct sr:candida parapsilosis |
| CONTIG647 | 14490811_c3_2 | 2273 | 16376 | 519 | 173 | X95547 | 374 | 1.3(10)-34 | Neurospora crassa | or:neurospora crassa pn:ferredoxin-like iron-sulfur subunit of |
| CONTIG5820 | 19819050_f3_49 | 2274 | 16377 | 393 | 131 | U02970 | 244 | 8.3(10)-21 | Prototheca wickerhamii | ec:1.6.5.3 le:139 re:798 di:direct or:mitochondrion prototheca wickerhamii gn:ali1orf = ymf44 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5738 | 23915932_f3_7 | 2275 | 16378 | 1176 | 392 | S59774 | 1022 | 3.0(10)-103 | Saccharomyces cerevisiae | le:7715 re:8491 di:complement sr:prototheca wickerhamii nt:cox1 intron 1 orf, group i intronic orf |
| CONTIG5549 | 23610625_f1_1 | 2276 | 16379 | 3033 | 1011 | S78624 | 339 | 3.7(10)-46 | Saccharomyces cerevisiae | or:saccharomyces cerevisiae le:2422 re:3582 di:direct sr:baker's yeast nt:description:sti1 stress-inducible protein homolog; |
| CONTIG4957 | 4774050_f1_1 | 2277 | 16380 | 1536 | 512 | X04288 | 499 | 9.0(10)-55 | Saccharomyces cerevisiae | or:saccharomyces cerevisiae gn:ycr592 le:1695 re:5375 di:direct sr:baker's yeast nt:this sequence comes from FIG. 3. |
| CONTIG5774 | 23472885_f3_13 | 2278 | 16381 | 327 | 109 | X95258 | 126 | 2.6(10)-8 | Saccharomyces cerevisiae | or:saccharomyces cerevisiae gn:cdc37 sp:p06101 le:150 re:1499 di:direct sr:baker's yeast nt:cdc37 gene product (aa 1-440) |
| CONTIG1618 | 12516577_c2_4 | 2279 | 16382 | 243 | 81 | X87941 | 114 | 5.0(10)-7 | Saccharomyces cerevisiae | or:saccharomyces cerevisiae pn:unknown protein gn:smf1 le:3530 re:3901 di:direct sr:baker's yeast nt:internal to smf1 |
| CONTIG4735 | 190692_f3_2 | 2280 | 16383 | 1035 | 345 | L13655 | 97 | 0.014 | Saccharum sp. | or:saccharomyces cerevisiae gn:orf 143 le:14608 re:15039 di:complement sr:baker's yeast pn:membrane protein le:123 re:1100 di:direct sr:saccharum sp. (strain h65-7052) leaf cdna to mrna nt:putative |
| b3x16985.y | 30165686_c3_2 | 2281 | 16384 | 594 | 198 | X69881 | 328 | 4.4(10)-29 | Saccharomyces cerevisiae | or:saccharomyces cerevisiae le:2051 re:>3811 di:complement sr:baker's yeast nt:orf2 |
| CONTIG5154 | 493762_c1_13 | 2282 | 16385 | 819 | 273 | X62105 | 353 | 2.2(10)-32 | Saccharomyces cerevisiae | or:saccharomyces cerevisiae gn:tfs1 sp:p14306 le:639 re:1298 di:direct sr:baker's yeast |
| CONTIG1315 | 19703438_f3_2 | 2283 | 16386 | 474 | 158 | U01878 | 420 | 1.8(10)-39 | Saccharomyces cerevisiae | or:saccharomyces cerevisiae pn:unknown le:1365 re:1793 di:complement sr:baker's yeast |
| CONTIG3863 | 29475017_f2_2 | 2284 | 16387 | 1950 | 650 | U05211 | 626 | 2.7(10)-61 | Saccharomyces cerevisiae | or:saccharomyces cerevisiae pn:ttp1p gn:ttp1 le:222 re:2015 di:direct sr:baker's yeast nt:putative |
| CONTIG4502 | 29320413_f2_1 | 2285 | 16388 | 582 | 194 | U09129 | 257 | 4.9(10)-21 | Saccharomyces cerevisiae | or:saccharomyces cerevisiae pn:mkt1p gn:mkt1 le:311 re:2764 di:direct sr:baker's yeast |
| CONTIG4993 | 875002_c2_7 | 2286 | 16389 | 1011 | 337 | U09129 | 144 | 6.7(10)-7 | Saccharomyces cerevisiae | or:saccharomyces cerevisiae pn:mkt1p gn:mkt1 le:311 re:2764 di:direct sr:baker's yeast |
| CONTIG1554 | 35789040_f3_1 | 2287 | 16390 | 1017 | 339 | U59224 | 125 | 7.0(10)-5 | Schizosaccharomyces pombe | or:schizosaccharomyces pombe pn:byr4p gn:byr4 le:636 re:2633 di:direct sr:fission yeast |
| CONTIG5187 | 19963927_f1_4 | 2288 | 16391 | 1680 | 560 | L04488 | 653 | 4.2(10)-117 | Trichosporon cutaneum | or:trichosporon cutaneum pn:phenol hydroxylase le:1 re:1998 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2460 | 35629507_c2_1 | 2289 | 16392 | 795 | 265 | L12045 | 1172 | 3.7(10)-119 | *Candida albicans* | di:direct sr:*trichosporon cutaneum* (library: atcc 46490) cdna to mrna or:*candida albicans* pn:cyclic nucleotide phosphodiesterase gn:pde1 le:300 re:1580 di:direct sr:*candida albicans* (strain b792) dna |
| CONTIG5103 | 1210311_c1_6 | 2290 | 16393 | 1182 | 394 | L12450 | 1990 | 7.9(10)-206 | *Candida albicans* | or:*candida albicans* pn:secreted aspartyl proteinase 1 gn:sap1 le:1325 re:2500 di:direct sr:*candida albicans* (strain) dna |
| CONTIG2263 | 9860450_f2_1 | 2291 | 16394 | 1149 | 383 | L13380 | 1761 | 1.5(10)-181 | *Candida albicans* | or:*candida albicans* pn:trna ligase le:121 re:2619 di:direct sr:*candida albicans* (strain sc5314) dna nt:bicub |
| CONTIG4894 | 1975931_f1_1 | 2292 | 16395 | 1794 | 598 | D38310 | 575 | 8.6(10)-61 | *Saccharomyces cerevisiae* | or:*saccharomyces cerevisiae* pn:boi2p gn:boi2 le:79 re:3201 di:direct sr:*saccharomyces cerevisiae* dna nt:encoding sh3 domain, proline-rich sequence for sh3 |
| CONTIG5399 | 2743877_f2_3 | 2293 | 16396 | 576 | 192 | M88172 | 216 | 7.7(10)-18 | *Saccharomyces cerevisiae* | or:*saccharomyces cerevisiae* le:1362 re:1362 di:complement sr:*saccharomyces cerevisiae* (library: lambda embl3 sau3a partia nt:orf2 |
| CONTIG2445 | 13835937_c2_2 | 2294 | 16397 | 1041 | 347 | M88172 | 354 | 1.8(10)-32 | *Saccharomyces cerevisiae* | or:*saccharomyces cerevisiae* le:1614 re:2555 di:complement sr:*saccharomyces cerevisiae* (library: lambda embl3 sau3a partia nt:orf3 |
| CONTIG3948 | 33707167_c3_8 | 2295 | 16398 | 264 | 88 | L37084 | 131 | 6.2(10)-8 | *Schizosaccharomyces pombe* | or:*schizosaccharomyces pombe* pn:phosphopyruvate hydratase ec:4.2.1.11 le:2 re:1342 di:complement sr:*schizosaccharomyces pombe* cdna to mrna |
| CONTIG3588 | 4328812_f2_3 | 2296 | 16399 | 1248 | 416 | D30801 | 94 | 0.07099 | *Zinnia elegans* | or:*zinnia elegans* pn:ted3 le:264 re:1223 di:direct sr:*zinnia elegans* xylem tracheary element cdna to mrna |
| CONTIG4873 | 12010012_c3_10 | 2297 | 16400 | 3216 | 1072 | U68408 | 716 | 1.6(10)-68 | *Zea mays* | or:*zea mays* gn:pol re:3696 re:6902 di:direct sr:*maize* nt:5' end not determined experimentally |
| CONTIG4571 | 10344801_c2_5 | 2298 | 16401 | 897 | 299 | D42138 | 407 | 4.4(10)-38 | *Homo sapiens* | or:*homo sapiens* pn:pig-b le:45 re:1709 di:direct sr:*homo sapiens* cell_lib:human p3 nt:mrna, clone_lib:human p3 nt:involvement of gpi-anchor biosynthesis |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5493 | 3915625_f2_5 | 2299 | 16402 | 747 | 249 | D63484 | 230 | 4.7(10)-18 | Homo sapiens | or:homo sapiens gn:kiaa0150 le:<2 re:2836 di:direct sr:homo sapiens male myeloblast cell_line:kg-1 cdna to mrna nt:the kiaa0150 gene product is novel. |
| CONTIG5167 | 26601525_c2_14 | 2300 | 16403 | 453 | 151 | D84307 | 209 | 1.3(10)-16 | Homo sapiens | or:homo sapiens pn:phosphoethanolamine cytidylyltransferase le:67 re:1236 di:direct sr:homo sapiens glioblastoma cdna nt:ctp |
| CONTIG3102 | 10975925_c2_3 | 2301 | 16404 | 801 | 267 | Z54367 | 93 | 0.73999 | Homo sapiens | or:homo sapiens pn:plectin le:1 re:14055 di:direct sr:human |
| CONTIG2984 | 24617002_f2_3 | 2302 | 16405 | 1740 | 580 | U22055 | 408 | 3.3(10)-37 | Homo sapiens | or:homo sapiens pn:100 kda coactivator le:268 re:2925 di:direct sr:human |
| CONTIG5716 | 16875_f1_1 | 2303 | 16406 | 393 | 131 | U66616 | 95 | 0.00169 | Homo sapiens | or:homo sapiens pn:swi/snf complex 170 kda subunit gn:baf170 le:23 re:3664 di:direct sr:human nt:similar to human baf155 and yeast swi3; contains a |
| CONTIG5442 | 14881583_c1_11 | 2304 | 16407 | 342 | 114 | D26018 | 114 | 5.0(10)-6 | Homo sapiens | or:homo sapiens gn:kiaa0039 le:<1 re:1476 di:direct sr:homo sapiens male myeloblast cell_line kg-1 cdna to mrna |
| CONTIG2286 | 33382873_f2_1 | 2305 | 16408 | 753 | 251 | M31467 | 686 | 1.2(10)-67 | Homo sapiens | or:homo sapiens le:1 re:576 di:direct sr:human teratocarcinoma cell line ntera2/d1, cdna to mrna, clon nt:ras-like protein |
| CONTIG2994 | 26594078_c1_4 | 2306 | 16409 | 1455 | 485 | S47242 | 149 | 1.2(10)-7 | Homo sapiens | or:homo sapiens gn:son le:1 re:1233 di:direct sr:human placenta nt:description: putative dna binding protein; this |
| CONTIG3666 | 3914090_f2_1 | 2307 | 16410 | 1254 | 418 | U76374 | 165 | 2.8(10)-9 | Mus musculus | or:mus musculus pn:skm-bop2 gn:bop le:1452 re:2885 di:direct sr:house mouse nt:allele b; alternatively spliced form lacking exon |
| CONTIG1843 | 6909425_f1_1 | 2308 | 16411 | 555 | 185 | M36227 | 94 | 9.4(10)-5 | Mus musculus | or:mus musculus pn:immunoglobulin heavy chain v-region gn:igh le:<1 re:>345 di:direct sr:mouse (strain balb/c), cdna to mrna, from hydridoma h35-c7 |
| CONTIG1785 | 25959837_f1_1 | 2309 | 16412 | 330 | 110 | U32575 | 94 | 0.00119 | Rattus norvegicus | or:rattus norvegicus gn:rssec6 le:1 re:>2265 di:direct sr:norway rat nt:similar to yeast sec6p, swiss-prot accession number |
| CONTIG5339 | 6679633_c2_9 | 2310 | 16413 | 1308 | 436 | U83119 | 221 | 7.7(10)-15 | Rattus norvegicus | or:rattus norvegicus le:<1 re:3903 di:direct sr:norway rat nt:orf2 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5606 | 14648437_f2_16 | 2311 | 16414 | 885 | 295 | U20341 | 94 | 0.33 | *Cassava vein mosaic virus* | consensus sequence encoding endonuclease and or:*cassava vein mosaic virus* le:30 re:4148 di:direct nt:orf i |
| CONTIG5789 | 23886702_c2_28 | 2312 | 16415 | 885 | 295 | X93351 | 100 | 0.025 | *Little cherry closterovirus* | or:*little cherry closterovirus* gn:orf2, unknown le:1834 re:3387 di:direct |
| b1x10404.x | 2400633_f2_1 | 2313 | 16416 | 759 | 253 | U26458 | 192 | 1.3(10)-13 | *Snakehead retrovirus* | or:*snakehead retrovirus* pn:gag-pol polyprotein gn:gag-pol le:337 re:6390 di:direct nt:the pol protein is presumed to be derived from the |
| CONTIG5718 | 40877_c1_14 | 2314 | 16417 | 1245 | 415 | Q45423 | 94 | 0.08599 | *Burkholderia* sp. | |
| CONTIG1735 | 433207_f2_1 | 2315 | 16418 | 1002 | 334 | Z66567 | 105 | 0.01099 | *Caenorhabditis elegans* | zk455.4,, |
| CONTIG3993 | 16587782_c3_10 | 2316 | 16419 | 1143 | 381 | Z66567 | 92 | 0.26 | *Caenorhabditis elegans* | zk455.4,, |
| CONTIG3823 | 17132_c2_11 | 2317 | 16420 | 765 | 255 | Y11066 | 93 | 0.17 | *Drosophila melanogaster* | ,,klu |
| b3x16054.y | 24081942_c3_5 | 2318 | 16421 | 765 | 255 | Y09542 | 1196 | 1.1(10)-121 | *Aspergillus fumigatus* | ,,chse |
| CONTIG3619 | 21484438_f1_1 | 2319 | 16422 | 411 | 137 | U72633 | 208 | 1.0(10)-21 | *Saccharomyces cerevisiae* | rna annealing protein yra1p,,yra1 |
| b9x12s39.x | 10198957_f1_1 | 2320 | 16423 | 594 | 198 | P74208 | 93 | 0.05 | *Synechocystis* sp. | ctp synthase, \(utp–ammonia ligase) \(ctp synthetase), |
| CONTIG3934 | 9878567_f1_1 | 2321 | 16424 | 420 | 140 | Q12024 | 428 | 2.6(10)-40 | *Saccharomyces cerevisiae* | microtubule-associated protein ytm1, |
| CONTIG3970 | 10634687_f1_3 | 2322 | 16425 | 486 | 162 | Q12024 | 411 | 1.7(10)-38 | *Saccharomyces cerevisiae* | microtubule-associated protein ytm1, |
| CONTIG4650 | 23611307_f1_3 | 2323 | 16426 | 612 | 204 | P55441 | 321 | 5.7(10)-29 | *Rhizobium* sp. | hypothetical monooxygenase y4fc,, |
| CONTIG5510 | 29315900_f1_3 | 2324 | 16427 | 1095 | 365 | P55487 | 328 | 6.7(10)-29 | *Rhizobium* sp. | probable monooxygenase y4id,, |
| CONTIG5690 | 4797161_c3_23 | 2325 | 16428 | 1116 | 372 | Q00319 | 371 | 2.8(10)-34 | *Candida boidinii* | peroxisomal membrane protein pmp47b, |
| CONTIG4877 | 29298187_f1_1 | 2326 | 16429 | 855 | 285 | Q12380 | 215 | 9.8(10)-18 | *Saccharomyces cerevisiae* | autophagy protein apg5, |
| CONTIG4764 | 4882763_f3_3 | 2327 | 16430 | 1404 | 468 | Q92262 | 275 | 1.1(10)-23 | *Pichia pastoris* | peroxisomal membrane protein pas2 \(peroxin-3), |
| CONTIG5710 | 16228311_c3_23 | 2328 | 16431 | 375 | 125 | Q92262 | 113 | 5.7(10)-6 | *Pichia pastoris* | peroxisomal membrane protein pas2 \(peroxin-3), |
| CONTIG5411 | 23600651_c3_15 | 2329 | 16432 | 1218 | 406 | Q01962 | 226 | 6.0(10)-16 | *Pichia pastoris* | peroxisomal protein per3 precursor \(peroxin-8), |
| CONTIG4573 | 26379635_c1_11 | 2330 | 16433 | 198 | 66 | Q08446 | 167 | 6.0(10)-12 | *Saccharomyces cerevisiae* | sgt1 protein, |
| CONTIG3702 | 26066076_f3_3 | 2331 | 16434 | 1284 | 428 | Q01961 | 500 | 8.0(10)-60 | *Pichia pastoris* | peroxisome assembly protein pas10 \(peroxin-12), |
| CONTIG3716 | 4696890_c1_6 | 2332 | 16435 | 354 | 118 | S72314 | 167 | 1.2(10)-12 | *Saccharomyces cerevisiae* | , |
| CONTIG3861 | 22845337_c1_7 | 2333 | 16436 | 480 | 160 | JC5096 | 152 | 4.5(10)-10 | *Cochliobolus carbonum* | , |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5143 | 26272827_c3_20 | 2334 | 16437 | 798 | 266 | S74287 | 510 | 5.4(10)-49 | Saccharomyces cerevisiae | , |
| CONTIG922 | 13704080_c3_3 | 2335 | 16438 | 594 | 198 | S74280 | 545 | 3.2(10)-52 | Saccharomyces cerevisiae | , |
| CONTIG5673 | 22079077_c2_30 | 2336 | 16439 | 2436 | 812 | S74291 | 452 | 5.7(10)-46 | Saccharomyces cerevisiae | , |
| CONTIG5038 | 11759430_c2_6 | 2337 | 16440 | 2277 | 759 | S74293 | 249 | 2.5(10)-17 | Saccharomyces cerevisiae | , |
| CONTIG1877 | 6523431_f2_3 | 2338 | 16441 | 582 | 194 | Z95151 | 92 | 0.07 | Mycobacterium leprae | purl,,purl,mlcb5.30, purl, phosphoribosylformylglycinamidine |
| CONTIG5464 | 9891030_f1_3 | 2339 | 16442 | 1377 | 459 | U97002 | 269 | 1.8(10)-20 | Caenorhabditis elegans | ,,kt09h11.1,coded for by c. elegans cdna yk44f8.5; coded for by |
| CONTIG4767 | 10625702_f1_1 | 2340 | 16443 | 453 | 151 | U97552 | 258 | 2.7(10)-22 | Caenorhabditis elegans | ,,w05h7.3,coded for by c. elegans cdna yk165e3.3; coded for |
| CONTIG4901 | 3940880_f2_1 | 2341 | 16444 | 732 | 244 | U97405 | 192 | 2.7(10)-15 | Caenorhabditis elegans | ,,t09b4.10,coded for by c. elegans cdna ceesu71r; contains |
| CONTIG5388 | 30195287_c3_11 | 2342 | 16445 | 1482 | 494 | U92879 | 221 | 3.7(10)-16 | Schizosaccharomyces pombe | cyclin c homolog 1,,pch1,similar to rattus rattus cyclin c encoded by the |
| CONTIG1770 | 511452_f3_1 | 2343 | 16446 | 534 | 178 | U79010 | 245 | 2.2(10)-20 | Borago officinalis | delta 6 desaturase,,, |
| CONTIG5746 | 1173436_f3_9 | 2344 | 16447 | 735 | 245 | U93563 | 236 | 1.7(10)-18 | Homo sapiens | putative p150,,orf2 |
| CONTIG5472 | 13847552_f1_2 | 2345 | 16448 | 1149 | 383 | U80223 | 93 | 0.60999 | Drosophila melanogaster | eukaryotic initiation factor eif-2 alpha kinase,,,similar to yeast gen2 protein kinase; dgcn2 |
| CONTIG1655 | 4694025_c2_3 | 2346 | 16449 | 219 | 73 | AF002109 | 96 | 0.00019 | Arabidopsis thaliana | ,,t29m21.15,26s proteasome regulatory subunit s12 isolog |
| CONTIG1812 | 15632252_c3_6 | 2347 | 16450 | 1299 | 433 | AF003148 | 126 | 6.7(10)-5 | Caenorhabditis elegans | ,,f3b5.7,coded for by c. elegans cdna yk93g1.3; coded for by |
| CONTIG3216 | 32101663_f1_1 | 2348 | 16451 | 948 | 316 | AF003148 | 106 | 0.00779 | Caenorhabditis elegans | ,,f32b5.7,coded for by c. elegans cdna yk93g1.3; coded for by |
| CONTIG3280 | 25437566_c3_9 | 2349 | 16452 | 912 | 304 | AF003148 | 96 | 0.083 | Caenorhabditis elegans | ,,f32b5.7,coded for by c. elegans cdna yk93g1.3; coded for by |
| CONTIG5131 | 22367135_f2_1 | 2350 | 16453 | 2043 | 681 | AF003148 | 120 | 0.00085 | Caenorhabditis elegans | ,,f32b5.7,coded for by c. elegans cdna yk93g1.3; coded for by |
| CONTIG5318 | 34017252_c1_6 | 2351 | 16454 | 1992 | 664 | AF003148 | 141 | 4.0(10)-6 | Caenorhabditis elegans | ,,f32b5.7,coded for by c. elegans cdna yk93g1.3; coded for by |
| CONTIG5404 | 511501_f1_1 | 2352 | 16455 | 1788 | 596 | AF003148 | 117 | 0.0015 | Caenorhabditis elegans | ,,f32b5.7,coded for by c. elegans cdna yk93g1.3; coded for by |
| CONTIG5817 | 29297186_f3_20 | 2353 | 16456 | 2127 | 709 | AF003148 | 131 | 4.7(10)-5 | Caenorhabditis elegans | ,,f32b5.7,coded for by c. elegans cdna yk93g1.3; coded for by |
| CONTIG5803 | 2481816_f3_15 | 2354 | 16457 | 1059 | 353 | AF003148 | 103 | 0.025 | Caenorhabditis elegans | ,,f32b5.7,coded for by c. elegans cdna yk93g1.3; coded for by |
| CONTIG2676 | 9867915_c2_2 | 2355 | 16458 | 1260 | 420 | AB003310 | 1035 | 1.3(10)-104 | Candida albicans | chitin synthase regulatory factor,,, |
| CONTIG190 | 14460082_c2_2 | 2356 | 16459 | 699 | 233 | D21852 | 90 | 0.31 | Homo sapiens | ,,kiaa0029, |
| CONTIG4687 | 4095138_f1_3 | 2357 | 16460 | 690 | 230 | Y12314 | 729 | 3.2(10)-72 | Schizosaccharomyces pombe | gtpase,,spg1, |
| CONTIG3299 | 35156555_f2_1 | 2358 | 16461 | 522 | 174 | Y12886 | 156 | 1.8(10)-11 | Amanita | dopa-dioxygenase,,doda, |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4483 | 26462787_c2_15 | 2359 | 16462 | 381 | 127 | Y12886 | 147 | 1.6(10)-10 | *Amanita muscaria* | dopa-dioxygenase,,doda, muscaria |
| CONTIG4458 | 4022651_f1_1 | 2360 | 16463 | 1215 | 405 | Z95395 | 390 | 3.0(10)-48 | *Schizosaccharomyces pombe* | unknown,,spac3a12.11c,spac3a12.11c, unknown, len |
| CONTIG1170 | 22772832_f1_1 | 2361 | 16464 | 816 | 272 | Z95395 | 213 | 2.2(10)-16 | *Schizosaccharomyces pombe* | unknown,,spac3a12.15,spac3a12.15, unknown, len |
| CONTIG3726 | 11725652_c3_8 | 2362 | 16465 | 606 | 202 | Z95396 | 197 | 7.9(10)-16 | *Schizosaccharomyces pombe* | unknown,,spac57a7.01,spac57a7.0 1, unknown; partial, len |
| CONTIG2188 | 20563588_f2_1 | 2363 | 16466 | 702 | 234 | Z95396 | 114 | 0.0014 | *Schizosaccharomyces pombe* | unknown,,spac57a7.05,spac57a7.0 5, unknown, len |
| CONTIG5524 | 33595927_c3_19 | 2364 | 16467 | 3447 | 1149 | Z95396 | 424 | 1.8(10)-52 | *Schizosaccharomyces pombe* | unknown,,spac57a7.05,spac57a7.0 5, unknown, len |
| CONTIG5015 | 22443762_c3_3 | 2365 | 16468 | 813 | 271 | Z95397 | 399 | 3.1(10)-37 | *Schizosaccharomyces pombe* | unknown,,spbc25h2.06c,spbc25h2. 06c, hypothetical integral membrane |
| CONTIG4131 | 16132692_f2_2 | 2366 | 16469 | 1746 | 582 | AC001645 | 103 | 0.039 | *Arabidopsis thaliana* | ,,t02o04.10,jasmonate inducible protein isolog |
| CONTIG601 | 10833550_f2_2 | 2367 | 16470 | 870 | 290 | X97908 | 114 | 0.00095 | *Vicia faba* | transcription factor,,,putative |
| CONTIG5653 | 16488950_c3_21 | 2368 | 16471 | 987 | 329 | AF003137 | 522 | 2.8(10)-50 | *Caenorhabditis elegans* | ,,c27a12.8, |
| CONTIG5424 | 14485962_f1_1 | 2369 | 16472 | 1881 | 627 | U97106 | 119 | 0.00239 | *Arabidopsis thaliana* | downy mildew resistance protein rpp5,,rpp5, |
| CONTIG2134 | 14457525_c3_5 | 2370 | 16473 | 870 | 290 | Z95586 | 265 | 1.3(10)-22 | *Mycobacterium tuberculosis* | unknown,,mtcy336.12,mtcy336.12, len |
| CONTIG2491 | 1181561_f2_4 | 2371 | 16474 | 858 | 286 | Z95586 | 274 | 1.2(10)-23 | *Mycobacterium tuberculosis* | unknown,,mtcy336.12,mtcy336.12, len |
| CONTIG4177 | 30116378_c2_5 | 2372 | 16475 | 1272 | 424 | Z95586 | 405 | 7.2(10)-38 | *Mycobacterium tuberculosis* | unknown,,mtcy336.12,mtcy336.12, len |
| CONTIG4394 | 22265877_c3_7 | 2373 | 16476 | 1404 | 468 | Z95586 | 332 | 9.4(10)-36 | *Mycobacterium tuberculosis* | unknown,,mtcy336.12,mtcy336.12, len |
| CONTIG4449 | 11910930_f2_2 | 2374 | 16477 | 687 | 229 | Z95586 | 235 | 2.7(10)-19 | *Mycobacterium tuberculosis* | unknown,,mtcy336.12,mtcy336.12, len |
| CONTIG4449 | 24335137_f3_4 | 2375 | 16478 | 798 | 266 | Z95586 | 142 | 2.8(10)-7 | *Mycobacterium tuberculosis* | unknown,,mtcy336.12,mtcy336.12, len |
| CONTIG4509 | 1181561_c3_7 | 2376 | 16479 | 1386 | 462 | Z95586 | 353 | 2.2(10)-32 | *Mycobacterium tuberculosis* | unknown,,mtcy336.12,mtcy336.12, len |
| CONTIG4587 | 662505_c2_7 | 2377 | 16480 | 1266 | 422 | Z95586 | 388 | 4.5(10)-36 | *Mycobacterium tuberculosis* | unknown,,mtcy336.12,mtcy336.12, len |
| CONTIG5106 | 1048127_f2_2 | 2378 | 16481 | 816 | 272 | Z95586 | 91 | 0.17999 | *Mycobacterium tuberculosis* | unknown,,mtcy336.12,mtcy336.12, len |
| CONTIG5214 | 24609633_c3_20 | 2379 | 16482 | 882 | 294 | Z95586 | 158 | 1.5(10)-13 | *Mycobacterium tuberculosis* | unknown,,mtcy336.12,mtcy336.12, len |
| CONTIG5593 | 10751268_f2_3 | 2380 | 16483 | 1314 | 438 | Z95586 | 385 | 9.5(10)-36 | *Mycobacterium tuberculosis* | unknown,,mtcy336.12,mtcy336.12, len |
| CONTIG5722 | 19640702_f2_4 | 2381 | 16484 | 801 | 267 | Z95586 | 366 | 9.8(10)-34 | *Mycobacterium tuberculosis* | unknown,,mtcy336.12,mtcy336.12, len |
| CONTIG5722 | 4773400_f2_5 | 2382 | 16485 | 585 | 195 | Z95586 | 104 | 0.0028 | *Mycobacterium tuberculosis* | unknown,,mtcy336.12,mtcy336.12, len |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG629 | 10391885_f3_2 | 2383 | 16486 | 609 | 203 | Z95586 | 219 | 1.7(10)-17 | *Mycobacterium tuberculosis* | unknown,,mtcy336.12,mtcy336.12. len [PN:hypothetical protein YJL204c]hypothetical protein J0318]hypothetical protein J0320]hypothetical protein YJL205c] [MP:10L] |
| CONTIG3337 | 22348461_f3_2 | 2384 | 16487 | 573 | 191 | S77615 | 423 | 7.0(10)-39 | *Saccharomyces cerevisiae* | [GN:MDL1] [SR:;YEAST] [DE:ATP-DEPENDENT PERMEASE MDL1] [SP:P97998] |
| CONTIG3158 | 22301376_c1_7 | 2385 | 16488 | 747 | 249 | P97998 | 795 | 3.3(10)-79 | *Candida albicans* | [GN:PEL1:YCLUN3W] [SR:,YEAST] [EC:2.7.8.8] [DE:(EC 2.7.8.8) (PHOSPHATIDYLSERINE SYNTHASE)] [SP:P79001] |
| CONTIG4519 | 12678325_c3_5 | 2386 | 16489 | 1524 | 508 | P79001 | 1097 | 3.3(10)-111 | *Saccharomyces pastorianus* | [GN:CIT] [SR:,YEAST] [EC:4.1.3.7] [DE:CITRATE SYNTHASE, MITOCHONDRIAL PRECURSOR.] [SP:P79024] |
| CONTIG3423 | 21640885_c3_9 | 2387 | 16490 | 186 | 62 | P79024 | 121 | 8.0(10)-7 | *Candida tropicalis* | [SR:,RAT] [DE:CYCLIC-NUCLEOTIDE-GATED OLFACTORY CHANNEL OCNC2 SUBUNIT] [SP:Q64359] |
| CONTIG3630 | 4789680_c2_5 | 2388 | 16491 | 426 | 142 | Q64359 | 115 | 4.9(10)-6 | *Rattus norvegicus* | [EC:1.4.3.3] [DE:D-AMINO ACID OXIDASE, (DAMOX) (DAO) (DAAO)] [SP:Q99042] |
| CONTIG2579 | 21882686_c3_7 | 2389 | 16492 | 1107 | 369 | Q99042 | 526 | 1.1(10)-50 | *Trigonopsis variabilis* | [SR:,TIF45:TIF1] [SR:FISSION YEAST] [DE:CAP-BINDING PROTEIN) (EIF-4F 25 KD SUBUNIT)] [SP:P78954] |
| b3x16009.y | 6370807_f1_2 | 2390 | 16493 | 198 | 66 | P78954 | 127 | 2.7(10)-8 | *Schizosaccharomyces pombe* | [GN:YDL222C] [SR:,BAKER'S YEAST] [DE:HYPOTHETICAL 34.1 KD PROTEIN IN CDC13-GCS1 INTERGENIC REGION] [SP:Q07651] |
| CONTIG5179 | 4079510_c2_16 | 2391 | 16494 | 867 | 289 | Q07651 | 304 | 3.6(10)-27 | *Saccharomyces cerevisiae* | [GN:CFL1] [SR:,YEAST] [DE:PROBABLE FERRIC REDUCTASE TRANSMEMBRANE COMPONENT] [SP:P78588] |
| CONTIG4657 | 1978136_f2_3 | 2392 | 16495 | 702 | 234 | P78588 | 119 | 0.00012 | *Candida albicans* | [GN:CFL1] [SR:,YEAST] [DE:PROBABLE FERRIC REDUCTASE TRANSMEMBRANE COMPONENT] [SP:P78588] |
| CONTIG4681 | 47011_c1_1 | 2393 | 16496 | 813 | 271 | P78588 | 125 | 8.8(10)-13 | *Candida albicans* | [GN:CFL1] [SR:,YEAST] [DE:PROBABLE FERRIC REDUCTASE TRANSMEMBRANE COMPONENT] [SP:P78588] |
| CONTIG4739 | 13954437_c3_4 | 2394 | 16497 | 2166 | 722 | P78588 | 2911 | 0 | *Candida albicans* | [GN:CFL1] [SR:,YEAST] [DE:PROBABLE FERRIC REDUCTASE TRANSMEMBRANE |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4876 | 20488905_f2_2 | 2395 | 16498 | 1368 | 456 | P78588 | 1576 | 5.9(10)-162 | Candida albicans | [GN:CFL1] [SR:;YEAST] [DE:PROBABLE FERRIC REDUCTASE TRANSMEMBRANE COMPONENT] [SP:P78588] |
| CONTIG660 | 4148317_f2_1 | 2396 | 16499 | 513 | 171 | P78588 | 402 | 5.5(10)-37 | Candida albicans | [GN:CFL1] [SR:;YEAST] [DE:PROBABLE FERRIC REDUCTASE TRANSMEMBRANE COMPONENT] [SP:P78588] |
| CONTIG312 | 898578_c2_2 | 2397 | 16500 | 501 | 167 | Q06706 | 367 | 2.0(10)-32 | Saccharomyces cerevisiae | [GN:IKI3:YLR384C:L3502.7] [SR:;BAKER'S YEAST] [DE:IKI3 PROTEIN] [SP:Q06706:O00036] |
| CONTIG4748 | 1057925_f1_1 | 2398 | 16501 | 264 | 88 | Q06706 | 285 | 1.1(10)-23 | Saccharomyces cerevisiae | [GN:IKI3:YLR384C:L3502.7] [SR:;BAKER'S YEAST] [DE:IKI3 PROTEIN] [SP:Q06706:O00036] |
| CONTIG4901 | 16113803_f2_2 | 2399 | 16502 | 1302 | 434 | Q06706 | 983 | 4.0(10)-99 | Saccharomyces cerevisiae | [GN:IKI3:YLR384C:L3502.7] [SR:;BAKER'S YEAST] [DE:IKI3 PROTEIN] [SP:Q06706:O00036] |
| CONTIG64 | 6048438_c2_2 | 2400 | 16503 | 501 | 167 | Q06706 | 339 | 1.8(10)-29 | Saccharomyces cerevisiae | [GN:IKI3:YLR384C:L3502.7] [SR:;BAKER'S YEAST] [DE:IKI3 PROTEIN] [SP:Q06706:O00036] |
| b1x15502.y | 9921942_c2_2 | 2401 | 16504 | 912 | 304 | Q06706 | 515 | 3.1(10)-48 | Saccharomyces cerevisiae | [GN:IKI3:YLR384C:L3502.7] [SR:;BAKER'S YEAST] [DE:IKI3 PROTEIN] [SP:Q06706:O00036] |
| CONTIG4363 | 15112562_c1_7 | 2402 | 16505 | 402 | 134 | P78587 | 611 | 1.1(10)-59 | Candida albicans | [GN:CGT1] [SR:;YEAST] [EC:2.7.7.50] [DE:(GTP--RNA GUANYLYTRANSFERASE)] [SP:P78587] |
| CONTIG718 | 6673506_c2_4 | 2403 | 16506 | 807 | 269 | P78587 | 1376 | 9.1(10)-141 | Candida albicans | [GN:CGT1] [SR:;YEAST] [EC:2.7.7.50] [DE:(GTP--RNA GUANYLYTRANSFERASE)] [SP:P78587] |
| CONTIG4324 | 33320135_f1_1 | 2404 | 16507 | 213 | 71 | Q02820 | 109 | 1.7(10)-6 | Saccharomyces cerevisiae | [GN:NCE1:YJL205BC] [SR:;BAKER'S YEAST] [DE:NON-CLASSICAL EXPORT PROTEIN NCE1] [SP:Q02820:O00038:O00037] |
| CONTIG5127 | 11876385_f1_1 | 2405 | 16508 | 195 | 65 | P80967 | 96 | 4.0(10)-5 | Saccharomyces cerevisiae | [GN:TOM5] [SR:;BAKER'S YEAST] [DE:MITOCHONDRIAL IMPORT RECEPTOR SUBUNIT TOM5] [SP:P80967] |
| CONTIG2633 | 13789075_f2_1 | 2406 | 16509 | 459 | 153 | Q12277 | 155 | 4.7(10)-17 | Saccharomyces cerevisiae | [GN:RRP42:YDL111C] [SR:;BAKER'S YEAST] [DE:RRP42 PROTEIN] [SP:Q12277] |
| b9x1t23.y | 16601562_f1_1 | 2407 | 16510 | 333 | 111 | Q12277 | 208 | 5.4(10)-17 | Saccharomyces cerevisiae | [GN:RRP42:YDL111C] [SR:;BAKER'S YEAST] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x12t23.y | 3227187_f3_2 | 2408 | 16511 | 354 | 118 | Q12277 | 154 | 4.7(10)-11 | Saccharomyces cerevisiae | [DE:RRP42 PROTEIN] [SP:Q12277] [GN:RRP42;YDL111C] [SR:;BAKER'S YEAST] [DE:RRP42 PROTEIN] [SP:Q12277] |
| CONTIG2256 | 1057031_c3_4 | 2409 | 16512 | 1269 | 423 | Q07878 | 826 | 1.1(10)-80 | Saccharomyces cerevisiae | [GN:VPS13;SOI1;YLL040C] [SR:;BAKER'S YEAST] [DE:VACUOLAR PROTEIN SORTING-ASSOCIATED PROTEIN VPS13] [SP:Q07878] |
| CONTIG2550 | 25916316_f2_1 | 2410 | 16513 | 939 | 313 | Q07878 | 751 | 9.9(10)-73 | Saccharomyces cerevisiae | [GN:VPS13;SOI1:YLL040C] [SR:;BAKER'S YEAST] [DE:VACUOLAR PROTEIN SORTING-ASSOCIATED PROTEIN VPS13] [SP:Q07878] |
| CONTIG3456 | 33672567_c1_5 | 2411 | 16514 | 1959 | 653 | Q07878 | 829 | 5.0(10)-81 | Saccharomyces cerevisiae | [GN:VPS13;SOI1:YLL040C] [SR:;BAKER'S YEAST] [DE:VACUOLAR PROTEIN SORTING-ASSOCIATED PROTEIN VPS13] [SP:Q07878] |
| CONTIG3489 | 4072587_f1_1 | 2412 | 16515 | 660 | 220 | Q07878 | 294 | 3.3(10)-24 | Saccharomyces cerevisiae | [GN:VPS13;SOI1:YLL040C] [SR:;BAKER'S YEAST] [DE:VACUOLAR PROTEIN SORTING-ASSOCIATED PROTEIN VPS13] [SP:Q07878] |
| CONTIG3489 | 23925277_f2_2 | 2413 | 16516 | 1464 | 488 | Q07878 | 824 | 1.7(10)-80 | Saccharomyces cerevisiae | [GN:VPS13;SOI1:YLL040C] [SR:;BAKER'S YEAST] [DE:VACUOLAR PROTEIN SORTING-ASSOCIATED PROTEIN VPS13] [SP:Q07878] |
| CONTIG5809 | 25400262_f1_7 | 2414 | 16517 | 2394 | 798 | Q07878 | 1141 | 5.2(10)-169 | Saccharomyces cerevisiae | [GN:VPS13;SOI1:YLL040C] [SR:;BAKER'S YEAST] [DE:VACUOLAR PROTEIN SORTING-ASSOCIATED PROTEIN VPS13] [SP:Q07878] |
| CONTIG5346 | 10581527_f2_5 | 2415 | 16518 | 1368 | 456 | P78599 | 2102 | 1.1(10)-217 | Candida albicans | [GN:SPE1] [SR:;YEAST] [DE:ORNITHINE DECARBOXYLASE, (ODC)] [SP:P78599;P78592] |
| CONTIG3488 | 7165888_f1_1 | 2416 | 16519 | 771 | 257 | Q07953 | 693 | 2.2(10)-68 | Saccharomyces cerevisiae | [GN:YLR022C] [SR:;BAKER'S YEAST] [DE:HYPOTHETICAL 28.3 KD PROTEIN IN PPR1-SNF7 INTERGENIC REGION] [SP:Q07953] |
| CONTIG1585 | 164663_f2_2 | 2417 | 16520 | 492 | 164 | Q08647 | 167 | 2.0(10)-22 | Saccharomyces cerevisiae | [GN:YOR243C;O5254] [SR:;BAKER'S YEAST] [DE:HYPOTHETICAL 77.0 KD PROTEIN IN HES1-SEC63 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2186 | 1956552_f1_1 | 2418 | 16521 | 819 | 273 | Q08647 | 167 | 7.2(10)-24 | Saccharomyces cerevisiae | INTERGENIC REGION] [SP:Q08647] [GN:YOR243C:O5254] [SR:BAKER'S YEAST] [DE:HYPOTHETICAL 77.0 KD PROTEIN IN HES1-SEC63 INTERGENIC REGION] |
| b1x11180.y | 1347531_f1_1 | 2419 | 16522 | 513 | 171 | Q08647 | 361 | 1.8(10)-32 | Saccharomyces cerevisiae | [SP:Q08647] [GN:YOR243C:O5254] [SR:BAKER'S YEAST] [DE:HYPOTHETICAL 77.0 KD PROTEIN IN HES1-SEC63 INTERGENIC REGION] [SP:Q08647] |
| CONTIG1795 | 23844400_c3_7 | 2420 | 16523 | 936 | 312 | P78609 | 963 | 5.2(10)-97 | Pichia jadinii | [SR:YEAST:CANDIDA UTILIS] [EC:1.7.3.3] [DE:URICASE, (URATE OXIDASE)] [SP:P78609] |
| CONTIG3707 | 15820192_c2_3 | 2421 | 16524 | 1842 | 614 | S75787 | 94 | 0.062 | Synechocystis sp. | [PN:hypothetical protein] [OR:Synechocystis sp.] [SR:PCC 6803, , PCC 6803] [SR:PCC 6803,] |
| CONTIG4731 | 19922051_c3_15 | 2422 | 16525 | 432 | 144 | S76221 | 96 | 0.00309 | Synechocystis sp. | [PN:hypothetical protein] [OR:Synechocystis sp.] [SR:PCC 6803, , PCC 6803] [SR:PCC 6803,] |
| b2x19077.y | 14266580_c2_4 | 2423 | 16526 | 600 | 200 | S77003 | 121 | 1.2(10)-6 | Synechocystis sp. | [PN:hypothetical protein] [OR:Synechocystis sp.] [SR:PCC 6803, , PCC 6803] [SR:PCC 6803,] |
| CONTIG2249 | 33235057_f1_1 | 2424 | 16527 | 1134 | 378 | S77453 | 196 | 2.3(10)-13 | Synechocystis sp. | [PN:hypothetical protein] [OR:Synechocystis sp.] [SR:PCC 6803, , PCC 6803] [SR:PCC 6803,] |
| CONTIG5506 | 3150677_c1_10 | 2425 | 16528 | 585 | 195 | S74956 | 96 | 0.00073 | Synechocystis sp. | [PN:spore protein sp21:protein sll1514:protein sll1514] [GN:hspA] [OR:Synechocystis sp.] [SR:PCC 6803, , PCC 6803] [SR:PCC 6803,] |
| CONTIG2983 | 13722130_c1_3 | 2426 | 16529 | 753 | 251 | S77699 | 141 | 9.4(10)-10 | Saccharomyces cerevisiae | [PN:inner cell wall mannoprotein ICWP:protein YLR390w-a] [GN:ICWP] [MP:12R] |
| CONTIG4885 | 24220165_f3_8 | 2427 | 16530 | 288 | 96 | S77567 | 157 | 1.3(10)-11 | Saccharomyces cerevisiae | [PN:ribosomal protein S37, mitochondrial] |
| CONTIG3379 | 23475401_c1_4 | 2428 | 16531 | 1209 | 403 | AF009672 | 179 | 2.1(10)-25 | Acinetobacter calcoaceticus | [PN:unknown] [DE:Acinetobacter calcoaceticus ADP1 vanillate demethylase region, vanillate demethylase (vanB) and vanillate demethylase (vanA) genes, complete cds.] [NT:putative oxo-ketoglutarate dioxygenase; ORF3] [LE:2783] [RE:3784] [D |
| b9x11006.y | 11775402_f3_2 | 2429 | 16532 | 834 | 278 | U71377 | 107 | 0.0097 | Staphylococcus epidermidis | [PN:autolysin AtlE] [DE:Staphylococcus epidermidis |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | autolysin AtlE and putative transcriptional regulator AtlR genes, complete cds.] [NT:primary attachment to a polystyrene surface] [LE:2620] [RE:6627] [DI:direct] |
| CONTIG5779 | 585458_c2_23 | 2430 | 16533 | 777 | 259 | U82227 | 92 | 0.02599 | *Sulfolobus solfataricus* | [PN:unknown] [GN:c0859] [DE:*Sulfolobus solfataricus* leucyl-tRNA synthetase (leuS) gene, partial cds, histidine biosynthesis operon hisCGABdfFDEHI, (hisC, hisG, hisBd, hisF, hisD, hisE, hisH and hisI) genes, complete cds andseryl-tRNA syn |
| CONTIG4836 | 7039187_f3_2 | 2431 | 16534 | 552 | 184 | AB001078 | 287 | 2.2(10)-25 | *Bombyx mori* | [PN:Multiprotein bridging factor 1] [SR:*Bombyx mori* cDNA to mRNA] [DE:*Bombyx mori* mRNA for Multiprotein bridging factor 1, complete cds.] [NT:MBF1] [LE:101] [RE:541] [DI:direct] |
| CONTIG5264 | 21504376_f2_2 | 2432 | 16535 | 1167 | 389 | Z81098 | 108 | 0.012 | *Caenorhabditis elegans* | [PN:K07A12.2] [DE:*Caenorhabditis elegans* cosmid K07A12.] [NT:Simiarity to Rat insulin-like growth factor binding] [LE:11543:11843:12923] [RE:11765:12861:13591] [DI:complementJoin] |
| CONTIG1953 | 12694837_f1_2 | 2433 | 16536 | 426 | 142 | AF016448 | 256 | 4.4(10)-22 | *Caenorhabditis elegans* | [GN:F41E6.9] [SR:*Caenorhabditis elegans* strain=Bristol N2] [DE:*Caenorhabditis elegans* cosmid F41E6.] [NT:similar to *Saccharomyces cerevisiae* nuclear protein] [LE:13138:13445:13811] [RE:13323:13715:14007] [DI:complementJoin] |
| CONTIG4964 | 23526686_c2_13 | 2434 | 16537 | 765 | 255 | AF016687 | 113 | 0.0015 | *Caenorhabditis elegans* | [GN:T21D12.9b] [SR:*Caenorhabditis elegans* strain=Bristol N2] [DE:*Caenorhabditis elegans* cosmid T21D12.] [NT:coded for by *C. elegans* cDNA yk6g3.3; coded for by] [LE:4395:4847:5306] [RE:4712:5123:5384] [DI:complementJoin] |
| CONTIG4711 | 14742907_c2_6 | 2435 | 16538 | 2475 | 825 | U49332 | 646 | 4.0(10)-68 | *Dictyostelium discoideum* | [PN:150-kD protein] [GN:cluA] [DE:*Dictyostelium discoideum* 150-kD protein (cluA) mRNA, complete cds.] [NT:protein required for proper dispersion of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5013 | 26359692_f1_2 | 2436 | 16539 | 1236 | 412 | U87912 | 90 | 0.45 | Dictyostelium discoideum | [LE:224] [RE:4189] [DI:direct] [PN:MAP kinase kinase protein DdMEK1] [GN:mekA] [FN:regulator of chemotaxis] [DE:Dictyostelium discoideum MAP kinase kinase protein DdMEK1 (mekA)mRNA, complete cds.] [LE:1] [RE:1983] [DI:direct] |
| CONTIG4907 | 25_c3_11 | 2437 | 16540 | 609 | 203 | AB004535 | 101 | 0.00589 | Schizosaccharomyces pombe | [GN:pi021] [SR:Schizosaccharomyces pombe (strain:972 h-) DNA, clone_lib:Mizukam] [DE:Schizosaccharomyces pombe 42.8 kb genomic DNA, clone c973.] [NT:similar to S.pombe unknown protein : DDBJ ACC#] [LE:15395] [RE:16642] [DI:direct] |
| CONTIG1951 | 4797252_f3_2 | 2438 | 16541 | 747 | 249 | AB004535 | 114 | 0.00062 | Schizosaccharomyces pombe | [PN:HYPOTHETICAL 105.9 KD PROTEIN IN AAC3-RFC5] [GN:pi030] [SR:Schizosaccharomyces pombe (strain:972 h-) DNA, clone_lib:Mizukam] [DE:Schizosaccharomyces pombe 42.8 kb genomic DNA, clone c973.] [NT:similar to S.cerevisiae HYPOTHETICAL |
| CONTIG3680 | 23867125_c2_6 | 2439 | 16542 | 1620 | 540 | AB004535 | 262 | 8.6(10)-21 | Schizosaccharomyces pombe | [PN:HYPOTHETICAL 105.9 KD PROTEIN IN AAC3-RFC5] [GN:pi030] [SR:Schizosaccharomyces pombe (strain:972 h-) DNA, clone_lib:Mizukam] [DE:Schizosaccharomyces pombe 42.8 kb genomic DNA, clone c973.] [NT:similar to S.cerevisiae HYPOTHETICAL |
| CONTIG2299 | 14179686_f1_1 | 2440 | 16543 | 993 | 331 | AB004537 | 327 | 1.3(10)-29 | Schizosaccharomyces pombe | [PN:HYPOTHETICAL 47.4KD PROTEIN IN SHP1-SEC17] [GN:pi038] [SR:Schizosaccharomyces pombe (strain:972 h-) DNA, clone_lib:Mizukam] [DE:Schizosaccharomyces pombe 37 kb genomic DNA, clone c213.] [NT:similar to S.cerevisiae HYPOTHETICAL 47. |
| CONTIG3583 | 1460067_f2_2 | 2441 | 16544 | 663 | 221 | AB004537 | 181 | 1.8(10)-13 | Schizosaccharomyces pombe | [PN:HLJ1 PROTEIN] [GN:pi041] [SR:Schizosaccharomyces pombe |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | (strain:972 h–) DNA, clone_lib:Mizukami) [DE:*Schizosaccharomyces pombe* 37 kb genomic DNA, clone c213.] [NT:similar to *S.cerevisiae* HLJ1 PROTEIN: SWISS_PROT] [LE:11111:11194:116 |
| CONTIG5568 | 14267312_c3_21 | 2442 | 16545 | 372 | 124 | AC000348 | 101 | 0.00044 | *Arabidopsis thaliana* | [PN:T7N9.2] [SR:*thale cress*] [DE:Genomic sequence for *Arabidopsis thaliana* BAC T7N9, completesequence.] [NT:TA1-like retrotransposon] [LE:9987:11109:12764] [RE:11012:12706:13970] [DI:complementJoin] |
| CONTIG3772 | 5879385_f2_2 | 2443 | 16546 | 1485 | 495 | AF001978 | 1057 | 5.7(10)-107 | *Candida albicans* | [GN:ECE2] [DE:*Candida albicans* ECE2 gene, complete cds.] [NT:differentially expressed in relation to the extent] [LE:151] [RE:2055] [DI:direct] |
| CONTIG5229 | 21953577_c1_14 | 2444 | 16547 | 1083 | 361 | AF004731 | 135 | 3.0(10)-6 | *Saccharomyces cerevisiae* | [PN:Stp22p] [GN:STP22] [FN:required for vacuolar targeting of] [SR:baker's yeast] [DE:*Saccharomyces cerevisiae* Stp22p (STP22) gene, complete cds.] [NT:similar to the mouse and human Tsg101 tumor] [LE:383] [RE:1540] [DI:direct] |
| CONTIG2426 | 4726567_f3_1 | 2445 | 16548 | 1314 | 438 | AF004880 | 102 | 0.017 | *Lycopersicon esculentum* | [PN:resistance complex protein I2C-3] [GN:I2C-3] [FN:confers resistance against *Fusarium oxysporum*] [SR:tomato] [DE:*Lycopersicon esculentum* resistance complex protein I2C-3 (I2C-3)mRNA, partial cds.] [LE:<1] [RE:1122] [DI:direct] |
| CONTIG944 | 21994032_f3_1 | 2446 | 16549 | 546 | 182 | AF007873 | 611 | 1.1(10)-59 | *Schizosaccharomyces pombe* | [PN:dolichol monophosphate mannose synthase] [GN:dpm1+] [FN:transfers mannose from GDP-mannose to dolichol] [SR:fission yeast] [DE:*Schizosaccharomyces pombe* dolichol monophosphate mannose synthase(dpm1+) mRNA, complete cds.] [LE:47] |
| CONTIG2873 | 14573430_c1_7 | 2447 | 16550 | 720 | 240 | AF011386 | 746 | 5.2(10)-74 | *Candida albicans* | [PN:pH-regulated protein 2] [GN:PHR2] [DE:*Candida albicans* pH-regulated protein 2 (PHR2) gene, complete cds.] [LE:52] [RE:1692] [DI:direct] |

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1784 | 10056376_c1_10 | 2448 | 16551 | 348 | 116 | Y11969 | 90 | 0.0016 | Arabidopsis thaliana | [PN:dnaJ-like protein] [GN:J10] [SR:thale cress] [DE:A.thaliana mRNA for dnaJ-like protein.] [LE:149] [RE:1429] [DI:direct] |
| CONTIG1597 | 23470281_f3_1 | 2449 | 16552 | 627 | 209 | U74294 | 163 | 3.0(10)-11 | Botryotinia fuckeliana | [PN:transposase] [DE:Botryotinia fuckeliana Flipper transposable element transposase gene, complete cds.] [LE:149] [RE:1747] [DI:direct] |
| CONTIG3861 | 24819811_c3_10 | 2450 | 16553 | 717 | 239 | U74294 | 173 | 2.5(10)-12 | Botryotinia fuckeliana | [PN:transposase] [DE:Botryotinia fuckeliana Flipper transposable element transposase gene, complete cds.] [LE:149] [RE:1747] [DI:direct] |
| CONTIG5685 | 412806_c3_10 | 2451 | 16554 | 1635 | 545 | U74294 | 585 | 6.0(10)-57 | Botryotinia fuckeliana | [PN:transposase] [DE:Botryotinia fuckeliana Flipper transposable element transposase gene, complete cds.] [LE:149] [RE:1747] [DI:direct] |
| CONTIG3424 | 3990760_f2_1 | 2452 | 16555 | 915 | 305 | Y13973 | 867 | 8.0(10)-87 | Candida sp. | [PN:CIP1 protein] [GN:CIP1] [OR:Candida sp.] [SR:Candida sp] [DE:Candida sp. CIP1 gene.] [NT:cadmium induced] [LE:1676] [RE:2566] [DI:direct] |
| b2x17229.x | 23603827_f3_2 | 2453 | 16556 | 192 | 64 | D88815 | 125 | 1.8(10)-6 | Candida albicans | [PN:beta-1,3-glucan synthase catalytic subunit 1] [GN:GSC1] [SR:Candida albicans DNA] [DE:Candida albicans gene for beta-1,3-glucan synthase catalyticsubunit 1, complete cds.] [LE:708] [RE:6401] [DI:direct] |
| CONTIG5371 | 905162_c3_18 | 2454 | 16557 | 2079 | 693 | AC000132 | 124 | 0.00027 | Arabidopsis thaliana | [GN:F21M12.21] [SR:thale cress] [DE:Sequence of BAC F21M12 from Arabidopsis thaliana chromosome I,complete sequence.] [NT:Similar to N. tabacum salt-inducible protein] [LE:77480] [RE:79300] [DI:complement] |
| CONTIG3904 | 1178387_f1_1 | 2455 | 16558 | 642 | 214 | AC001229 | 259 | 2.1(10)-22 | Arabidopsis thaliana | [GN:F5I14.18] [SR:thale cress] [DE:Sequence of BAC F5114 from Arabidopsis thaliana chromosome I,complete sequence.] [NT:ESTs gb[T45673,gb[N37512 come from this gene.] [LE:94242:95089:95364] [RE:95006:95191:95410] [DI:complementJoin] |
| CONTIG4669 | 14062943_c3_11 | 2456 | 16559 | 282 | 94 | AC001229 | 175 | 4.7(10)-13 | Arabidopsis thaliana | [GN:F5I14.18] [SR:thale cress] [DE:Sequence of BAC F5114 from |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | *Arabidopsis thaliana* chromosome I,complete sequence.] [NT:ESTs gb|T45673,gb|N37512 come from this gene.] [LE:94242:95089:95364] [RE:95006:95191:95410] [DI:complementJoin] |
| CONTIG3681 | 35421936_c1_5 | 2457 | 16560 | 504 | 168 | Y13139 | 559 | 3.5(10)-54 | *Saccharomyces cerevisiae* | [gn:yip3] [sr:baker"s yeast] [db:genbank-sac] [de:*saccharomyces cerevisiae* chromosome xiv.] [nt:orf yn1044w] |
| CONTIG2135 | 994002_f1_1 | 2458 | 16561 | 537 | 179 | Z97208 | 155 | 2.8(10)-10 | *Schizosaccharomyces pombe* | [PN:hypothetical protein] [GN:SPAC15A10.13] [SR:fission yeast] [DE:*S.pombe* chromosome I cosmid c15A10.] [NT:SPAC15A10.13, unknown, len:637aa, similar eg. to C.] [LE:35343:35518:35710:35864] [RE:35468:35658:35811:36724] [DI:directJoin] |
| CONTIG4777 | 24260903_c1_6 | 2459 | 16562 | 591 | 197 | Z97210 | 134 | 5.2(10)-7 | *Schizosaccharomyces pombe* | [PN:beta-transducin] [GN:SPAC29A4.08c] [SR:fission yeast] [DE:*S.pombe* chromosome I cosmid c29A4.] [NT:SPAC29A4.08c, unknown; beta-transducin; some] [LE:11807:13596:13741] [RE:13110:13700:13798] [DI:complementJoin] |
| CONTIG5566 | 2817637_f2_10 | 2460 | 16563 | 705 | 235 | Z98056 | 297 | 2.0(10)-26 | *Schizosaccharomyces pombe* | [PN:hypothetical protein] [GN:SPAC5D6.06c] [SR:fission yeast] [DE:*S.pombe* chromosome I cosmid c5D6.] [NT:SPAC5D6.06c, unknown, len:210aa, similar eg. to] [LE:91490:93633] [RE:93169:9827] [DI:complementJoin] |
| CONTIG5606 | 183187_f3_27 | 2461 | 16564 | 669 | 223 | Z97204 | 341 | 4.4(10)-31 | *Schizosaccharomyces pombe* | [PN:hypothetical protein] [GN:SPBC31F10.03] [SR:fission yeast] [DE:*S.pombe* chromosome II cosmid c31F10.] [NT:SPBC31F10.03, unknown, len:203aa, similar eg. to] [LE:1913] [RE:2524] [DI:direct] |
| CONTIG5650 | 31772188_c2_19 | 2462 | 16565 | 2202 | 734 | Z97204 | 438 | 5.7(10)-38 | *Schizosaccharomyces pombe* | [PN:hypothetical protein] [GN:SPBC31F10.14c] [SR:fission yeast] [DE:*S.pombe* chromosome II cosmid c31F10.] [NT:SPBC31F10.14c, unknown, len:1586aa, some similarity] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3986 | 11886303_c2_10 | 2463 | 16566 | 738 | 246 | Z97052 | 134 | 2.7(10)-6 | *Schizosaccharomyces pombe* | [LE:23034] [RE:27926] [DI:complement] [PN:hypothetical protein] [GN:SPCC4G3.10c] [SR:fission yeast] [DE:*S.pombe* chromosome III cosmid c4G3.] [NT:SPCC4G3.10c, putative dna repair protein,] [LE:19546] [RE:21606] [DI:complement] |
| CONTIG4931 | 9773402_c3_18 | 2464 | 16567 | 336 | 112 | X86179 | 111 | 2.3(10)-5 | *Schizosaccharomyces pombe* | [PN:phosphoprotein] [GN:cdc15] [FN:colocalises with f actin at mitosis but not in] [SR:fission yeast] [DE:*S.pombe* cdc15 gene.] [LE:376:515:799:3293] [RE:456:606:3236:3465] [DI:directJoin] |
| CONTIG1872 | 24257682_c2_7 | 2465 | 16568 | 204 | 68 | L47210 | 234 | 2.6(10)-18 | *Candida albicans* | [PN:serine/threonine kinase] [FN:hyphal formation] [DE:*Candida albicans* serine/threonine protein kinase gene, completecds.] [LE:355] [RE:4047] [DI:direct] |
| CONTIG3788 | 867055_c3_4 | 2466 | 16569 | 519 | 173 | AF006087 | 604 | 5.9(10)-59 | *Homo sapiens* | [PN:p20-Arc] [GN:ARC20] [SR:human] [DE:*Homo sapiens* Arp2/3 protein complex subunit p20-Arc (ARC20) mRNA,complete cds.] [NT:20 kD subunit of the Arp2/3 protein complex] [LE:16] [RE:522] [DI:direct] |
| CONTIG4018 | 23448436_c1_2 | 2467 | 16570 | 285 | 95 | Z24459 | 117 | 2.3(10)-7 | *Homo sapiens* | [PN:p8MTCP1 protein] [GN:MTCP1] [SR:human] [DE:*H.sapiens* MTCP1 gene, exons 2A to 7 (and joined mRNA)]. [LE:28885587] [RE:29455735] [DI:directJoin] |
| CONTIG4396 | 22744525_f2_5 | 2468 | 16571 | 354 | 118 | AF003348 | 192 | 8.1(10)-14 | *Mus musculus* | [PN:NPC1] [GN:Npc1] [SR:house mouse] [DE:*Mus musculus* NPC1 (Npc1) mRNA, complete cds.] [NT:mutations within this gene are responsible for the] [LE:124] [RE:3960] [DI:direct] |
| CONTIG3470 | 4407527_f2_3 | 2469 | 16572 | 399 | 133 | D88364 | 122 | 1.8(10)-7 | *Rattus norvegicus* | [PN:PIG-L] [FN:phosphatidylinositol glycan class L] [SR:*Rattus norvegicus* glial cell cell_line:C6 cDNA to mRNA] [DE:Rat mRNA for PIG-L, complete cds.] [LE:391] [RE:1149] [DI:direct] |
| CONTIG4294 | 546887_f3_2 | 2470 | 16573 | 960 | 320 | Q06598 | 625 | 3.5(10)-61 | *Saccharomyces* | [gn:acr3:ypr201w:p9677.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | [sr;baker"s yeast] [de:arsenical-resistance protein acr3] [sp:q06598] [dbs:swissprot-sp__new] |
| CONTIG4847 | 4535312_f2_2 | 2471 | 16574 | 1653 | 551 | P89105 | 632 | 4.2(10)-61 | Saccharomyces cerevisiae | [gn:ctr9;yol145c] [sr;baker"s yeast] [de:ctr9 protein] [sp:p89105:q08292:q07332] [dbs:swissprot-sp__new] |
| CONTIG5381 | 32454650_c3_16 | 2472 | 16575 | 1278 | 426 | P89105 | 389 | 5.9(10)-35 | Saccharomyces cerevisiae | [gn:ctr9;yol145c] [sr;baker"s yeast] [de:ctr9 protein] [sp:p89105:q08292:q07332] [dbs:swissprot-sp__new] |
| CONTIG2666 | 23672000_f1_2 | 2473 | 16576 | 210 | 70 | P56091 | 157 | 1.2(10)-10 | Candida albicans | [gn:gal1] [sr;yeast] [ec:2.7.1.6] [de:galactokinase,] [sp:p56091] [dbs:swissprot-sp__new] |
| CONTIG4512 | 23943787_f3_3 | 2474 | 16577 | 444 | 148 | P56091 | 578 | 3.3(10)-56 | Candida albicans | [gn:gal1] [sr;yeast] [ec:2.7.1.6] [de:galactokinase,] [sp:p56091] [dbs:swissprot-sp__new] |
| b1x16820.x | 10721974_c1_1 | 2475 | 16578 | 513 | 171 | P56091 | 691 | 3.6(10)-68 | Candida albicans | [gn:gal1] [sr;yeast] [ec:2.7.1.6] [de:galactokinase,] [sp:p56091] [dbs:swissprot-sp__new] |
| CONTIG1672 | 12128388_f1_1 | 2476 | 16579 | 261 | 87 | P56090 | 314 | 3.2(10)-28 | Candida albicans | [gn:his3] [sr;yeast] [ec:4.2.1.19] [de:imidazoleglycerol-phosphate dehydratase, (igpd)] [sp:p56090] [dbs:swissprot-sp__new] |
| b2x10243.x | 9958514_c1_3 | 2477 | 16580 | 465 | 155 | P87323 | 120 | 1.2(10)-6 | Schizosaccharomyces pombe | [gn:mcs4] [sr;fission yeast] [de:response regulator mcs4 (mitotic catastrophe suppressor 4)] [sp:p87323] [dbs:swissprot-sp__new] |
| CONTIG3202 | 1995175_c3_4 | 2478 | 16581 | 1158 | 386 | P87207 | 1939 | 2.0(10)-200 | Candida albicans | [gn:mnt3] [sr;yeast] [ec:2.4.1.131] [de:probable mannosyltransferase mnt3,] [sp:p87207] [dbs:swissprot-sp__new] |
| CONTIG5796 | 33379011_c2_18 | 2479 | 16582 | 297 | 99 | Q07842 | 185 | 1.5(10)-14 | Neurospora crassa | [gn:nuo-10.5] [ec:1.6.5.3:1.6.99.3] [de:(ec 1.6.99.3) (complex i) (ci) [sp:q07842] [dbs:swissprot-sp__new] |
| CONTIG931 | 19531518_f1_2 | 2480 | 16583 | 525 | 175 | P78723 | 189 | 1.3(10)-28 | Pichia angusta | [sr;yeast:hansenula polymorpha] [de:peroxisomal membrane protein per10 (peroxin-14)] [sp:p78723] [dbs:swissprot-sp__new] |
| CONTIG734 | 33336050_c2_2 | 2481 | 16584 | 825 | 275 | P87200 | 133 | 5.7(10)-6 | Yarrowia lipolytica | [gn:pex17] [sr;candida lipolytica] [de:peroxisomal membrane protein pex17 (peroxin-17)] [sp:p87200] [dbs:swissprot-sp__new] |
| CONTIG2128 | 117055_c1_3 | 2482 | 16585 | 681 | 227 | P87020 | 1003 | 3.1(10)-101 | Candida albicans | [gn:pra1] [sr;yeast] [de:ph-regulated antigen pra1 precursor (fibrinogen binding protein)] [sp:p87020:p78598] [dbs:swissprot-sp__new] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1684 | 9799180_c2_3 | 2483 | 16586 | 360 | 120 | Q08096 | 417 | 3.8(10)-39 | Saccharomyces cerevisiae | [gn:rtc1:yol010w] [sr:,baker"s yeast] [ec:6.5.1.4] [de:cyclase) (rna cyclase)] [sp:q08096] [db:swissprot-sp_new] |
| CONTIG5808 | 3964827_f1_1 | 2484 | 16587 | 711 | 237 | Q08096 | 765 | 5.0(10)-76 | Saccharomyces cerevisiae | [gn:rtc1:yol010w] [sr:,baker"s yeast] [ec:6.5.1.4] [de:cyclase) (rna cyclase)] [sp:q08096] [db:swissprot-sp_new] |
| CONTIG5787 | 35164063_f3_10 | 2485 | 16588 | 1662 | 554 | Q12460 | 1669 | 8.1(10)-172 | Saccharomyces cerevisiae | [gn:sik1:ylr197w:18167.9] [sr:,baker"s yeast] [de:sik1 protein] [sp:q12460] [db:swissprot-sp_new] |
| CONTIG5152 | 2922062_c3_8 | 2486 | 16589 | 1806 | 602 | P87024 | 2785 | 4.5(10)-290 | Candida albicans | [gn:skn1] [sr:,yeast] [de:beta-glucan synthesis-associated protein skn1] [sp:p87024] [db:swissprot-sp_new] |
| CONTIG2960 | 235902_c3_15 | 2487 | 16590 | 465 | 155 | P87219 | 424 | 7.0(10)-40 | Candida albicans | [gn:sou1] [sr:,yeast] [de:sorbitol utilization protein sou1] [sp:p87219] [db:swissprot-sp_new] |
| CONTIG347 | 7160882_f3_1 | 2488 | 16591 | 336 | 112 | P87219 | 533 | 2.0(10)-51 | Candida albicans | [gn:sou1] [sr:,yeast] [de:sorbitol utilization protein sou1] [sp:p87219] [db:swissprot-sp_new] |
| CONTIG5783 | 1988500_f3_17 | 2489 | 16592 | 873 | 291 | P87219 | 544 | 1.3(10)-52 | Candida albicans | [gn:sou1] [sr:,yeast] [de:sorbitol utilization protein sou1] [sp:p87219] [db:swissprot-sp_new] |
| CONTIG2960 | 15031327_c1_10 | 2490 | 16593 | 927 | 309 | P87218 | 1358 | 7.4(10)-139 | Candida albicans | [gn:sou2] [sr:,yeast] [de:sorbitol utilization protein sou2] [sp:p87218] [db:swissprot-sp_new] |
| CONTIG5262 | 23602181_c2_9 | 2491 | 16594 | 480 | 160 | Q03446 | 99 | 4.2(10)-5 | Saccharomyces cerevisiae | [gn:ssh5:ydr003w:yd8119.09] [sr:,baker"s yeast] [de:ssh5 protein] [sp:q03446] [db:swissprot-sp_new] |
| CONTIG2331 | 10052012_f3_1 | 2492 | 16595 | 1026 | 342 | P87078 | 1356 | 1.2(10)-138 | Candida albicans | [gn:top2] [sr:,yeast] [ec:5.99.1.3] [de:dna topoisomerase ii,] [sp:p87078] [db:swissprot-sp_new] |
| CONTIG5703 | 22112812_c1_28 | 2493 | 16596 | 504 | 168 | P56093 | 417 | 3.8(10)-39 | Candida albicans | [gn:tup1] [sr:,yeast] [de:transcriptional repressor tup1] [sp:p56093] [db:swissprot-sp_new] |
| CONTIG4527 | 4397588_c2_10 | 2494 | 16597 | 486 | 162 | Q94535 | 270 | 1.5(10)-23 | Drosophila melanogaster | [gn:u2af58] [sr:,fruit fly] [de:subunit) (u2 snrnp auxiliary factor small subunit)] [sp:q94535] [db:swissprot-sp_new] |
| CONTIG1603 | 2535930_c2_5 | 2495 | 16598 | 573 | 191 | Q29350 | 161 | 5.2(10)-12 | Sus scrofa | [gn:u2af1] [sr:,pig] [de:subunit) (u2 snrnp auxiliary factor small subunit) (fragment)] [sp:q29350] [db:swissprot-sp_new] |
| CONTIG4527 | 19957125_c2_9 | 2496 | 16599 | 606 | 202 | Q09176 | 165 | 2.0(10)-12 | Schizosaccharomyces pombe | [sr:,fission yeast] [de:subunit) (u2 snrnp auxiliary factor small subunit) (u2af23)] [sp:q09176] [db:swissprot-sp_new] |
| b3x16048.y | 2081926_c3_5 | 2497 | 16600 | 198 | 66 | Q92353 | 97 | 0.0032 | Schizosaccharomyces | [gn:spac6g9.08] [sr:,fission yeast] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5780 | 4414061_f1_6 | 2498 | 16601 | 870 | 290 | Q12499 | 1062 | 1.7(10)-107 | pombe | [ec:3.1.2.15] [de:(deubiquitinating enzyme)] [sp:q92353] [db:swissprot-sp_new] |
| CONTIG5780 | 7063507_f1_7 | 2499 | 16602 | 690 | 230 | Q12499 | 585 | 6.0(10)-57 | Saccharomyces cerevisiae | [gn:yor310c:o6108] [sr:baker''s yeast] [de:hypothetical 57.0 kd protein] [sp:q12499] [db:swissprot-sp_new] |
| CONTIG1788 | 31287937_f3_1 | 2500 | 16603 | 1296 | 432 | Q06053 | 566 | 1.2(10)-81 | Saccharomyces cerevisiae | [gn:ylr401c:l8084.19] [sr:baker''s yeast] [de:hypothetical 69.8 kd protein in bdf1-sfp1 intergenic region] [sp:q06053] [db:swissprot-sp_new] |
| CONTIG5484 | 12523285_f1_1 | 2501 | 16604 | 294 | 98 | Q06063 | 248 | 3.1(10)-21 | Saccharomyces cerevisiae | [gn:ylr405w:l8084.2] [sr:baker''s yeast] [de:hypothetical 41.7 kd protein in sfp1-ctr3 intergenic region] [sp:q06063] [db:swissprot-sp_new] |
| CONTIG5484 | 7322336_f2_4 | 2502 | 16605 | 765 | 255 | Q06063 | 674 | 2.2(10)-66 | Saccharomyces cerevisiae | [gn:ylr405w:l8084.2] [sr:baker''s yeast] [de:hypothetical 41.7 kd protein in sfp1-ctr3 intergenic region] [sp:q06063] [db:swissprot-sp_new] |
| CONTIG3442 | 32531905_f3_3 | 2503 | 16606 | 834 | 278 | Q07821 | 528 | 6.7(10)-51 | Saccharomyces cerevisiae | [gn:yll027w] [sr:baker''s yeast] [de:hypothetical 27.7 kd protein in prp19-hsp104 intergenic region] [sp:q07821] [db:swissprot-sp_new] |
| CONTIG4075 | 13925182_f3_8 | 2504 | 16607 | 861 | 287 | Q12524 | 393 | 1.3(10)-36 | Saccharomyces cerevisiae | [gn:ylr151c:l9634.8] [sr:baker''s yeast] [de:hypothetical 39.8 kd protein in mpt4-acs2 intergenic region] [sp:q12524] [db:swissprot-sp_new] |
| CONTIG5707 | 4884437_f1_1 | 2505 | 16608 | 1200 | 400 | Q06218 | 1027 | 8.8(10)-104 | Saccharomyces cerevisiae | [gn:ylr276c:l9328.3] [sr:baker''s yeast] [de:putative atp-dependent rna helicase ylr276c] [sp:q06218] [db:swissprot-sp_new] |
| CONTIG5707 | 4188562_f1_2 | 2506 | 16609 | 525 | 175 | Q06218 | 545 | 1.1(10)-52 | Saccharomyces cerevisiae | [gn:ylr276c:l9328.3] [sr:baker''s yeast] [de:putative atp-dependent rna helicase ylr276c] [sp:q06218] [db:swissprot-sp_new] |
| CONTIG5714 | 24396086_c2_21 | 2507 | 16610 | 1158 | 386 | Q12094 | 888 | 4.7(10)-89 | Saccharomyces cerevisiae | [gn:yor006c:und313] [sr:baker''s yeast] [de:hypothetical 35.7 kd protein in dnl4-slg1 intergenic region] [sp:q12094] [db:swissprot-sp_new] |
| CONTIG2961 | 24797785_c3_9 | 2508 | 16611 | 2331 | 777 | Q08960 | 1666 | 1.7(10)-171 | Saccharomyces cerevisiae | [gn:ypl207w] [sr:baker''s yeast] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | [de:hypothetical 89.8 kd protein ypl207w] [sp:q08960] [db:swissprot-sp_new] |
| CONTIG4215 | 110900_f3_4 | 2509 | 16612 | 600 | 200 | AF020657 | 110 | 0.00025 | Borrelia burgdorferi | [pn:erpx protein] [gn:erpx] [sr:lyme disease spirochete] [db:genpept-bct] [de:borrelia burgdorferi plasmid lp56 erpx protein (erpx) gene,complete cds.] |
| CONTIG1392 | 32542706_f1_1 | 2510 | 16613 | 1074 | 358 | D31792 | 94 | 0.14999 | Streptomyces griseus | [pn:serine/threonine protein kinase] [gn:pksg1] [sr:streptomyces griseus (strain:b2682) dna] [db:genpept-bct] [de:streptomyces griseus dna for serine/threonine protein kinases,complete cds.] |
| CONTIG4864 | 2616537_f3_7 | 2511 | 16614 | 1053 | 351 | AJ001073 | 128 | 2.0(10)-5 | Thermotoga maritima | [pn:beta-fructosidase] [gn:bfra] [fn:hydrolysis of sucrose, raffinose, inulin.] [db:genpept-bct] [ec:3.2.1.26] [de:thermotoga maritima bfra gene and orf1.] |
| CONTIG5544 | 19957186_c1_13 | 2512 | 16615 | 1710 | 570 | Z81074 | 466 | 6.9(10)-73 | Caenorhabditis elegans | [pn:f32b6.8] [db:genpept-inv] [de:caenorhabditis elegans cosmid f32b6,] [nt:protein predicted using genefinder; similarity to] |
| CONTIG1317 | 19788276_f1_1 | 2513 | 16616 | 630 | 210 | AF026212 | 94 | 0.03699 | Caenorhabditis elegans | [gn:f52g3.5] [sr:caenorhabditis elegans strain=bristol n2] [db:genpept-inv] [de:caenorhabditis elegans cosmid f52g3.] |
| CONTIG4752 | 10728407_f1_1 | 2514 | 16617 | 744 | 248 | AF025472 | 107 | 0.0023 | Caenorhabditis elegans | [gn:zk250.8] [sr:caenorhabditis elegans strain=bristol n2] [db:genpept-inv] [de:caenorhabditis elegans cosmid zk250.] |
| CONTIG4582 | 21484377_c1_3 | 2515 | 16618 | 414 | 138 | U95996 | 111 | 5.2(10)-6 | Cryptosporidium parvum | [pn:unknown] [db:genpept-inv] [de:cryptosporidium parvum unknown protein, complete cds.] [nt:similar to jnk protein kinases; small segment] |
| CONTIG5496 | 1223160_f1_1 | 2516 | 16619 | 1737 | 579 | U94410 | 99 | 0.17999 | Dictyostelium discoideum | [pn:rep protein] [gn:rep] [db:genpept-inv] [de:dictyostelium discoideum plasmid ddp6 rep protein (rep) gene,complete cds.] |
| CONTIG5513 | 22144535_f3_7 | 2517 | 16620 | 3786 | 1262 | AF012898 | 5109 | 0 | Candida albicans | [pn:protein phosphatase ssd1 homolog] [gn:ssd1] [db:genpept-pln] [de:candida albicans protein phosphatase ssd1 homolog (ssd1) gene,complete cds.] [nt:cassd1; similar to saccharomyces cerevisiae ssd1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5266 | 22891927_f1_3 | 2518 | 16621 | 942 | 314 | AF013799 | 1475 | 3.0(10)-151 | *Candida albicans* | [pn:aur1 homolog] [db:genpept-pln] [de:*candida albicans* aur1 homolog gene, complete cds.] |
| CONTIG1877 | 1433277_f1_1 | 2519 | 16622 | 621 | 207 | AF015771 | 112 | 7.0(10)-6 | *Magnaporthe grisea* | [pn:putative transcriptional regulator] [gn:con7] [fn:controls germ tube growth and pathogenicity of] [db:genpept-pln] [de:*magnaporthe grisea* putative transcriptional regulator (con7) gene,complete cds.] [nt:has zinc-finger motif and |
| CONTIG2705 | 26226412_f1_2 | 2520 | 16623 | 1212 | 404 | AC002332 | 91 | 0.23999 | *Arabidopsis thaliana* | [gn:f4p9.9] [db:genpept-pln] [de:*arabidopsis thaliana* chromosome ii bac f4p9 genomic sequence,complete sequence.] [nt:hypothetical protein] |
| CONTIG4174 | 12791652_c3_8 | 2521 | 16624 | 3183 | 1061 | Y13975 | 4117 | 0 | *Candida albicans* | [pn:phospholipase c] [gn:plc1] [db:genpept-pln] [de:*candida albicans* plc1 gene.] |
| CONTIG4434 | 4015803_c1_5 | 2522 | 16625 | 216 | 72 | U60973 | 334 | 2.3(10)-29 | *Candida albicans* | [pn:opt1p] [gn:opt1] [fn:membrane protein mediating transport of] [db:genpept-pln] [de:*candida albicans* oligopeptide transporter (opt1) gene, completecds.] [nt:oligopeptide transporter.] |
| CONTIG4856 | 11992132_f1_1 | 2523 | 16626 | 2301 | 767 | U60973 | 653 | 3.7(10)-64 | *Candida albicans* | [pn:opt1p] [gn:opt1] [fn:membrane protein mediating transport of] [db:genpept-pln] [de:*candida albicans* oligopeptide transporter (opt1) gene, completecds.] [nt:oligopeptide transporter.] |
| CONTIG5662 | 6835052_f2_6 | 2524 | 16627 | 1161 | 387 | U60973 | 1847 | 1.1(10)-190 | *Candida albicans* | [pn:opt1p] [gn:opt1] [fn:membrane protein mediating transport of] [db:genpept-pln] [de:*candida albicans* oligopeptide transporter (opt1) gene, completecds.] [nt:oligopeptide transporter.] |
| CONTIG5640 | 34175152_f2_3 | 2525 | 16628 | 2106 | 702 | U87996 | 1476 | 1.8(10)-227 | *Candida albicans* | [pn:cla4 protein kinase homolog] [fn:hyphal formation and virulence; morphological] [db:genpept-pln] [de:*candida albicans* cla4 protein kinase homolog gene, complete cds.] |
| CONTIG5530 | 24084426_c2_12 | 2526 | 16629 | 483 | 161 | U23425 | 103 | 0.00012 | *Neurospora crassa* | [gn:ropy-2] [db:genpept-pln] [de:*neurospora crassa* ropy-2 gene, complete cds.] |
| b1x16210.y | 36453425_f2_1 | 2527 | 16630 | 489 | 163 | Z98951 | 258 | 3.6(10)-20 | *Schizosaccharomyces pombe* | [pn:hypothetical protein] [gn:spac10d6.03c] [sr:fission yeast] [db:genpept-pln] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3373 | 6676332_c1_4 | 2528 | 16631 | 648 | 216 | Z98951 | 139 | 5.5(10)-12 | *Schizosaccharomyces pombe* | [des:*pombe* chromosome i cosmid c10d6,] [nt:spac10d6.03c, unknown; probable motor protein,] [pn:hypothetical protein] [gn:spac10d6.04] [sr:fission yeast] [db:genpept-pln] [des:*pombe* chromosome i cosmid c10d6, ] [nt:spac10d6.04, unknown, len:660aa, similar eg. to] |
| CONTIG5621 | 6113177_f1_5 | 2529 | 16632 | 600 | 200 | Z98595 | 135 | 2.8(10)-9 | *Schizosaccharomyces pombe* | [pn:hypothetical protein] [gn:spac11e3.10] [sr:fission yeast] [db:genpept-pln] [des:*pombe* chromosome i cosmid c11e3.] [nt:spac11e3.10, unknown, len:187aa] |
| CONTIG2424 | 30085805_c3_3 | 2530 | 16633 | 1086 | 362 | Z98595 | 190 | 3.3(10)-12 | *Schizosaccharomyces pombe* | [pn:hypothetical protein] [gn:spac11e3.11c] [sr:fission yeast] [db:genpept-pln] [des:*pombe* chromosome i cosmid c11e3,] [nt:spac11e3.11c, unknown, len:942aa, some similarity] |
| CONTIG2826 | 10972337_c1_3 | 2531 | 16634 | 1554 | 518 | Z98596 | 737 | 4.7(10)-73 | *Schizosaccharomyces pombe* | [pn:hypothetical protein] [gn:spac14c4.11] [sr:fission yeast] [db:genpept-pln] [des:*pombe* chromosome i cosmid c14c4.] [nt:spac14c4.11, unknown, len:734aa, similar eg. to] |
| CONTIG5011 | 10162510_f3_2 | 2532 | 16635 | 633 | 211 | Z98529 | 211 | 2.6(10)-17 | *Schizosaccharomyces pombe* | [pn:hypothetical protein] [gn:spac16e8.02] [sr:fission yeast] [db:genpept-pln] [des:*pombe* chromosome i cosmid c16e8.] [nt:spac16e8.02, unknown, len:223aa, similar eg. to] |
| CONTIG5817 | 26568763_c1_40 | 2533 | 16636 | 225 | 75 | Z98529 | 101 | 0.00014 | *Schizosaccharomyces pombe* | [pn:hypothetical protein] [gn:spac16e8.13] [sr:fission yeast] [db:genpept-pln] [des:*pombe* chromosome i cosmid c16e8.] [nt:spac16e8.13, unknown; zinc finger containing,] |
| CONTIG3295 | 4102300_c3_9 | 2534 | 16637 | 1305 | 435 | Z99292 | 435 | 4.7(10)-41 | *Schizosaccharomyces pombe* | [pn:flavoprotein] [gn:spac17a2.05] [sr:fission yeast] [db:genpept-pln] [des:*pombe* chromosome i cosmid c17a2,] [nt:spac17a2.05, putative oxidoreductase; flavoprotein,] |
| CONTIG4027 | 9954677_f2_3 | 2535 | 16638 | 666 | 222 | Z98849 | 110 | 1.5(10)-7 | *Schizosaccharomyces pombe* | [pn:hypothetical protein] [gn:spac17a5.09c] [sr:fission yeast] [db:genpept-pln] [des:*pombe* chromosome i cosmid |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5614 | 2756682_c3_26 | 2536 | 16639 | 984 | 328 | Z98849 | 348 | 5.2(10)-31 | Schizosaccharomyces pombe | c17a5.] [nt:spac17a5.09c, unknown, len:310aa] [pn:hypothetical protein] [sr:fission yeast] [db:genpept-pln] [de:s.pombe chromosome i cosmid c17a5.] [nt:spac17a5.12, unknown; may need n terminal] |
| CONTIG5009 | 2353135_f3_2 | 2537 | 16640 | 3195 | 1065 | Z98849 | 113 | 2.2(10)-9 | Schizosaccharomyces pombe | [pn:hypothetical protein] [gn:spac17a5.16] [sr:fission yeast] [db:genpept-pln] [de:s.pombe chromosome i cosmid c17a5.] [nt:spac17a5.16, unknown, len:921aa, similar eg. to c.] |
| CONTIG4109 | 4703130_c3_8 | 2538 | 16641 | 1200 | 400 | Z99162 | 234 | 9.3(10)-21 | Schizosaccharomyces pombe | [pn:hypothetical protein] [gn:spac17g6.05c] [sr:fission yeast] [db:genpept-pln] [de:s.pombe chromosome i cosmid c17g6.] [nt:spac17g6.05c, unknown, len:775aa, similar eg. to |
| CONTIG768 | 22470177_f1_1 | 2539 | 16642 | 693 | 231 | Z99162 | 130 | 5.7(10)-6 | Schizosaccharomyces pombe | [pn:hypothetical protein] [gn:spac17g6.12] [sr:fission yeast] [db:genpept-pln] [de:s.pombe chromosome i cosmid c17g6.] [nt:spac17g6.12, putative cell division control] |
| CONTIG2361 | 25433303_f2_1 | 2540 | 16643 | 684 | 228 | Z98597 | 110 | 0.001 | Schizosaccharomyces pombe | [pn:hypothetical protein] [gn:spac17h9.20] [sr:fission yeast] [db:genpept-pln] [de:s.pombe chromosome i cosmid c17h9.] [nt:spac17h9.20, partial; unknown, len:563aa, some] |
| CONTIG3822 | 5890767_f1_1 | 2541 | 16644 | 234 | 78 | Z98974 | 120 | 1.1(10)-7 | Schizosaccharomyces pombe | [pn:hypothetical protein] [gn:spac19a8.09] [sr:fission yeast] [db:genpept-pln] [de:s.pombe chromosome i cosmid c19a8.] [nt:spac19a8.09, unknown, len:81aa] |
| CONTIG4079 | 803212_f2_2 | 2542 | 16645 | 432 | 144 | Z98974 | 108 | 6.4(10)-6 | Schizosaccharomyces pombe | [pn:hypothetical protein] [gn:spac19a8.11c] [sr:fission yeast] [db:genpept-pln] [de:s.pombe chromosome i cosmid c19a8.] [nt:spac19a8.11c, unknown, len:246aa] |
| CONTIG1426 | 33644591_f2_1 | 2543 | 16646 | 834 | 278 | Z98598 | 190 | 4.9(10)-14 | Schizosaccharomyces pombe | [pn:hypothetical protein] [gn:spac1b3.05] [sr:fission yeast] [db:genpept-pln] [de:s.pombe chromosome i cosmid c1b3.] [nt:spac1b3.05, probable transcriptional regulator,] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3514 | 16615683_c2_3 | 2544 | 16647 | 282 | 94 | Z98598 | 126 | 8.5(10)-8 | Schizosaccharomyces pombe | [pn:hypothetical protein] [gn:spac1b3.06c] [sr:fission yeast] [db:genpept-pln] [des:pombe chromosome i cosmid c1b3.] [nt:spac1b3.06c, unknown, len:278aa, some similarity] |
| CONTIG4070 | 25803812_f1_2 | 2545 | 16648 | 1116 | 372 | Z98598 | 192 | 2.2(10)-16 | Schizosaccharomyces pombe | [pn:hypothetical protein] [gn:spac1b3.08] [sr:fission yeast] [db:genpept-pln] [des:pombe chromosome i cosmid c1b3.] [nt:spac1b3.08, unknown, len:424aa, similar eg. to c.] |
| CONTIG3736 | 14246016_f2_2 | 2546 | 16649 | 699 | 233 | Z98598 | 125 | 1.0(10)-5 | Schizosaccharomyces pombe | [pn:hypothetical protein] [gn:spac1b3.08] [sr:fission yeast] [db:genpept-pln] [des:pombe chromosome i cosmid c1b3.] [nt:spac1b3.08, unknown, len:424aa, similar eg. to c.] |
| CONTIG5498 | 10970438_f3_7 | 2547 | 16650 | 1512 | 504 | Z98598 | 970 | 9.6(10)-98 | Schizosaccharomyces pombe | [pn:hypothetical protein] [gn:spac1b3.16c] [sr:fission yeast] [db:genpept-pln] [des:pombe chromosome i cosmid c1b3.] [nt:spac1b3.16c, possible transporter, len:568aa.] |
| CONTIG4818 | 15712755_f2_2 | 2548 | 16651 | 558 | 186 | Z99295 | 167 | 1.2(10)-11 | Schizosaccharomyces pombe | [pn:phosphatidyl synthase] [gn:spac22a12.08c] [sr:fission yeast] [db:genpept-pln] [des:pombe chromosome i cosmid c22a12.] [nt:spac22a12.08c, unknown; putative phosphatidyl] |
| CONTIG2123 | 25431652_c2_8 | 2549 | 16652 | 789 | 263 | Z99295 | 125 | 1.7(10)-11 | Schizosaccharomyces pombe | [pn:pre-mrna splicing factor] [gn:spac22a12.09c] [sr:fission yeast] [db:genpept-pln] [des:pombe chromosome i cosmid c22a12.] [nt:spac22a12.09c, putative pre-mrna splicing factor,] |
| b2x10952.y | 36334443_c1_1 | 2550 | 16653 | 690 | 230 | Z98559 | 145 | 1.1(10)-13 | Schizosaccharomyces pombe | [pn:hypothetical protein] [gn:spac23c11.01] [sr:fission yeast] [db:genpept-pln] [des:pombe chromosome i cosmid c23c11.] [nt:spac23c11.01, unknown, len:441aa, some similarity] |
| CONTIG3360 | 6261265_c1_7 | 2551 | 16654 | 702 | 234 | Z98559 | 231 | 6.4(10)-19 | Schizosaccharomyces pombe | [pn:hypothetical protein] [gn:spac23c11.04c] [sr:fission yeast] [db:genpept-pln] [des:pombe chromosome i cosmid c23c11.] [nt:spac23c11.04c, unknown, len:421aa, similar eg. to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5477 | 35956467_f1_1 | 2552 | 16655 | 684 | 228 | Z98559 | 216 | 5.0(10)-31 | Schizosaccharomyces pombe | [pn:hypothetical protein] [gn:spac23c11.04c] [sr:fission yeast] [db:genpept-pln] [des:pombe chromosome i cosmid c23c11.] [nt:spac23c11.04c, unknown, len:421aa, similar eg. to |
| CONTIG4786 | 2816316_c1_6 | 2553 | 16656 | 1338 | 446 | Z99753 | 395 | 8.3(10)-37 | Schizosaccharomyces pombe | [pn:hypothetical protein] [gn:spac23c4.16c] [sr:fission yeast] [db:genpept-pln] [des:pombe chromosome i cosmid c23c4.] [nt:spac23c4.16c, unknown, len:424aa, similar eg. to a] |
| CONTIG1811 | 4428750_c2_4 | 2554 | 16657 | 819 | 273 | Z99163 | 186 | 2.1(10)-20 | Schizosaccharomyces pombe | [pn:hypothetical protein] [gn:spac23h3.04] [sr:fission yeast] [db:genpept-pln] [des:pombe chromosome i cosmid c23h3.] [nt:spac23h3.04, unknown, len:349aa] |
| CONTIG368 | 2147513_f1_1 | 2555 | 16658 | 312 | 104 | Z98977 | 139 | 2.3(10)-8 | Schizosaccharomyces pombe | [pn:hypothetical protein] [gn:spac23h4.14] [sr:fission yeast] [db:genpept-pln] [des:pombe chromosome i cosmid c23h4.] [nt:spac23h4.14, unknown, len:905aa, contains ps00307] |
| CONTIG4912 | 23953887_f2_2 | 2556 | 16659 | 2037 | 679 | Z98601 | 325 | 2.3(10)-32 | Schizosaccharomyces pombe | [pn:hypothetical protein] [gn:spac24c9.05c] [sr:fission yeast] [db:genpept-pln] [des:pombe chromosome i cosmid c24c9.] [nt:spac24c9.05c, unknown, len:730aa] |
| CONTIG5803 | 9957510_f3_14 | 2557 | 16660 | 2607 | 869 | Z98601 | 695 | 1.3(10)-68 | Schizosaccharomyces pombe | [pn:hypothetical protein] [gn:spac24c9.11] [sr:fission yeast] [db:genpept-pln] [des:pombe chromosome i cosmid c24c9.] [nt:spac24c9.11, unknown, len:775aa, similar eg. to |
| CONTIG3472 | 1210258_f3_3 | 2558 | 16661 | 396 | 132 | Z99126 | 148 | 1.2(10)-10 | Schizosaccharomyces pombe | [pn:hypothetical protein] [gn:spac26h5.14] [sr:fission yeast] [db:genpept-pln] [des:pombe chromosome i cosmid c26h5.] [nt:spac26h5.14, unknown, len:166aa, similar eg. to pig] |
| CONTIG2971 | 25861411_c2_3 | 2559 | 16662 | 1449 | 483 | Z98978 | 608 | 2.2(10)-59 | Schizosaccharomyces pombe | [pn:cell division protein] [gn:cdc1] [sr:fission yeast] [db:genpept-pln] [des:pombe chromosome i cosmid c27e2.] [nt:spac27e2.05, cdc1; cell division protein,] |
| CONTIG4757 | 19589556_f2_2 | 2560 | 16663 | 627 | 209 | Z99164 | 101 | 0.0008 | Schizosaccharomyces pombe | [pn:hypothetical protein] |

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5489 | 798562_c3_10 | 2561 | 16664 | 432 | 144 | Z98887 | 204 | 1.3(10)-16 | Schizosaccharomyces pombe | [pn:hypothetical protein] [gn:spac2c6.07] [sr:fission yeast] [db:genpept-pln] [des:pombe chromosome i cosmid c2c6,] [nt:spac2c6.07, unknown, len:101aa] |
| CONTIG4354 | 266381_c3_8 | 2562 | 16665 | 486 | 162 | Z98850 | 190 | 4.4(10)-15 | Schizosaccharomyces pombe | [pn:hypothetical protein] [gn:spac2e11.03c] [sr:fission yeast] [db:genpept-pln] [des:pombe chromosome i cosmid c2e11.] [nt:spac2e11.03c, unknown, len:124aa] |
| CONTIG5008 | 24783428_f2_3 | 2563 | 16666 | 2217 | 739 | Z99165 | 680 | 2.1(10)-73 | Schizosaccharomyces pombe | [pn:hypothetical protein] [gn:spac2f3.16] [sr:fission yeast] [db:genpept-pln] [des:pombe chromosome i cosmid c2f3.] [nt:spac2f3.16, unknown, (splicing may be incorrectly] |
| CONTIG5340 | 31345378_f3_3 | 2564 | 16667 | 2082 | 694 | Z98979 | 991 | 5.7(10)-100 | Schizosaccharomyces pombe | [pn:hypothetical protein] [gn:spac31g5.20c] [sr:fission yeast] [db:genpept-pln] [des:pombe chromosome i cosmid c31g5.] [nt:author-given protein sequence is in conflict with] |
| CONTIG4504 | 12789064_c1_7 | 2565 | 16668 | 1803 | 601 | Z95395 | 100 | 0.039 | Schizosaccharomyces pombe | [pn:unknown] [gn:spac3a12.01c] [sr:fission yeast] [db:genpept-pln] [des:pombe chromosome i cosmid c3a12.] [nt:spac3a12.01c, unknown; partial, len:371aa, similar] |
| CONTIG3109 | 36643128_f2_1 | 2566 | 16669 | 1308 | 436 | Z99568 | 146 | 5.7(10)-7 | Schizosaccharomyces pombe | [pn:hypothetical protein] [gn:spac3c7.04] [sr:fission yeast] [db:genpept-pln] [des:pombe chromosome i cosmid c3c7.] [nt:spac3c7.04, putative transcriptional control.] |
| CONTIG201 | 30258317_f3_1 | 2567 | 16670 | 609 | 203 | Z99568 | 93 | 0.033 | Schizosaccharomyces pombe | [pn:hypothetical protein] [gn:spac3c7.05c] [sr:fission yeast] [db:genpept-pln] [des:pombe chromosome i cosmid c3c7.] [nt:spac3c7.05c, unknown, len:442aa] |
| CONTIG2732 | 22461713_c2_4 | 2568 | 16671 | 471 | 157 | Z99568 | 136 | 1.8(10)-8 | Schizosaccharomyces pombe | [pn:hypothetical protein] [gn:spac3c7.05c] [sr:fission yeast] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5511 | 4297340_c2_19 | 2569 | 16672 | 306 | 102 | Z99568 | 114 | 4.2(10)-6 | Schizosaccharomyces pombe | [pn:hypothetical protein] [gn:spac3c7.05c] [sr:fission yeast] [db:genpept-pln] [de:s.pombe chromosome i cosmid c3c7.] [nt:spac3c7.05c, unknown, len:442aa] |
| CONTIG5767 | 36386575_c1_37 | 2570 | 16673 | 1371 | 457 | Z99568 | 164 | 3.2(10)-9 | Schizosaccharomyces pombe | [pn:hypothetical protein] [gn:spac3c7.05c] [sr:fission yeast] [db:genpept-pln] [de:s.pombe chromosome i cosmid c3c7.] [nt:spac3c7.05c, unknown, len:442aa] |
| CONTIG5106 | 23440952_c1_6 | 2571 | 16674 | 1623 | 541 | Z99568 | 204 | 7.9(10)-20 | Schizosaccharomyces pombe | [pn:hypothetical protein] [sr:fission yeast] [db:genpept-pln] [de:s.pombe chromosome i cosmid c3c7.] [nt:spac3c7.15c, partial; unknown, len:<397aa] |
| CONTIG2105 | 4807168_f1_1 | 2572 | 16675 | 660 | 220 | Z98560 | 186 | 1.7(10)-14 | Schizosaccharomyces pombe | [pn:hypothetical protein] [gn:spac4c5.03] [sr:fission yeast] [db:genpept-pln] [de:s.pombe chromosome i cosmid c4c5.] [nt:spac4c5.03, unknown, len:302aa] |
| CONTIG1550 | 34416332_c2_2 | 2573 | 16676 | 867 | 289 | Z98602 | 120 | 3.7(10)-5 | Schizosaccharomyces pombe | [pn:hypothetical protein] [gn:spac4d7.11] [sr:fission yeast] [db:genpept-pln] [de:s.pombe chromosome i cosmid c4d7.] [nt:spac4d7.11, unknown, len:281aa] |
| CONTIG5158 | 6750753_c3_16 | 2574 | 16677 | 2388 | 796 | Z98980 | 325 | 3.7(10)-26 | Schizosaccharomyces pombe | [pn:hypothetical protein] [gn:spac4f10.07c] [sr:fission yeast] [db:genpept-pln] [de:s.pombe chromosome i cosmid c4f10.] [nt:spac4f10.07c, unknown, len:758aa, some similarity] |
| CONTIG5721 | 4722536_c1_22 | 2575 | 16678 | 1494 | 498 | Z98531 | 530 | 3.8(10)-62 | Schizosaccharomyces pombe | [pn:hypothetical protein] [sr:fission yeast] [db:genpept-pln] [de:s.pombe chromosome i cosmid c6b12.] [nt:spac6b12.07c, unknown; dna binding, len:456aa,] |
| CONTIG5699 | 5860137_f3_17 | 2576 | 16679 | 492 | 164 | Z98531 | 160 | 6.5(10)-12 | Schizosaccharomyces pombe | [pn:hypothetical protein] [gn:spac6b12.13] [sr:fission yeast] [db:genpept-pln] [de:s.pombe chromosome i cosmid c6b12.13, unknown,] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1271 | 276561_c3_4 | 2577 | 16680 | 933 | 311 | Z98981 | 353 | 2.2(10)-32 | Schizosaccharomyces pombe | [en:104aa, similar eg. to] [pn:hypothetical protein] [gn:spac6f6.04c] [sr:fission yeast] [db:genpept-pln] [des.pombe chromosome i cosmid c6f6.] [nt:spac6f6.04c, unknown, len:489aa] |
| b1x18631.x | 23829751_c3_4 | 2578 | 16681 | 555 | 185 | Z98981 | 127 | 2.0(10)-7 | Schizosaccharomyces pombe | [pn:hypothetical protein] [gn:spac6f6.04c] [sr:fission yeast] [db:genpept-pln] [des.pombe chromosome i cosmid c6f6.] [nt:spac6f6.04c, unknown, len:489aa] |
| b9x12169.x | 30475931_c1_1 | 2579 | 16682 | 234 | 78 | Z98603 | 178 | 4.5(10)-13 | Schizosaccharomyces pombe | [pn:hypothetical protein] [gn:spac6g10.03c] [sr:fission yeast] [db:genpept-pln] [des.pombe chromosome i cosmid c6g10.] [nt:spac6g10.03c, unknown, len:428aa, similar eg. to] |
| CONTIG5458 | 5288942_f3_7 | 2580 | 16683 | 639 | 213 | Z98603 | 117 | 0.0004 | Schizosaccharomyces pombe | [pn:hypothetical protein] [gn:spac6g10.05c] [sr:fission yeast] [db:genpept-pln] [des.pombe chromosome i cosmid c6g10.] [nt:spac6g10.05c, unknown, len:1210aa, similar eg. to] |
| CONTIG2887 | 1175267_f3_3 | 2581 | 16684 | 1806 | 602 | Z99532 | 110 | 0.01 | Schizosaccharomyces pombe | [pn:hypothetical protein] [gn:spacd4.03c] [sr:fission yeast] [db: genpept-pln] [des.pombe chromosome i cosmid c7d4.] [nt:spac7d4.03c, unknown; serine rich, len:886aa] |
| CONTIG4209 | 24336641_c1_5 | 2582 | 16685 | 1590 | 530 | Z99532 | 1021 | 3.6(10)-107 | Schizosaccharomyces pombe | [pn:hypothetical protein] [gn:spac7d4.12c] [sr:fission yeast] [db:genpept-pln] [des.pombe chromosome i cosmid c7d4.] [nt:spac7d4.12c, unknown, len:759aa, similar eg.] |
| CONTIG4813 | 0_f2_4 | 2583 | 16686 | 603 | 201 | Z99262 | 92 | 0.085 | Schizosaccharomyces pombe | [pn:hypothetical protein] [gn:spac9e9.10c] [sr:fission yeast] [db:genpept-pln] [des.pombe chromosome i cosmid c9e9.] [nt:spac9e9.10c, unknown, len:514aa, similar eg. to] |
| CONTIG3949 | 190637_f1_1 | 2584 | 16687 | 408 | 136 | Z99759 | 104 | 5.7(10)-6 | Schizosaccharomyces pombe | [pn:hypothetical protein] [gn:spbc16e9.01c] [sr:fission yeast] [db:genpept-pln] [des.pombe chromosome ii cosmid c16e9.] [nt:spbc16e9.01c, partial; |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1905 | 26175937_f2_1 | 2585 | 16688 | 591 | 197 | Z99759 | 144 | 5.7(10)-9 | Schizosaccharomyces pombe | unknown, len:<161aa] [pn:hypothetical protein] [gn:spbc16e9.10c] [sr:fission yeast] [db:genpept-pln] [de:s.pombe chromosome ii cosmid c16e9.] [nt:spbc16e9.10e, unknown, len:779aa, similar eg. to |
| CONTIG449 | 480016_f3_2 | 2586 | 16689 | 819 | 273 | Z99759 | 92 | 0.0018 | Schizosaccharomyces pombe | [pn:hypothetical protein] [gn:spbc16e9.16c] [sr:fission yeast] [db:genpept-pln] [de:s.pombe chromosome ii cosmid c16e9.] [nt:spbc16e9.16c, unknown, splicing prediction may be] |
| CONTIG1321 | 5953825_c2_4 | 2587 | 16690 | 291 | 97 | U48234 | 122 | 1.1(10)-7 | Schizosaccharomyces pombe | [pn:hypothetical protein] [db:genpept-pln] [de:schizosaccharomyces pombe small subunit of u2af splicing factorspu2af23 gene, complete cds.] [nt:small subunit of u2af splicing factor] |
| CONTIG2863 | 24615675_f2_1 | 2588 | 16691 | 891 | 297 | AJ001414 | 329 | 7.0(10)-29 | Yarrowia lipolytica | [pn:gtpase activating protein] [gn:gyp7] [db:genpept-pln] [de:yarrowia lipolytica gyp7 gene.] |
| CONTIG5253 | 24252057_f3_8 | 2589 | 16692 | 936 | 312 | U54559 | 264 | 6.2(10)-23 | Homo sapiens | [pn:eif3-p40] [db:genpept-pri2] [de:human translation initiation factor eif3 p40 subunit mrna, completecds.] [nt:translation initiation factor eif3 p40 subunit] |
| CONTIG3093 | 22550753_f1_1 | 2590 | 16693 | 624 | 208 | AF015297 | 108 | 0.0053 | Human herpesvirus 6 (strain uganda-1102) | [pn:ie2hom] [gn:ie2hom] [or:human herpesvirus 6 (strain uganda-1102)] [db:genpept-vrl] [de:human herpesvirus 6 (strain uganda-1102) ie2hom mrna, complete cds.] [nt:similar to the immediate-early 2 protein of human] |
| CONTIG1420 | 1047135_f2_1 | 2591 | 16694 | 693 | 231 | AF022372 | 1089 | 2.3(10)-110 | Candida albicans | [pn1[proteinase] [gn:kex2] [db:genpept] [de:candida albicans proteinase (kex2) gene, complete cds.] [nt:convertase; probably in trans golgi network] |
| CONTIG4441 | 1047135_c2_4 | 2592 | 16695 | 1155 | 385 | AF022372 | 1920 | 2.1(10)-198 | Candida albicans | [pn:proteinase] [gn:kex2] [db:genpept] [de:candida albicans proteinase (kex2) gene, complete cds.] [nt:convertase; probably in trans golgi network] |
| CONTIG177 | 15631938_c3_3 | 2593 | 16696 | 528 | 176 | AF025429 | 707 | 9.9(10)-69 | Candida | [pn:agglutinin-like adhesin] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4256 | 15865762_f1_1 | 2594 | 16697 | 1710 | 570 | AF025429 | 1505 | 2.0(10)-154 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5246 | 14095436_f1_1 | 2595 | 16698 | 690 | 230 | AF025429 | 800 | 1.0(10)-78 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5486 | 12301431_c1_11 | 2596 | 16699 | 2472 | 824 | AF025429 | 1327 | 1.3(10)-186 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5486 | 14187555_c3_15 | 2597 | 16700 | 234 | 78 | AF025429 | 267 | 9.5(10)-22 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5486 | 859688_c3_14 | 2598 | 16701 | 1941 | 647 | AF025429 | 1817 | 1.7(10)-187 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5515 | 3167010_c2_10 | 2599 | 16702 | 2340 | 780 | AF025429 | 2740 | 2.6(10)-285 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG5648 | 1062887_f2_4 | 2600 | 16703 | 1590 | 530 | AF025429 | 102 | 0.0057 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG4507 | 5118942_f3_1 | 2601 | 16704 | 1128 | 376 | AF025429 | 119 | 0.00068 | Candida albicans | [pn:agglutinin-like adhesin] [gn:ala1] [fn:cell adhesion protein] [db:genpept] [de:candida albicans agglutinin-like adhesin (ala1) gene, complete cds.] |
| CONTIG1863 | 1281513_f3_2 | 2602 | 16705 | 882 | 294 | AF002669 | 90 | 0.58999 | Dictyostelium discoideum | [pn:multifunctional protein] [db:genpept] [de:dictyostelium discoideum retrotransposable element tdd-3, completesequence.] [nt:multifunctional protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x12147.y | 24895453_c1_7 | 2603 | 16706 | 666 | 222 | AF025995 | 99 | 0.00076 | Mycobacterium genavense | including en domain and] [pn:hypothetical 21 kda protein] [db:genpept] [de:mycobacterium genavense hypothetical 21 kda protein gene, complete cds.] [nt:p21] |
| CONTIG4308 | 25971886_f3_4 | 2604 | 16707 | 522 | 174 | U69696 | 712 | 2.1(10)-70 | Candida albicans | [pn:sec65] [gn:sec65] [db:genpept] [de:candida albicans sec65 (sec65) gene, complete cds, and ura5 (ura5)gene, partial cds.] |
| CONTIG4308 | 4320302_f1_2 | 2605 | 16708 | 354 | 118 | U69696 | 488 | 1.2(10)-46 | Candida albicans | [pn:sec65] [gn:sec65] [db:genpept] [de:candida albicans sec65 (sec65) gene, complete cds, and ura5 (ura5)gene, partial cds.] |
| CONTIG1784 | 21505030_c1_11 | 2606 | 16709 | 246 | 82 | AF012106 | 128 | 1.6(10)-8 | Homo sapiens | [pn:dnaj protein] [gn:hspf2] [sr:human] [db:genpept] [de:homo sapiens dnaj protein (hspf2) mrna, complete cds.] |
| CONTIG1784 | 29792326_c2_14 | 2607 | 16710 | 411 | 137 | AF012106 | 432 | 9.9(10)-41 | Homo sapiens | [pn:dnaj protein] [gn:hspf2] [sr:human] [db:genpept] [de:homo sapiens dnaj protein (hspf2) mrna, complete cds.] |
| CONTIG3993 | 1178140_c2_6 | 2608 | 16711 | 363 | 121 | AF020554 | 113 | 1.1(10)-5 | Candida albicans | [pn:translation release factor 3] [gn:sup35] [db:genpept] [de:candida albicans translation release factor 3 (sup35) gene, complete cds.] [nt:erf3; translation termination factor; putative] |
| CONTIG2653 | 9799166_c2_8 | 2609 | 16712 | 1344 | 448 | AF029885 | 1374 | 1.5(10)-140 | Emericella nidulans | [pn:putative homoserine o-acetyltransferase] [gn:cysc] [db:genpept] [de:emericella nidulans putative homoserine o-acetyltransferase (cysc)gene, complete cds.] |
| CONTIG4195 | 4335256_c1_4 | 2610 | 16713 | 363 | 121 | AF030343 | 113 | 3.2(10)-6 | Mus musculus | [pn:ech1p] [gn:ech1] [sr:house mouse] [db:genpept] [de:mus musculus peroxisomal/mitochondrial dienoyl-coa isomerase ech1p(ech1) mrna, complete cds.] [nt:peroxisomal/mitochondrial dienoyl-coa isomerase] |
| CONTIG5744 | 22276390_f2_9 | 2611 | 16714 | 888 | 296 | U78082 | 195 | 1.3(10)-15 | Homo sapiens | [pn:rna polymerase transcriptional regulation] [gn:h-med6] [sr:human] [db:genpept] [de:human rna polymerase transcriptional regulation mediator (h-med6)mrna, complete cds.] [nt:h-med6p] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5813 | 24226632_c2_45 | 2612 | 16715 | 954 | 318 | AF027728 | 92 | 0.81999 | *Xenopus laevis* | [pn:kinesin-related protein] [gn:xcenp-e] [sr:african clawed frog] [db:genpept] [de:xenopus laevis kinesin-related protein (xcenp-e) mrna, complete cds.] [nt:kinetochore-associated; plus end-directed] |
| b9x11m31.y | 34400702_c2_3 | 2613 | 16716 | 207 | 69 | AF030861 | 90 | 0.005 | *Debaryomyces occidentalis* | [pn:p-type atpase 2] [gn:ena2] [db:genpept] [de:debaryomyces occidentalis p-type atpase 2 (ena2) gene, complete cds.] |
| CONTIG1818 | 476384_c1_4 | 2614 | 16717 | 1407 | 469 | AF030861 | 1551 | 2.6(10)-159 | *Debaryomyces occidentalis* | [pn:p-type atpase 2] [gn:ena2] [db:genpept] [de:debaryomyces occidentalis p-type atpase 2 (ena2) gene, complete cds.] |
| CONTIG957 | 13772010_f2_2 | 2615 | 16718 | 576 | 192 | AJ002030 | 165 | 2.0(10)-12 | *Homo sapiens* | [pn:progesterone binding protein] [sr:human] [db:genpept] [de:homo sapiens mrna for putative progesterone binding protein.] [nt:putative] |
| CONTIG1432 | 16287535_f2_1 | 2616 | 16719 | 909 | 303 | AC002983 | 90 | 0.46999 | *Arabidopsis thaliana* | [pn:predicted protein] [gn:t3f12.8] [sr:thale cress] [db:genpept] [de:a. thaliana bac t3f12 from chromosome iv, likely from the long arm, complete sequence.] [nt:strongly similar to t21b4.1 (pid:2191190); an] |
| CONTIG5336 | 5271877_f2_6 | 2617 | 16720 | 1305 | 435 | AF030693 | 95 | 0.27 | *Plasmodium falciparum* | [pn:cg2] [gn:cg2] [fn:chloroquine resistance gene candidate] [sr:malaria parasite] [db:genpept-inv] [de:plasmodium falciparum strain hb3 cg2 (cg2) gene, complete cds.] [nt:detected by monoclonal antibody] |
| CONTIG3828 | 3907752_c2_3 | 2618 | 16721 | 753 | 251 | AF030694 | 98 | 0.066 | *Plasmodium falciparum* | [pn:cg7] [gn:cg7] [sr:malaria parasite] [db:genpept-inv] [de:plasmodium falciparum strain dd2 heat shock protein 86 (hsp86), o1 (o1), o3 (o3), o2 (o2), cg8 (cg8), cg4 (cg4), cg3 (cg3), cg9 (cg9), cg1 (cg1), cg6 (cg6), chloroquine resist |
| CONTIG3914 | 2847027_c3_7 | 2619 | 16722 | 1404 | 468 | AF007776 | 143 | 3.2(10)-7 | *Candida albicans* | [pn:gag protein] [db:genpept-pln] [de:candida albicans retrotransposon pcal, complete sequence.] [nt:orf1] |
| CONTIG5122 | 9819075_f1_1 | 2620 | 16723 | 1014 | 338 | AF007776 | 1448 | 2.2(10)-148 | *Candida albicans* | [pn:gag protein] [db:genpept-pln] [de:candida albicans retrotransposon pcal, complete sequence.] [nt:orf1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG962 | 2788182_f1_1 | 2621 | 16724 | 270 | 90 | AF007776 | 207 | 8.9(10)-17 | *Candida albicans* | [pn:gag protein] [db:genpept-pln] [de:candida albicans retrotransposon pca1, complete sequence.] [nt:orf1] |
| CONTIG1327 | 35799058_f1_1 | 2622 | 16725 | 987 | 329 | AF007776 | 1510 | 5.7(10)-155 | *Candida albicans* | [pn:pol protein] [db:genpept-pln] [de:candida albicans retrotransposon pca1, complete sequence.] [nt:orf2] |
| CONTIG3732 | 15672567_f1_1 | 2623 | 16726 | 555 | 185 | AF007776 | 231 | 7.5(10)-18 | *Candida albicans* | [pn:pol protein] [db:genpept-pln] [de:candida albicans retrotransposon pca1, complete sequence.] [nt:orf2] |
| CONTIG3732 | 3008442_f1_2 | 2624 | 16727 | 573 | 191 | AF007776 | 538 | 1.5(10)-50 | *Candida albicans* | [pn:pol protein] [db:genpept-pln] [de:candida albicans retrotransposon pca1, complete sequence.] [nt:orf2] |
| CONTIG2840 | 24725930_c3_5 | 2625 | 16728 | 1425 | 475 | AF007776 | 146 | 1.8(10)-6 | *Candida albicans* | [pn:pol protein] [db:genpept-pln] [de:candida albicans retrotransposon pca1, complete sequence.] [nt:orf2] |
| CONTIG3054 | 860338_c2_5 | 2626 | 16729 | 2637 | 879 | AF007776 | 4183 | 0 | *Candida albicans* | [pn:pol protein] [db:genpept-pln] [de:candida albicans retrotransposon pca1, complete sequence.] [nt:orf2] |
| CONTIG4386 | 56587_c2_6 | 2627 | 16730 | 258 | 86 | AF007776 | 154 | 1.2(10)-9 | *Candida albicans* | [pn:pol protein] [db:genpept-pln] [de:candida albicans retrotransposon pca1, complete sequence.] [nt:orf2] |
| CONTIG5122 | 15913437_f1_2 | 2628 | 16731 | 507 | 169 | AF007776 | 843 | 3.6(10)-83 | *Candida albicans* | [pn:pol protein] [db:genpept-pln] [de: candida albicans retrotransposon pca1, complete sequence.] [nt:orf2] |
| CONTIG962 | 15913437_f1_2 | 2629 | 16732 | 708 | 236 | AF007776 | 1150 | 8.1(10)-117 | *Candida albicans* | [pn:pol protein] [db:genpept-pln] [de: candida albicans retrotransposon pca1, complete sequence.] [nt:orf2] |
| CONTIG224 | 25600324_c1_2 | 2630 | 16733 | 624 | 208 | AF007776 | 854 | 2.3(10)-84 | *Candida albicans* | [pn:pol protein] [db:genpept-pln] [de: candida albicans retrotransposon pca1, complete sequence.] [nt:orf2] |
| CONTIG1165 | 22851388_c1_1 | 2631 | 16734 | 1167 | 389 | U89714 | 1576 | 5.9(10)-162 | *Candida albicans* | [pn:opaque-specific abc transporter] [gn:cdr3] [db:genpept-pln] [de:candida albicans opaque-specific abc transporter (cdr3) gene, complete cds.] |
| CONTIG1739 | 471040_f3_2 | 2632 | 16735 | 345 | 115 | U89714 | 507 | 2.7(10)-47 | *Candida albicans* | [pn:opaque-specific abc transporter] [gn:cdr3] [db:genpept-pln] [de:candida albicans opaque-specific abc transporter (cdr3) |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1806 | 36516561_c3_6 | 2633 | 16736 | 783 | 261 | U89714 | 1229 | 3.5(10)-125 | *Candida albicans* | gene, complete cds. [pn:opaque-specific abc transporter] [gn:cdr3] [db:genpept-pln] [de:candida albicans opaque-specific abc transporter (cdr3) gene, complete cds.] |
| CONTIG3175 | 30258442_c1_3 | 2634 | 16737 | 234 | 78 | AJ001726 | 103 | 3.0(10)-5 | *Neurospora crassa* | [pn:complex i intermediate associated protein cia35] [gn:cia35] [db:genpept-pln] [de:neurospora crassa cia35 gene.] |
| CONTIG5047 | 19554627_f2_4 | 2635 | 16738 | 495 | 165 | AJ001726 | 213 | 1.6(10)-17 | *Neurospora crassa* | [pn:complex i intermediate associated protein cia35] [gn:cia35] [db:genpept-pln] [de:neurospora crassa cia35 gene.] |
| CONTIG4800 | 4798127_f2_2 | 2636 | 16739 | 525 | 175 | AL009197 | 131 | 7.2(10)-18 | *Schizosaccharomyces pombe* | [pn:hypothetical protein] [gn:vip1] [sr:fission yeast] [db:genpept-pln] [des.pombe chromosome i cosmid c10f6.] [nt:spac10f6.06, vip1; unknown, len:257aa, identical to] |
| CONTIG3451 | 23539000_c3_5 | 2637 | 16740 | 1539 | 513 | AL009197 | 676 | 1.3(10)-66 | *Schizosaccharomyces pombe* | [pn:hypothetical protein] [gn:spac10f6.14c] [sr:fission yeast] [db:genpept-pln] [des.pombe chromosome i cosmid c10f6.] [nt:spac10f6.14c, unknown, len:535aa, similar eg. to] |
| CONTIG5754 | 15662777_c1_25 | 2638 | 16741 | 2739 | 913 | Z99296 | 604 | 7.2(10)-68 | *Schizosaccharomyces pombe* | [pn:hypothetical protein] [gn:spac3h5.08c] [sr:fission yeast] [db:genpept-pln] [des.pombe chromosome i cosmid c3h5.] [nt:spac3h5.08c, unknown, len:855aa, some similarity] |
| CONTIG2859 | 899012_c1_3 | 2639 | 16742 | 720 | 240 | Z99262 | 253 | 9.1(10)-22 | *Schizosaccharomyces pombe* | [pn:cell-cycle regulatory protein] [gn:wos2] [sr:fission yeast] [db:genpept-pln] [des.pombe chromosome i cosmid c9c9.] [nt:spac9c9.13c, wos2; cell cycle regulatory protein] |
| CONTIG2466 | 14244652_c2_8 | 2640 | 16743 | 720 | 240 | AF006514 | 94 | 0.23 | *Homo sapiens* | [pn:chd2] [gn:chd2] [de:homo sapiens chd2 mrna, complete cds.] [db:genpept-pri2] [de:homo sapiens chd2 mrna, complete cds.] |
| CONTIG5320 | 4018761_c1_6 | 2641 | 16744 | 1050 | 350 | AF001688 | 318 | 9.0(10)-28 | *Mus musculus* | [pn:u4/u6 snrnp 90 kda protein] [sr:house mouse] [db:genpept-rod] [de:mus musculus u4/u6 snrnp 90 kda protein gene, complete cds.] |
| CONTIG2886 | 35165687_f3_2 | 2642 | 16745 | 1944 | 648 | AF013614 | 154 | 1.8(10)-10 | *Fugu rubripes* | [gn:tsc2] [db:genpept-vrt] [de:fugu rubripes cosmid 259c6, complete sequence.] [nt:f_259c6.1] |
| CONTIG4108 | 5195337_f1_2 | 2643 | 16746 | 1149 | 383 | AE001153 | 126 | 0.00032 | *Borrelia burgdorferi* | [pn:b. burgdorferi predicted coding region bb0512] [gn:bb0512] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4977 | 31428803_f1_1 | 2644 | 16747 | 783 | 261 | AE001153 | 117 | 2.6(10)-5 | *Borrelia burgdorferi* | [sr:lyme disease spirochete] [db:genbank] [de:borrelia burgdorferi (section 39 of 70) of the complete genome.] [nt:hypothetical protein; identified by genemark;] [pn:b. burgdorferi predicted coding region bb0512] [gn:bb0512] [sr:lyme disease spirochete] [db:genbank] [de:borrelia burgdorferi (section 39 of 70) of the complete genome.] [nt:hypothetical protein; identified by genemark;] |
| CONTIG5055 | 29329517_c1_10 | 2645 | 16748 | 339 | 113 | AE000788 | 90 | 0.00096 | *Borrelia burgdorferi* | [pn:b. burgdorferi predicted coding region bbk23] [gn:bbk23] [sr:lyme disease spirochete] [db:genbank] [de:borrelia burgdorferi plasmid p36, complete plasmid sequence.] [nt:hypothetical protein; identified by genemark;] |
| CONTIG5388 | 24852276_c2_10 | 2646 | 16749 | 1245 | 415 | adhB | 317 | 1.5(10)-28 | *Bacillus subtilis* | [ui:adhB] [pn:alcohol dehydrogenase] [gtcfc:1.1.1.8:2.2.3.2:3.5.5.12:8.1] [keggfc:1.1.1.8:2.2.3.2:3.5.5.12:8.1] [bsorffc:2.6.1] [db:gtc-bacillus subtilis] |
| CONTIG4019 | 14710432_f2_1 | 2647 | 16750 | 1383 | 461 | acoL | 109 | 0.00449 | *Bacillus subtilis* | [ui:acoL] [pn:acetoin dehydrogenase c3 component:dihydrolipoamide dehydrogenase] [gn:yfjh] [gtcfc:1.1] [keggfc:14.2] [bsorffc:2.4.1] [db:gtc-bacillus subtilis] |
| CONTIG5546 | 4491625_c2_19 | 2648 | 16751 | 993 | 331 | acoL | 103 | 0.01299 | *Bacillus subtilis* | [ui:acoL] [pn:acetoin dehydrogenase c3 component:dihydrolipoamide dehydrogenase] [gn:yfjh] [gtcfc:1.1] [keggfc:14.2] [bsorffc:2.4.1] [db:gtc-bacillus subtilis] |
| CONTIG5018 | 23453909_c2_14 | 2649 | 16752 | 957 | 319 | aldX | 403 | 1.2(10)-37 | *Bacillus subtilis* | [ui:aldX] [pn:aldehyde dehydrogenase:probable aldehyde dehydrogenase yxas] [gn:yxas:yxbe:ve7fri] [gtcfc:1.1] [ec:1.2.1.3] [keggfc:14.1] [bsorffc:2.4.1] [db:gtc-bacillus subtilis] |
| CONTIG2774 | 10658208_c3_4 | 2650 | 16753 | 948 | 316 | ywdH | 282 | 1.7(10)-24 | *Bacillus subtilis* | [ui:ywdh] [pn:hypothetical |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4021 | 23598500_c1_10 | 2651 | 16754 | 1485 | 495 | ywdH | 404 | 1.3(10)-48 | *Bacillus subtilis* | protein:probably aldehyde dehydrognase ywdh] [gn:ipa-58r] [gtcfc:1.10:1.11:1.7:1.8:3.2:3.5:5.1 0:5.11:5.12:5.14:5.6:5.9:6.1:8.1:14.1] [ec:1.2.1.3] [keggfc:1.71.8:1.10:1.11:3.2:3.5:5.6: 5.9:5.10:5.11:5.12:5.1 [ui:ywdh] [pn:hypothetical protein:probable aldehyde |
| CONTIG5498 | 4459628_f2_3 | 2652 | 16755 | 606 | 202 | gutB | 106 | 0.00093 | *Bacillus subtilis* | dehydrogenase ywdh] [gn:ipa-58r] [gtcfc:1.10:1.11:1.7:1.8:3.2:3.5:5.1 0:5.11:5.12:5.14:5.6:5.9:6.1:8.1:14.1] [ec:1.2.1.3] [keggfc:1.71.8:1.10:1.11:3.2:3.5:5.6: 5.9:5.10:5.11:5.12:5.1 [ui:gutb] [pn:sorbitol dehydrogenase:l-iditol 2-dehydrogenase] [gtcfc:1.4:1.5] [ec:1.1.1.14] [keggfc:1.5] [bsorffc:2.1.1] [db:gtc-bacillus subtilis] |
| CONTIG553 | 191877_f2_1 | 2653 | 16756 | 426 | 142 | gutB | 149 | 4.4(10)-10 | *Bacillus subtilis* | [ui:gutb] [pn:sorbitol dehydrogenase:l-iditol 2-dehydrogenase] [gtcfc:1.4:1.5] [ec:1.1.1.14] [keggfc:1.5] [bsorffc:2.1.1] [db:gtc-bacillus subtilis] |
| CONTIG5522 | 26425177_c3_24 | 2654 | 16757 | 873 | 291 | kduD | 418 | 3.0(10)-39 | *Bacillus subtilis* | [ui:kdud] [pn:2-keto-3-deoxygluconate oxidoreductase:2-deoxy-d-gluconate 3-deoxygluconate oxydoreductase] [gtcfc:1.4] [ec:1.1.1.125] [keggfc:14.1] [bsorffc:2.1.1] [db:gtc-bacillus subtilis] |
| b3x16037.y | 16219543_f3_5 | 2655 | 16758 | 282 | 94 | mmgC | 201 | 9.4(10)-16 | *Bacillus subtilis* | [ui:mmgc] [pn:acyl-coa dehydrogenase] [gn:yqin] [gtcfc:1.8:2.2] [ec:1.3.99.-] [keggfc:14.1] [bsorffc:2.6.1:2.6.2] [db:gtc-bacillus subtilis] |
| CONTIG5614 | 25507180_c2_22 | 2656 | 16759 | 1635 | 545 | aspB | 234 | 4.5(10)-17 | *Bacillus subtilis* | [ui:aspb] [pn:aspartate aminotranferase:transaminase a:aspat] [gtcfc:2.4:5.1:5.10:5.15:5.2:5.5] [ec:2.6.1.1] [keggfc:2.3:5.11:5.2:5.5:5.10:5.15] [bsorffc:3.1.2] [db:gtc-bacillus subtilis] |
| CONTIG3790 | 1069136_c2_5 | 2657 | 16760 | 615 | 205 | hmp | 306 | 2.2(10)-27 | *Bacillus subtilis* | [ui:hmp] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3790 | 15672827_c2_4 | 2658 | 16761 | 300 | 100 | hmp | 112 | 6.0(10)-6 | Bacillus subtilis | [pn:flavohemoprotein:haemoglobin like protein:flavohemoglobin] [gn:ykia:ane3] [gtcfc:2.8] [keggfc:14.2] [bsorffc:2.7.1] [ui:hmp] |
| CONTIG4338 | 5907500_f2_3 | 2659 | 16762 | 1269 | 423 | hmp | 511 | 4.2(10)-49 | Bacillus subtilis | [pn:flavohemoprotein:haemoglobin like protein:flavohemoglobin] [gn:ykia:ane3] [gtcfc:2.8] [keggfc:14.2] [bsorffc:2.7.1] [ui:hmp] |
| CONTIG5015 | 35573416_f3_1 | 2660 | 16763 | 924 | 308 | fabD | 324 | 2.7(10)-29 | Bacillus subtilis | [ui:fabd] [pn:malonyl coa-acyl carrier protein transacylase.met] [gn:ylpe] [gtcfc:3.1.9.5] [ec:2.3.1.39] [keggfc:3.1] [bsorffc:3.4.9] [db:gtc-bacillus subtilis] |
| CONTIG2545 | 23984576_f1_1 | 2661 | 16764 | 789 | 263 | fabG | 249 | 2.3(10)-21 | Bacillus subtilis | [ui:fabg] [pn:3-oxoacyl-acyl-carrier protein reductase:3-ketoacyl-acyl carrier protein reductase] [gn:ylpf] [gtcfc:3.1.9.5] [ec:1.1.1.100] [keggfc:3.1] [bsorffc:3.4.9] [db:gtc-bacillus subtilis] |
| CONTIG3469 | 4882813_f2_2 | 2662 | 16765 | 1083 | 361 | yusK | 589 | 2.2(10)-57 | Bacillus subtilis | [ui:yusk] [pn:hypothetical protein:similar to acetyl-coa c-acyltransferase] [gtcfc:3.1.3.2:3.5.5.13:5.6:14.1] [ec:2.3.1.16] [keggfc:3.1:3.2:3.5.5.6:5.13] [bsorffc:8.1.1] [db:gtc-bacillus subtilis] |
| b3x14056.y | 12924199_c1_2 | 2663 | 16766 | 582 | 194 | yxjE | 576 | 5.5(10)-56 | Bacillus subtilis | [ui:yxje] [pn:hypothetical protein:probably succinyl-coa:3-ketoacid-coenzyme a transferase subunit b:succinyl coa:3-oxoacid coa-transferase:oxct b] [gn:scob:n151] [gtcfc:5.13:14.1] [keggfc:5.13] [bsorffc:8.1.1] [db:gtc-bacillus subtil |
| CONTIG5457 | 24650402_c1_6 | 2664 | 16767 | 909 | 303 | yxjD | 344 | 8.0(10)-56 | Bacillus subtilis | [ui:yxjd] [pn:hypothetical protein:probable succinyl-coa:3-ketoacid-coenzyme a transferase subunit a:succinyl coa:3-oxoacid |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5713 | 21875341_f3_5 | 2665 | 16768 | 1209 | 403 | metS | 708 | 5.5(10)-70 | Bacillus subtilis | coa-transferase:oxct a [gn:scoan15k] [gtcfc:5.13:14.1] [keggfc:5.13] [bsorffc:8.1.1] [db:gtc-bacillus subtil [ui:metS] [pn:methionyl-trna synthetase:methionine--trna ligase:metrs] [gtcfc:10.6] [ec:6.1.1.10] [keggfc:5.4:6.4:10.1:10.2] [bsorffc:4.3.1] [db:gtc-bacillus subtilis] |
| CONTIG2734 | 480152_c3_8 | 2666 | 16769 | 903 | 301 | ykwC | 142 | 1.5(10)-7 | Bacillus subtilis | [ui:ykwC] [pn:hypothetical protein:similar to 3-hydroxyisobutyrate dehydrogenase] [gtcfc:5.6:14.1] [ec:1.1.1.31] [keggfc:5.6] [bsorffc:8.1.1] [db:gtc-bacillus subtilis] |
| CONTIG5759 | 24002183_f3_10 | 2667 | 16770 | 1620 | 540 | lysS | 604 | 5.9(10)-59 | Bacillus subtilis | [ui:lysS] [pn:lysyl-trna synthetase:lysine--trna ligase:lysrs] [gtcfc:10.6] [ec:6.1.1.6] [keggfc:5.8:10.1:10.2] [bsorffc:4.3.1] [db:gtc-bacillus subtilis] |
| CONTIG5692 | 172037_c2_13 | 2668 | 16771 | 1863 | 621 | ggt | 535 | 1.2(10)-51 | Bacillus subtilis | [ui:ggt] [pn:gamma-glutamyltranspeptidase:gamma-glutamyltranspeptidase precursor] [gn:pac] [gtcfc:6.16:6.4:6.5:8.2:10.11] [ec:2.3.2.2] [keggfc:6.4:6.5:6.9:8.6] [bsorffc:4.3.4] [db:gtc-bacillus subtilis] |
| CONTIG2262 | 12287750_f1_1 | 2669 | 16772 | 1290 | 430 | iolA | 666 | 1.6(10)-65 | Bacillus subtilis | [ui:iolA] [pn:methylmalonate-semialdehyde dehydrogenase:probable methylmalonate-semialdehyde dehydrogenase:acylating:mmsdh [gn:mmsa:yxda:c83a] [gtcfc:8.2] [ec:1.2.1.27] [keggfc:14.1] [bsorffc:7.7.1] [db:gtc-bacillus subtilis] |
| CONTIG3774 | 26196900_f3_3 | 2670 | 16773 | 2352 | 784 | lonA | 534 | 5.2(10)-85 | Bacillus subtilis | [ui:lonA] [pn:class iii heat-shock atp-dependent lon protease:atp-dependent protease 1a 1] [gn:lon] [gtcfc:10.11] [ec:3.4.21.53] [keggfc:14.1] [bsorffc:4.3.4] [db:gtc-bacillus subtilis] |
| CONTIG701 | 9790932_f3_1 | 2671 | 16774 | 606 | 202 | rpsR | 116 | 4.0(10)-7 | Bacillus subtilis | [ui:rpsR] [pn:ribosomal protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | s18:30s ribosomal protein s18:bs21] [gtcfc:10.4] [keggfc:14.2] [bsorffc:4.3.2] [db:gtc-bacillus subtilis] |
| CONTIG3565 | 20501555_f2_4 | 2672 | 16775 | 741 | 247 | yqiZ | 100 | 0.00519 | Bacillus subtilis | [ui:yqiZ] [pn:hypothetical protein:probable amino-acid abc transporter atp-binding protein in bmru-ansr intergenic region] [gtcfc:12.6.14.1] [keggfc:11.1] [bsorffc:8.1.1] [db:gtc-bacillus subtilis] |
| CONTIG5605 | 579677_c3_18 | 2673 | 16776 | 2205 | 735 | dnaJ | 148 | 2.8(10)-7 | Bacillus subtilis | [ui:dnaj] [pn:heat-shock protein:dnaj protein] [gtcfc:12.7] [keggfc:14.2] [bsorffc:6.5.1] [db:gtc-bacillus subtilis] |
| CONTIG4618 | 14850312_f3_1 | 2674 | 16777 | 594 | 198 | cinA | 126 | 1.8(10)-7 | Bacillus subtilis | [ui:cina] [pn:competence-damage inducible protein:putative competence-damage protein] [gn:ymfo:yzlb] [gtcfc:13.2] [keggfc:14.2] [bsorffc:7.1.1] [db:gtc-bacillus subtilis] |
| CONTIG5273 | 6718755_f3_5 | 2675 | 16778 | 558 | 186 | yaaE | 228 | 4.0(10)-19 | Bacillus subtilis | [ui:yaae] [pn:hypothetical protein:hypothetical 21.4 kd protein in daca-sers intergenic region] [gtcfc:14.1] [keggfc:14.2] [bsorffc:8.1.1] [db:gtc-bacillus subtilis] |
| CONTIG1303 | 11203402_c3_4 | 2676 | 16779 | 1179 | 393 | yaaT | 136 | 6.9(10)-8 | Bacillus subtilis | [ui:yaat] [pn:hypothetical protein:hypothetical 31.2 kd protein in xpac-abrb intergenic region] [gtcfc:14.1] [keggfc:14.2] [bsorffc:8.1.1] [db:gtc-bacillus subtilis] |
| CONTIG1670 | 4547139_c1_3 | 2677 | 16780 | 1113 | 371 | yacA | 171 | 4.5(10)-10 | Bacillus subtilis | [ui:yaca] [pn:hypothetical protein:hypothetical 55.1 kd protein in spoiie-hpt intergenic region] [gtcfc:14.1] [keggfc:14.2] [bsorffc:8.1.1] [db:gtc-bacillus subtilis] |
| CONTIG5226 | 19625251_c2_15 | 2678 | 16781 | 993 | 331 | ybgG | 430 | 1.6(10)-40 | Bacillus subtilis | [ui:ybgg] [pn:hypothetical protein:similar to hypothetical proteins] [gtcfc:14.1] [keggfc:14.2] [bsorffc:8.1.1] [db:gtc-bacillus subtilis] |
| CONTIG4075 | 25680130_f1_1 | 2679 | 16782 | 483 | 161 | yceI | 99 | 0.00014 | Bacillus subtilis | [ui:ycei] [pn:hypothetical protein:similar to transporter] [gtcfc:14.1] [keggfc:14.2] [bsorffc:8.1.1] [db:gtc-bacillus subtilis] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4844 | 16287676_f1_1 | 2680 | 16783 | 294 | 98 | yceI | 91 | 0.0011 | Bacillus subtilis | [ui:yceI] [pn:hypothetical protein;similar to transporter] [gtcfc:14.1] [keggfc:14.2] [bsorffc:8.1.1] [db:gtc-bacillus subtilis] |
| CONTIG1646 | 4688219_c1_4 | 2681 | 16784 | 927 | 309 | yfmT | 414 | 8.0(10)-39 | Bacillus subtilis | [ui:yfmT] [pn:hypothetical protein;similar to benzaldehyde dehydrogenase] [gtcfc:14.1] [keggfc:14.2] [bsorffc:8.1.1] [db:gtc-bacillus subtilis] |
| CONTIG5571 | 25445253_c1_19 | 2682 | 16785 | 975 | 325 | yfmJ | 340 | 5.5(10)-31 | Bacillus subtilis | [ui:yfmJ] [pn:hypothetical protein;similar to quinone ixudireductase] [gtcfc:14.1] [keggfc:9.12] [bsorffc:8.1.1] [db:gtc-bacillus subtilis] |
| CONTIG2618 | 23459053_c2_7 | 2683 | 16786 | 597 | 199 | yfiG | 130 | 9.0(10)-8 | Bacillus subtilis | [ui:yfiG] [pn:hypothetical protein;hypothetical metabolite transport protein in glvbc 3" region] [gtcfc:14.1] [keggfc:14.2] [bsorffc:8.1.1] [db:gtc-bacillus subtilis] |
| CONTIG2776 | 25975063_c1_6 | 2684 | 16787 | 621 | 207 | yfhB | 158 | 2.5(10)-11 | Bacillus subtilis | [ui:yfhB] [pn:hypothetical protein;similar to hypothetical proteins] [gtcfc:14.1] [keggfc:14.2] [bsorffc:8.1.1] [db:gtc-bacillus subtilis] |
| CONTIG3317 | 25975063_f1_2 | 2685 | 16788 | 699 | 233 | yfhB | 157 | 3.2(10)-11 | Bacillus subtilis | [ui:yfhB] [pn:hypothetical protein;similar to hypothetical proteins] [gtcfc:14.1] [keggfc:14.2] [bsorffc:8.1.1] [db:gtc-bacillus subtilis] |
| CONTIG3317 | 6056286_f2_4 | 2686 | 16789 | 426 | 142 | yfhB | 116 | 1.2(10)-6 | Bacillus subtilis | [ui:yfhB] [pn:hypothetical protein;similar to hypothetical proteins] [gtcfc:14.1] [keggfc:14.2] [bsorffc:8.1.1] [db:gtc-bacillus subtilis] |
| CONTIG2581 | 5900817_f2_3 | 2687 | 16790 | 531 | 177 | yfhM | 122 | 2.7(10)-6 | Bacillus subtilis | [ui:yfhM] [pn:hypothetical protein;similar to epoxide hydrolase] [gtcfc:14.1] [keggfc:14.2] [bsorffc:8.1.1] [db:gtc-bacillus subtilis] |
| CONTIG5773 | 115662_c2_30 | 2688 | 16791 | 513 | 171 | yhfK | 298 | 1.6(10)-26 | Bacillus subtilis | [ui:yfhK] [pn:hypothetical protein;similar to hypothetical proteins] [gtcfc:14.1] [keggfc:14.2] [bsorffc:8.1.1] [db:gtc-bacillus subtilis] |
| CONTIG5761 | 21687788_c1_21 | 2689 | 16792 | 897 | 299 | yisK | 405 | 7.2(10)-38 | Bacillus subtilis | [ui:yisk] [pn:hypothetical protein;similar to 5-oxo-1,2,5- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3702 | 20392302_f1_2 | 2690 | 16793 | 423 | 141 | ykrS | 156 | 7.4(10)-11 | *Bacillus subtilis* | tricarboxilic-3-penten acid decarboxylase] [gtcfc:14.1] [keggfc:14.2] [bsorffc:8.1.1] [db:gtc-bacillus subtilis] [ui:ykrs] [pn:hypothetical protein:similar to initiation factor eif-2b:alpha subunit] [gtcfc:14.1] [keggfc:14.2] [bsorffc:8.1.1] [db:gtc-bacillus subtilis] |
| CONTIG4770 | 2157713_c2_8 | 2691 | 16794 | 756 | 252 | ykrS | 230 | 3.1(10)-19 | *Bacillus subtilis* | [ui:ykrs] [pn:hypothetical protein:similar to initiation factor eif-2b:alpha subunit] [gtcfc:14.1] [keggfc:14.2] [bsorffc:8.1.1] [db:gtc-bacillus subtilis] |
| b3x16064.y | 26255192_f3_3 | 2692 | 16795 | 495 | 165 | ykvO | 118 | 4.9(10)-7 | *Bacillus subtilis* | [ui:ykvo] [pn:hypothetical protein:similar to glucose 1-dehydrogenase] [gtcfc:14.1] [keggfc:14.2] [bsorffc:8.1.1] [db:gtc-bacillus subtilis] |
| CONTIG432 | 2385942_f2_1 | 2693 | 16796 | 1251 | 417 | yloO | 101 | 0.00959 | *Bacillus subtilis* | [ui:yloo] [pn:hypothetical protein:similar to hypothetical proteins] [gtcfc:14.1] [keggfc:14.2] [bsorffc:8.1.1] [db:gtc-bacillus subtilis] |
| CONTIG4735 | 33241263_c1_5 | 2694 | 16797 | 291 | 97 | yluA | 101 | 4.4(10)-5 | *Bacillus subtilis* | [ui:ylua] [pn:hypothetical protein:similar to hypothetical proteins] [gtcfc:14.1] [keggfc:14.2] [bsorffc:8.1.1] [db:gtc-bacillus subtilis] |
| CONTIG4811 | 10970438_c1_9 | 2695 | 16798 | 1551 | 517 | yncC | 106 | 0.00979 | *Bacillus subtilis* | [ui:yncc] [pn:hypothetical protein:similar to metabolite transport protein] [gtcfc:14.1] [keggfc:14.2] [bsorffc:8.1.1] [db:gtc-bacillus subtilis] |
| CONTIG1944 | 14070443_c1_4 | 2696 | 16799 | 1179 | 393 | yodT | 409 | 2.7(10)-38 | *Bacillus subtilis* | [ui:yodt] [pn:hypothetical protein:similar to adenosylmethionine-8-amino-7-oxononanoate aminotransferase] [gtcfc:14.1] [keggfc:14.2] [bsorffc:8.1.1] [db:gtc-bacillus subtilis] |
| CONTIG4745 | 36150003_f3_3 | 2697 | 16800 | 1107 | 369 | yoqW | 149 | 5.7(10)-14 | *Bacillus subtilis* | [ui:yoqw] [pn:hypothetical protein:similar to hypothetical proteins] [gtcfc:14.1] [keggfc:14.2] [bsorffc:8.1.1] [db:gtc-bacillus subtilis] |
| CONTIG5750 | 14240693_c2_20 | 2698 | 16801 | 2400 | 800 | yprA | 336 | 1.2(10)-49 | *Bacillus subtilis* | [ui:ypra] [pn:hypothetical protein:hypothetical helicase in pona-cotd intergenic region] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3492 | 22453302_c2_7 | 2699 | 16802 | 480 | 160 | yqkG | 133 | 4.7(10)-9 | Bacillus subtilis | [gtcfc:14.1] [keggfc:14.2] [bsorffc:8.1.1] [db:gtc-bacillus subtilis] [ui:yqkg] [pn:hypothetical protein:hypothetical 21.0 kd protein in glnq-ansr intergenic region] [gtcfc:14.1] [keggfc:14.2] [bsorffc:8.1.1] [db:gtc-bacillus subtilis] |
| CONTIG4458 | 21656962_f2_2 | 2700 | 16803 | 1140 | 380 | yqjM | 442 | 8.6(10)-42 | Bacillus subtilis | [ui:yqjm] [pn:hypothetical protein:probable nadh-dependent flavin oxidoreductase yqjm] [gtcfc:14.1] [ec:1.-.-.-] [keggfc:14.1] [bsorffc:8.1.1] [db:gtc-bacillus subtilis] |
| CONTIG5794 | 629681_c3_39 | 2701 | 16804 | 1293 | 431 | yqjM | 334 | 4.4(10)-53 | Bacillus subtilis | [ui:yqjm] [pn:hypothetical protein:probable nadh-dependent flavin oxidoreductase yqjm] [gtcfc:14.1] [ec:1.-.-.-] [keggfc:14.1] [bsorffc:8.1.1] [db:gtc-bacillus subtilis] |
| CONTIG5616 | 34178755_c2_26 | 2702 | 16805 | 477 | 159 | yrvI | 285 | 3.7(10)-25 | Bacillus subtilis | [ui:yrvi] [pn:hypothetical protein:similar to hypothetical proteins] [gtcfc:14.1] [keggfc:14.2] [bsorffc:8.1.1] [db:gtc-bacillus subtilis] |
| CONTIG5621 | 21906280_c2_16 | 2703 | 16806 | 1140 | 380 | ysxC | 174 | 8.6(10)-13 | Bacillus subtilis | [ui:ysyc] [pn:hypothetical protein:hypothetical gtp-binding protein in lona-hema intergenic region:orfx] [gtcfc:14.1] [keggfc:14.2] [bsorffc:8.1.1] [db:gtc-bacillus subtilis] |
| CONTIG5204 | 3163282_f3_3 | 2704 | 16807 | 732 | 244 | ytaG | 390 | 2.7(10)-36 | Bacillus subtilis | [ui:ytag] [pn:hypothetical protein:similar to hypothetical proteins] [gtcfc:14.1] [keggfc:14.2] [bsorffc:8.1.1] [db:gtc-bacillus subtilis] |
| CONTIG3297 | 4776412_c1_6 | 2705 | 16808 | 1095 | 365 | yulF | 268 | 2.3(10)-23 | Bacillus subtilis | [ui:yulf] [pn:hypothetical protein:similar to hypothetical proteins] [gtcfc:14.1] [keggfc:14.2] [bsorffc:8.1.1] [db:gtc-bacillus subtilis] |
| CONTIG1602 | 15828510_c3_3 | 2706 | 16809 | 972 | 324 | yutK | 401 | 1.8(10)-37 | Bacillus subtilis | [ui:yutk] [pn:hypothetical protein:similar to na+/nucleoside cotransporter] [gtcfc:14.1] [keggfc:14.2] [bsorffc:8.1.1] [db:gtc-bacillus subtilis] |
| CONTIG5426 | 5892951_f1_1 | 2707 | 16810 | 1161 | 387 | yutJ | 198 | 1.3(10)-13 | Bacillus subtilis | [ui:yutj] [pn:hypothetical protein:similar to nadh |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x16037.y | 34663505_f1_1 | 2708 | 16811 | 276 | 92 | yusJ | 189 | 5.5(10)-14 | Bacillus subtilis | dehydrogenase [gtcfc:14.1] [keggfc:14.2] [bsorffc:8.1.1] [db:gtc-bacillus subtilis] [ui:yusj] [pn:hypothetical protein:similar to butyryl-coa dehydrogenase] [gtcfc:14.1] [keggfc:14.2] [bsorffc:8.1.1] [db:gtc-bacillus subtilis] |
| CONTIG3334 | 34408268_f1_1 | 2709 | 16812 | 1431 | 477 | yusP | 293 | 2.2(10)-25 | Bacillus subtilis | [ui:yusp] [pn:hypothetical protein:similar to multidrug-efflux transporter] [gtcfc:14.1] [keggfc:14.2] [bsorffc:8.1.1] [db:gtc-bacillus subtilis] |
| CONTIG942 | 291663_f2_1 | 2710 | 16813 | 906 | 302 | yusP | 278 | 1.0(10)-23 | Bacillus subtilis | [ui:yusp] [pn:hypothetical protein:similar to multidrug-efflux transporter] [gtcfc:14.1] [keggfc:14.2] [bsorffc:8.1.1] [db:gtc-bacillus subtilis] |
| b9x10u32.x | 36147679_c2_1 | 2711 | 16814 | 663 | 221 | yusP | 193 | 1.8(10)-14 | Bacillus subtilis | [ui:yusp] [pn:hypothetical protein:similar to multidrug-efflux transporter] [gtcfc:14.1] [keggfc:14.2] [bsorffc:8.1.1] [db:gtc-bacillus subtilis] |
| CONTIG5277 | 5117037_c1_9 | 2712 | 16815 | 681 | 227 | yvgV | 99 | 0.00339 | Bacillus subtilis | [ui:yvgv] [pn:hypothetical protein:similar to hypothetical proteins] [gtcfc:14.1] [keggfc:14.2] [bsorffc:8.1.1] [db:gtc-bacillus subtilis] |
| CONTIG4307 | 35195927_c3_9 | 2713 | 16816 | 1329 | 443 | yvgX | 387 | 4.9(10)-35 | Bacillus subtilis | [ui:yvgx] [pn:hypothetical protein:similar to heavy metal-transporting atpase] [gtcfc:14.1] [ec:3.6.1.-] [keggfc:14.1] [bsorffc:8.1.1] [db:gtc-bacillus subtilis] |
| CONTIG4704 | 14632762_c1_5 | 2714 | 16817 | 393 | 131 | yveI | 120 | 1.1(10)-7 | Bacillus subtilis | [ui:yvci] [pn:hypothetical protein:similar to mutator mutt protein] [gtcfc:14.1] [keggfc:14.2] [bsorffc:8.1.1] [db:gtc-bacillus subtilis] |
| CONTIG3934 | 10189577_c1_5 | 2715 | 16818 | 759 | 253 | yvcE | 97 | 0.03799 | Bacillus subtilis | [ui:yvce] [pn:hypothetical protein:similar to cell wall-binding protein] [gn:yzka] [gtcfc:14.1] [keggfc:14.2] [bsorffc:8.1.1] [db:gtc-bacillus subtilis] |
| CONTIG2976 | 3942506_c1_7 | 2716 | 16819 | 840 | 280 | ywtG | 135 | 1.7(10)-6 | Bacillus subtilis | [ui:ywtg] [pn:hypothetical protein:similar to metabolite transport protein] [gtcfc:14.1] [keggfc:14.2] [bsorffc:8.1.1] [db:gtc-bacillus subtilis] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5813 | 14066375_c1_35 | 2717 | 16820 | 570 | 190 | ywtG | 130 | 8.4(10)-8 | *Bacillus subtilis* | [ui:ywtg] [pn:hypothetical protein:similar to metabolite transport protein] [gtcfc:14.1] [keggfc:14.2] [bsorffc:8.1.1] [db:gtc-bacillus subtilis] |
| CONTIG5316 | 12305293_c3_20 | 2718 | 16821 | 330 | 110 | ywrF | 191 | 3.3(10)-15 | *Bacillus subtilis* | [ui:ywrf] [pn:hypothetical protein] [gtcfc:14.1] [keggfc:14.2] [bsorffc:8.1.1] [db:gtc-bacillus subtilis] |
| CONTIG3309 | 4095375_f3_2 | 2719 | 16822 | 1065 | 355 | ywfD | 135 | 1.1(10)-6 | *Bacillus subtilis* | [ui:ywfd] [pn:hypothetical protein:hypothetical oxidoreductase in rocc-pta intergenic region] [gn:ipa-82d] [gtcfc:14.1] [ec:1.-.-.-] [keggfc:14.1] [bsorffc:8.1.1] [db:gtc-bacillus subtilis] |
| CONTIG5352 | 14579127_c1_7 | 2720 | 16823 | 930 | 310 | ywfD | 248 | 3.1(10)-21 | *Bacillus subtilis* | [ui:ywfd] [pn:hypothetical protein:hypothetical oxidoreductase in rocc-pta intergenic region] [gn:ipa-82d] [gtcfc:14.1] [ec:1.-.-.-] [keggfc:14.1] [bsorffc:8.1.1] [db:gtc-bacillus subtilis] |
| CONTIG5647 | 24648332_c3_20 | 2721 | 16824 | 1509 | 503 | yxiO | 113 | 0.0016 | *Bacillus subtilis* | [ui:yxio] [pn:hypothetical protein:hypothetical 47.3 kd protein in wapa-lict intergenic region] [gn:s3ar] [gtcfc:14.1] [keggfc:14.2] [bsorffc:8.1.1] [db:gtc-bacillus subtilis] |
| CONTIG5514 | 1172313_c2_11 | 2722 | 16825 | 456 | 152 | yxcK | 120 | 9.5(10)-7 | *Bacillus subtilis* | [ui:yxck] [pn:hypothetical protein:hypothetical 49.3 kd protein in idh-deor intergenic region] [gn:1p9c] [gtcfc:14.1] [keggfc:14.2] [bsorffc:8.1.1] [db:gtc-bacillus subtilis] |
| CONTIG5514 | 23611307_c1_8 | 2723 | 16826 | 1221 | 407 | yxeK | 483 | 3.8(10)-46 | *Bacillus subtilis* | [ui:yxek] [pn:hypothetical protein:hypothetical 49.3 kd protein in idh-deor intergenic region] [gn:1p9c] [gtcfc:14.1] [keggfc:14.2] [bsorffc:8.1.1] [db:gtc-bacillus subtilis] |
| CONTIG5693 | 23442181_c3_19 | 2724 | 16827 | 1620 | 540 | yxeK | 662 | 4.2(10)-65 | *Bacillus subtilis* | [ui:yxek] [pn:hypothetical protein:hypothetical 49.3 kd protein in idh-deor intergenic region] [gn:1p9c] [gtcfc:14.1] [keggfc:14.2] [bsorffc:8.1.1] [db:gtc-bacillus subtilis] |
| CONTIG3313 | 10738907_c3_12 | 2725 | 16828 | 1239 | 413 | yyaF | 557 | 5.5(10)-54 | *Bacillus subtilis* | [ui:yyaf] [pn:hypothetical protein:hypothetical 40.1 kd gtp- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x10759.x | 23478184_c2_2 | 2726 | 16829 | 279 | 93 | b2661 | 199 | 3.1(10)-15 | Escherichia coli | binding protein in rpsf-spo0j intergenic region] [gtcfc:14.1] [keggfc:14.2] [bsorfc:8.1.1] [db:gtc-bacillus subtilis] [ui:b2661] [pn:succinate-semialdehyde dehydrogenase:nadp+:ssdh] [gn:gabd] [gtcfc:1.4:1.8] [ec:1.2.1.16] [keggfc:1.11:5.15.12] [rileyfc:1.3.1] [db:gtc-escherichia coli] |
| CONTIG661 | 14072189_c1_3 | 2727 | 16830 | 687 | 229 | b2841 | 266 | 1.3(10)-22 | Escherichia coli | [ui:b2841] [pn:l-arabinose isomerase:arabinose-proton symport:arabinose transporter] [gn:arae] [gtcfc:12.2] [ec:5.3.1.4] [keggfc:1.4] [rileyfc:4.1.3] [db:gtc-escherichia coli] |
| CONTIG5820 | 5944017_f3_54 | 2728 | 16831 | 357 | 119 | b2276 | 97 | 0.00027 | Escherichia coli | [ui:b2276] [pn:nadh dehydrogenase i chain n:nadh-ubiquinone oxidoreductase chain 14:nuo14] [gn:nuon] [gtcfc:2.1:2.8:9.12] [ec:1.6.5.3] [keggfc:2.1.9.13] [rileyfc:1.2.6] [db:gtc-escherichia coli] |
| CONTIG5820 | 12142885_c3_93 | 2729 | 16832 | 273 | 91 | b2282 | 143 | 1.6(10)-9 | Escherichia coli | [ui:b2282] [pn:nadh dehydrogenase i chain h:nadh-ubiquinone oxidoreductase chain 8:nuo8] [gn:nuoh] [gtcfc:2.1:2.8:9.12] [ec:1.6.5.3] [keggfc:2.1.9.13] [rileyfc:1.2.6] [db:gtc-escherichia coli] |
| CONTIG5694 | 3938800_c1_17 | 2730 | 16833 | 825 | 275 | b1619 | 234 | 9.5(10)-20 | Escherichia coli | [ui:b1619] [pn:7-alpha-hydroxysteroid dehydrogenase:7-alpha-hsdh] [gn:hdha:hsdh] [gtcfc:2.3] [ec:1.1.1.159] [keggfc:14.1] [rileyfc:1.3.1] [db:gtc-escherichia coli] |
| b3x16064.y | 33259633_f2_2 | 2731 | 16834 | 324 | 108 | b1619 | 111 | 3.2(10)-6 | Escherichia coli | [ui:b1619] [pn:7-alpha-hydroxysteroid dehydrogenase:7-alpha-hsdh] [gn:hdha:hsdh] [gtcfc:2.3] [ec:1.1.1.159] [keggfc:14.1] [rileyfc:1.3.1] [db:gtc-escherichia coli] |
| CONTIG5792 | 21882777_c3_41 | 2732 | 16835 | 1278 | 426 | b2552 | 368 | 6.0(10)-34 | Escherichia coli | [ui:b2552] [pn:flavohemoprotein:haemoglobin-like protein:flavohemoglobin:dihydropteridine reductase:ferrisiderophore reductase b] [gn:hmpa:hmp:fsrb] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1757 | 31683136_f3_1 | 2733 | 16836 | 879 | 293 | b4051 | 438 | 2.2(10)-41 | Escherichia coli | [gtcfc:2.8.9.6] [ec:1.6.99.7] [keggfc:9.7] [rileyfc:1.2.6] [db:gtc-escherichia coli] [ui:b4051] [pn:quinone oxidoreductase:nadphquinone reductase:zeta-crystallin homolog protein] [gn:qor:hcz] [gtcfc:2.8.9.12] [ec:1.6.5.5] [keggfc:14.1] [rileyfc:1.2.6] [db:gtc-escherichia coli] |
| CONTIG3667 | 21665635_c3_2 | 2734 | 16837 | 909 | 303 | b0452 | 216 | 7.7(10)-18 | Escherichia coli | [ui:b0452] [pn:acyl-coa thioesterase ii] [gn:tesb] [gtcfc:3.1] [ec:3.1.2.-] [keggfc:14.1] [rileyfc:1.8.0] [db:gtc-escherichia coli] |
| CONTIG5588 | 3910635_f2_4 | 2735 | 16838 | 1173 | 391 | b0452 | 114 | 1.6(10)-7 | Escherichia coli | [ui:b0452] [pn:acyl-coa thioesterase ii] [gn:tesb] [gtcfc:3.1] [ec:3.1.2.-] [keggfc:14.1] [rileyfc:1.8.0] [db:gtc-escherichia coli] |
| CONTIG5588 | 4880002_f3_9 | 2736 | 16839 | 1002 | 334 | b0452 | 108 | 1.0(10)-9 | Escherichia coli | [ui:b0452] [pn:acyl-coa thioesterase ii] [gn:tesb] [gtcfc:3.1] [ec:3.1.2.-] [keggfc:14.1] [rileyfc:1.8.0] [db:gtc-escherichia coli] |
| CONTIG5588 | 21665635_f2_5 | 2737 | 16840 | 291 | 97 | b0452 | 111 | 4.2(10)-6 | Escherichia coli | [ui:b0452] [pn:acyl-coa thioesterase ii] [gn:tesb] [gtcfc:3.1] [ec:3.1.2.-] [keggfc:14.1] [rileyfc:1.8.0] [db:gtc-escherichia coli] |
| CONTIG5669 | 21756888_c2_24 | 2738 | 16841 | 1143 | 381 | b0452 | 154 | 1.2(10)-15 | Escherichia coli | [ui:b0452] [pn:acyl-coa thioesterase ii] [gn:tesb] [gtcfc:3.1] [ec:3.1.2.-] [keggfc:14.1] [rileyfc:1.8.0] [db:gtc-escherichia coli] |
| CONTIG5059 | 35806687_c1_8 | 2739 | 16842 | 420 | 140 | b2407 | 198 | 6.2(10)-16 | Escherichia coli | [ui:b2407] [pn:xanthosine phosphorylase] [gn:xapa:pnda] [gtcfc:4.1.5.11] [ec:2.4.2.-] [keggfc:5.111] [rileyfc:1.6.5] [db:gtc-escherichia coli] |
| CONTIG3659 | 29585840_f2_2 | 2740 | 16843 | 1230 | 410 | b1386 | 508 | 1.8(10)-48 | Escherichia coli | [ui:b1386] [pn:copper amine oxidase precursor:tyramine oxidase] [gn:tyna:maoa] [gtcfc:5.10:5.11:5.12:5.13:5.14:5.3:6.1:14.3] [ec:1.4.3.6] [keggfc:5.3:5.10:5.11:5.12:5.13:5.14:6.1] [rileyfc:5.8.0] [db:gtc-escherichia coli] |
| CONTIG5469 | 29548311_f3_8 | 2741 | 16844 | 1401 | 467 | b4386 | 244 | 1.6(10)-19 | Escherichia coli | [ui:b4386] [pn:lipoate-protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5735 | 14179650_c2_20 | 2742 | 16845 | 264 | 88 | b3041 | 184 | 1.8(10)-14 | Escherichia coli | ligase a] [gn:lpla] [gtcfc:9.12:9.6.14.3] [ec:6.-.-.-] [keggfc:9.7:9.13] [rileyfc:5.8.0] [db:gtc-escherichia coli] [ui:b3041] [pn:3,4-dihydroxy-2-butanone 4-phosphate synthase:dhbp synthase] [gn:ribb:htrp] [gtcfc:9.2] [keggfc:14.2] [rileyfc:1.7.9] [db:gtc-escherichia coli] |
| CONTIG4540 | 26025180_f2_3 | 2743 | 16846 | 375 | 125 | b0774 | 316 | 1.8(10)-28 | Escherichia coli | [ui:b0774] [pn:adenosylmethionine-8-amino-7-oxononanoate aminotransferase:7,8-diamino-pelargonic acid aminotransferase:dapa aminotransferase] [gn:bioa] [gtcfc:9.6] [keggfc:9.6] [rileyfc:1.7.1] [db:gtc-escherichia coli] |
| CONTIG5560 | 11955213_c3_15 | 2744 | 16847 | 852 | 284 | b0774 | 743 | 1.1(10)-73 | Escherichia coli | [ui:b0774] [pn:adenosylmethionine-8-amino-7-oxononanoate aminotransferase:7,8-diamino-pelargonic acid aminotransferase:dapa aminotransferase] [gn:bioa] [gtcfc:9.6] [keggfc:9.6] [rileyfc:1.7.1] [db:gtc-escherichia coli] |
| CONTIG5600 | 26384652_c1_17 | 2745 | 16848 | 2703 | 901 | b2592 | 1732 | 1.7(10)-178 | Escherichia coli | [ui:b2592] [pn:clpb protein:heat shock protein f84.1] [gn:clpb:htpm] [gtcfc:10.11] [keggfc:14.2] [rileyfc:3.2.3] [db:gtc-escherichia coli] |
| CONTIG4921 | 4694052_f3_4 | 2746 | 16849 | 1725 | 575 | b2213 | 122 | 1.3(10)-8 | Escherichia coli | [ui:b2213] [pn:ada regulatory protein:regulatory protein:regulatory protein of adaptative response:contains:methylated-dna--protein-cysteine methyltransferase:o-6-methylguanine-dna alkyltransferase] [gn:ada] [gtcfc:10.8] [ec:2.1.1.63] |
| CONTIG5387 | 20364175_c1_14 | 2747 | 16850 | 561 | 187 | b2213 | 251 | 1.5(10)-21 | Escherichia coli | [ui:b2213] [pn:ada regulatory protein:regulatory protein-regulatory protein of adaptative response:contains-methylated-dna--protein-cysteine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4535 | 5901965_f1_1 | 2748 | 16851 | 1704 | 568 | b3741 | 1082 | 1.3(10)-109 | Escherichia coli | methyltransferase:o-6-methylguanine-dna alkyltransferase] [gn:ada] [gtcfc:10.8] [ec:2.1.1.63] [ui:b3741] [pn:glucose inhibited division protein:glucose inhibited division protein a] [gn:gida] [gtcfc:10.8] [keggfc:14.2] [rileyfc:3.1.7] [db:gtc-escherichia coli] |
| CONTIG2974 | 29554062_f2_4 | 2749 | 16852 | 666 | 222 | b2156 | 259 | 8.8(10)-22 | Escherichia coli | [ui:b2156] [pn:lysine-specific permease] [gn:lysp:cadr] [gtcfc:12.1] [keggfc:14.2] [rileyfc:4.1.1] [db:gtc-escherichia coli] |
| CONTIG2974 | 35189040_f3_6 | 2750 | 16853 | 597 | 199 | b2156 | 254 | 3.1(10)-21 | Escherichia coli | [ui:b2156] [pn:lysine-specific permease] [gn:lysp:cadr] [gtcfc:12.1] [keggfc:14.2] [rileyfc:4.1.1] [db:gtc-escherichia coli] |
| CONTIG5319 | 34387_c1_7 | 2751 | 16854 | 243 | 81 | b4031 | 114 | 5.0(10)-6 | Escherichia coli | [ui:b4031] [pn:xylose-proton symport:xylose transporter] [gn:xyle] [gtcfc:12.2] [keggfc:14.2] [rileyfc:4.1.3] [db:gtc-escherichia coli] |
| CONTIG3369 | 12925062_f1_1 | 2752 | 16855 | 264 | 88 | b3849 | 91 | 0.00129 | Escherichia coli | [ui:b3849] [pn:trkh] [gtcfc:12.5] [keggfc:14.2] [rileyfc:4.1.2] [db:gtc-escherichia coli] |
| b9x12t47.y | 26284428_c2_9 | 2753 | 16856 | 498 | 166 | b1158 | 230 | 2.5(10)-19 | Escherichia coli | [ui:b1158] [pn:dna-invertase pin:dna-invertase] [gn:pin] [gtcfc:13.1] [keggfc:14.2] [rileyfc:5.1.0] [db:gtc-escherichia coli] |
| CONTIG1700 | 4328557_f1_1 | 2754 | 16857 | 630 | 210 | b0156 | 90 | 0.00017 | Escherichia coli | [ui:b0156] [pn:hypothetical 12.1 kd protein in hem1-pfs intergenic region] [gn:yadr] [gtcfc:14.1] [keggfc:14.2] [rileyfc:5.7.0] [db:gtc-escherichia coli] |
| CONTIG4907 | 5371099_c1_7 | 2755 | 16858 | 444 | 148 | b0368 | 153 | 8.1(10)-11 | Escherichia coli | [ui:b0368] [pn:hypothetical protein:probable taurine catabolism dioxygenase:sulfate starvation-induced protein 3:ssi3] [gn:taud:ssid] [gtcfc:14.1] [ec:1.-.-.-] [keggfc:14.1] [rileyfc:5.7.0] [db:gtc-escherichia coli] |
| CONTIG5567 | 23992328_f2_6 | 2756 | 16859 | 840 | 280 | b0489 | 251 | 1.5(10)-21 | Escherichia coli | [ui:b0489] [pn:hypothetical protein:hypothetical 33.7 kd protein in usha-tesa intergenic region] [gn:ybbk] [gtcfc:14.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4609 | 33781579_c2_12 | 2757 | 16860 | 366 | 122 | b0686 | 99 | 6.9(10)-5 | Escherichia coli | [keggfc:14.2] [rileyfc:5.7.0] [db:gtc-escherichia coli] [ui:b0686] [pn:hypothetical protein] [gtcfc:14.1] [keggfc:14.2] [rileyfc:5.7.0] [db:gtc-escherichia coli] |
| CONTIG5221 | 14316656_f3_11 | 2758 | 16861 | 1068 | 356 | b0821 | 244 | 5.5(10)-19 | Escherichia coli | [ui:b0821] [pn:hypothetical protein] [gtcfc:14.1] [keggfc:14.2] [rileyfc:5.7.0] [db:gtc-escherichia coli] |
| CONTIG5221 | 26197177_f1_2 | 2759 | 16862 | 573 | 191 | b0821 | 139 | 1.5(10)-8 | Escherichia coli | [ui:b0821] [pn:hypothetical protein] [gtcfc:14.1] [keggfc:14.2] [rileyfc:5.7.0] [db:gtc-escherichia coli] |
| CONTIG4368 | 35445263_c2_6 | 2760 | 16863 | 699 | 233 | b0838 | 157 | 1.3(10)-11 | Escherichia coli | [ui:b0838] [pn:hypothetical protein] [gtcfc:14.1] [keggfc:14.2] [rileyfc:5.7.0] [db:gtc-escherichia coli] |
| CONTIG4011 | 29475724_c1_3 | 2761 | 16864 | 1503 | 501 | b1045 | 276 | 1.3(10)-23 | Escherichia coli | [ui:b1045] [pn:hypothetical protein] [gtcfc:14.1] [keggfc:14.2] [rileyfc:5.7.0] [db:gtc-escherichia coli] |
| CONTIG3953 | 22454827_f2_3 | 2762 | 16865 | 921 | 307 | b1120 | 210 | 2.0(10)-28 | Escherichia coli | [ui:b1120] [pn:hypothetical protein] [gtcfc:14.1] [keggfc:14.2] [rileyfc:5.7.0] [db:gtc-escherichia coli] |
| CONTIG5552 | 2126680_c3_18 | 2763 | 16866 | 1299 | 433 | b1133 | 633 | 6.0(10)-62 | Escherichia coli | [ui:b1133] [pn:hypothetical protein in purb 5" region:hypothetical 42.6 kd protein in purb-icda intergenic region:orf-15] [gn:ycfb] [gtcfc:14.1] [keggfc:14.2] [rileyfc:5.7.0] [db:gtc-escherichia coli] |
| CONTIG5552 | 20320152_f3_10 | 2764 | 16867 | 762 | 254 | b1180 | 315 | 2.5(10)-28 | Escherichia coli | [ui:b1180] [pn:hypothetical protein] [gtcfc:14.1] [keggfc:14.2] [rileyfc:5.7.0] [db:gtc-escherichia coli] |
| CONTIG3219 | 979812_c3_7 | 2765 | 16868 | 384 | 128 | b1203 | 252 | 1.2(10)-21 | Escherichia coli | [ui:b1203] [pn:hypothetical gtp-binding protein in pth 3" region:probable gtp-binding protein in trea-pth intergenic region:orf-3] [gn:ychf:gtp1] [gtcfc:14.1] [keggfc:14.2] [rileyfc:5.7.0] [db:gtc-escherichia coli] |
| CONTIG5786 | 24807805_c3_34 | 2766 | 16869 | 1278 | 426 | b1680 | 149 | 1.3(10)-7 | Escherichia coli | [ui:b1680] [pn:hypothetical protein] [gtcfc:14.1] [keggfc:14.2] [rileyfc:5.7.0] [db:gtc-escherichia coli] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4264 | 2429075_c1_5 | 2767 | 16870 | 1749 | 583 | b1706 | 296 | 5.5(10)-44 | Escherichia coli | [ui:b1706] [pn:hypothetical protein] [gtcfc:14.1] [keggfc:14.2] [rileyfc:5.7.0] [db:gtc-escherichia coli] |
| CONTIG5307 | 4804587_c2_9 | 2768 | 16871 | 696 | 232 | b1768 | 204 | 2.1(10)-32 | Escherichia coli | [ui:b1768] [pn:hypothetical 23.4 kd protein in ansa 3" region [gn:ydjb] [gtcfc:14.1] [keggfc:14.2] [rileyfc:5.7.0] [db:gtc-escherichia coli] |
| CONTIG4649 | 4100307_c3_9 | 2769 | 16872 | 729 | 243 | b1802 | 287 | 2.2(10)-25 | Escherichia coli | [ui:b1802] [pn:hypothetical protein] [gtcfc:14.1] [keggfc:14.2] [rileyfc:5.7.0] [db:gtc-escherichia coli] |
| CONTIG5804 | 3912761_c3_62 | 2770 | 16873 | 681 | 227 | b1802 | 91 | 0.08899 | Escherichia coli | [ui:b1802] [pn:hypothetical protein] [gtcfc:14.1] [keggfc:14.2] [rileyfc:5.7.0] [db:gtc-escherichia coli] |
| CONTIG2979 | 10179037_f2_4 | 2771 | 16874 | 561 | 187 | b1864 | 235 | 7.5(10)-20 | Escherichia coli | [ui:b1864] [pn:hypothetical 26.4 kd protein in ruve-asps intergenic region] [gn:yebc] [gtcfc:14.1] [keggfc:14.2] [rileyfc:5.7.0] [db:gtc-escherichia coli] |
| CONTIG5587 | 2042312_c2_22 | 2772 | 16875 | 600 | 200 | b1970 | 115 | 3.8(10)-7 | Escherichia coli | [ui:b1970] [pn:hypothetical protein] [gtcfc:14.1] [keggfc:14.2] [rileyfc:5.7.0] [db:gtc-escherichia coli] |
| CONTIG1954 | 11172650_f2_2 | 2773 | 16876 | 600 | 200 | b2086 | 90 | 0.068 | Escherichia coli | [ui:b2086] [pn:hypothetical protein:hypothetical 32.0 kd protein in ogrk-gatr intergenic region] [gn:yegs] [gtcfc:14.1] [keggfc:14.2] [rileyfc:5.7.0] [db:gtc-escherichia coli] |
| CONTIG5772 | 31250050_c2_34 | 2774 | 16877 | 954 | 318 | b2165 | 680 | 5.2(10)-67 | Escherichia coli | [ui:b2165] [pn:hypothetical 32.9 kd protein in nfo-frua intergenic region] [gn:yein] [gtcfc:14.1] [keggfc:14.2] [rileyfc:5.7.0] [db:gtc-escherichia coli] |
| CONTIG5772 | 15839713_c3_41 | 2775 | 16878 | 1068 | 356 | b2166 | 165 | 4.9(10)-12 | Escherichia coli | [ui:b2166] [pn:hypothetical 33.6 kd protein in nfo-frua intergenic region] [gn:yeic] [gtcfc:14.1] [keggfc:14.2] [rileyfc:5.7.0] [db:gtc-escherichia coli] |
| CONTIG712 | 23550942_f3_2 | 2776 | 16879 | 558 | 186 | b2302 | 233 | 1.2(10)-19 | Escherichia coli | [ui:b2302] [pn:hypothetical protein:hypothetical 24.5 kd protein in pta-folx intergenic region] [gn:yfcg] [gtcfc:14.1] [keggfc:14.2] [rileyfc:5.7.0] [db:gtc-escherichia coli] |
| CONTIG3649 | 11929704_c1_5 | 2777 | 16880 | 723 | 241 | b2374 | 116 | 0.0002 | Escherichia coli | [ui:b2374] [pn:hypothetical |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5682 | 803825_c2_23 | 2778 | 16881 | 1065 | 355 | b2426 | 224 | 1.1(10)-18 | Escherichia coli | protein] [gtcfc:14.1] [kegfc:14.2] [rileyfc:5.7.0] [db:gtc-escherichia coli] [ui:b2426] [pn:hypothetical protein in cysp 5'' region:oxidoreductase ucpa] [gn:yfefucpa] [gtcfc:14.1] [ec:1.-.-.] [kegfc:14.1] [rileyfc:5.7.0] [db:gtc-escherichia coli] |
| b9x12u56.x | 29416408_f2_1 | 2779 | 16882 | 564 | 188 | b2430 | 108 | 0.00079 | Escherichia coli | [ui:b2430] [pn:hypothetical protein] [gtcfc:14.1] [kegfc:14.2] [rileyfc:5.7.0] [db:gtc-escherichia coli] |
| CONTIG1270 | 4770427_c2_8 | 2780 | 16883 | 621 | 207 | b2545 | 198 | 1.8(10)-15 | Escherichia coli | [ui:b2545] [pn:hypothetical protein] [gtcfc:14.1] [kegfc:14.2] [rileyfc:5.7.0] [db:gtc-escherichia coli] |
| b9x11160.x | 5447303_f1_1 | 2781 | 16884 | 549 | 183 | b2627 | 772 | 9.3(10)-77 | Escherichia coli | [ui:b2627] [pn:hypothetical protein:hypothetical 83.1 kd protein in alpha-gabd intergenic region:f729] [gn:yfjk] [gtcfc:14.1] [kegfc:14.2] [rileyfc:5.7.0] [db:gtc-escherichia coli] |
| b9x11160.x | 14572755_f2_3 | 2782 | 16885 | 399 | 133 | b2627 | 318 | 1.1(10)-27 | Escherichia coli | [ui:b2627] [pn:hypothetical protein:hypothetical 83.1 kd protein in alpha-gabd intergenic region:f729] [gn:yfjk] [gtcfc:14.1] [kegfc:14.2] [rileyfc:5.7.0] [db:gtc-escherichia coli] |
| CONTIG4008 | 21484383_f3_5 | 2783 | 16886 | 639 | 213 | b2660 | 159 | 5.7(10)-11 | Escherichia coli | [ui:b2660] [pn:hypothetical protein:hypothetical 48.6 kd protein in alpa-gabp intergenic region] [gn:ygaf] [gtcfc:14.1] [kegfc:14.2] [rileyfc:5.7.0] [db:gtc-escherichia coli] |
| CONTIG4114 | 30504076_c2_5 | 2784 | 16887 | 528 | 176 | b2666 | 98 | 2.5(10)-5 | Escherichia coli | [ui:b2666] [pn:hypothetical protein] [gtcfc:14.1] [kegfc:14.2] [rileyfc:5.7.0] [db:gtc-escherichia coli] |
| CONTIG2751 | 26195262_f2_3 | 2785 | 16888 | 318 | 106 | b2666 | 125 | 3.3(10)-8 | Escherichia coli | [ui:b2666] [pn:hypothetical protein] [gtcfc:14.1] [kegfc:14.2] [rileyfc:5.7.0] [db:gtc-escherichia coli] |
| CONTIG1536 | 26172806_c1_2 | 2786 | 16889 | 942 | 314 | b2883 | 178 | 1.3(10)-21 | Escherichia coli | [ui:b2883] [pn:hypothetical protein] [gtcfc:14.1] [kegfc:14.2] [rileyfc:5.7.0] [db:gtc-escherichia coli] |
| CONTIG4759 | 9773275_f3_8 | 2787 | 16890 | 747 | 249 | b2928 | 197 | 7.9(10)-16 | Escherichia coli | [ui:b2928] [pn:hypothetical 27.1 kd protein in gapb-cmta intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3163 | 5281562_f1_1 | 2788 | 16891 | 423 | 141 | b3102 | 255 | 5.7(10)-22 | Escherichia coli | region:hypothetical 27.1 kd protein in cpd-cmta intergenic region:orf3:f237] [gn:yggc] [gtcfc:14.1] [keggfc:14.2] [gn:yggc] [gtcfc:5.7.0] [db:gtc-escherichia coli] |
| CONTIG3163 | 32070907_f3_3 | 2789 | 16892 | 636 | 212 | b3102 | 466 | 2.5(10)-44 | Escherichia coli | [ui:b3102] [pn:hypothetical 37.4 kd protein in exur-tdcc intergenic region:o328] [gn:yyqig] [gtcfc:14.1] [keggfc:14.2] [rileyfc:5.7.0] [db:gtc-escherichia coli] |
| CONTIG5427 | 5194430_c1_18 | 2790 | 16893 | 531 | 177 | b3152 | 196 | 1.0(10)-15 | Escherichia coli | [ui:b3152] [pn:hypothetical 24.8 kd protein in agai-mtr intergenic region:f226] [gn:yrar] [gtcfc:14.1] [keggfc:14.2] [rileyfc:5.7.0] [db:gtc-escherichia coli] |
| CONTIG4150 | 1992151_f3_7 | 2791 | 16894 | 363 | 121 | b3190 | 99 | 1.8(10)-5 | Escherichia coli | [ui:b3190] [pn:hypothetical 9.5 kd protein in murz-rpon intergenic region] [gn:yrba] [gtcfc:14.1] [keggfc:14.2] [rileyfc:5.7.0] [db:gtc-escherichia coli] |
| CONTIG2380 | 12166461_f2_1 | 2792 | 16895 | 1233 | 411 | b3232 | 184 | 1.2(10)-13 | Escherichia coli | [ui:b3232] [pn:hypothetical 43.1 kd protein in rplm-hhoa intergenic region:f375] [gn:yhcm] [gtcfc:14.1] [keggfc:14.2] [rileyfc:5.7.0] [db:gtc-escherichia coli] |
| b2x17123.y | 3956967_f1_1 | 2793 | 16896 | 513 | 171 | b3232 | 142 | 1.5(10)-14 | Escherichia coli | [ui:b3232] [pn:hypothetical 43.1 kd protein in rplm-hhoa intergenic region:f375] [gn:yhcm] [gtcfc:14.1] [keggfc:14.2] [rileyfc:5.7.0] [db:gtc-escherichia coli] |
| CONTIG2301 | 9957660_f2_2 | 2794 | 16897 | 660 | 220 | b3248 | 172 | 3.5(10)-13 | Escherichia coli | [ui:b3248] [pn:hypothetical 21.5 kd protein in cafa-mred intergenic region:orfe] [gn:yhde] [gtcfc:14.1] [keggfc:14.2] [rileyfc:5.7.0] [db:gtc-escherichia coli] |
| b4x10264.y | 29474001_f2_1 | 2795 | 16898 | 609 | 203 | b3654 | 309 | 1.3(10)-27 | Escherichia coli | [ui:b3654] [pn:hypothetical 48.9 kd protein in glts 3" region:hypothetical 48.9 kd protein in glts-selc intergenic region] [gn:yice] [gtcfc:14.1] [keggfc:14.2] [rileyfc:5.7.0] [db:gtc-escherichia coli] |
| CONTIG1347 | 25588577_f2_1 | 2796 | 16899 | 327 | 109 | b3676 | 95 | 5.0(10)-5 | Escherichia coli | [ui:b3676] [pn:hypothetical 12.8 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | kd protein in ivbl-ibpb intergenic region:hypothetical 12.8 kd protein in emrd-glvg intergenic region] [gn:yidh] [gtcfc:14.1] [keggfc:14.2] [rileyfc:5.7.0] [db:gtc-escherichia coli] |
| CONTIG5666 | 10945130_f3_7 | 2797 | 16900 | 465 | 155 | b4056 | 329 | 8.1(10)-30 | Escherichia coli | [ui:b4056] [pn:hypothetical 15.7 kd protein in tyrb-uvra intergenic region:hypothetical 15.7 kd protein in apha-uvra intergenic region:0138] [gn:ylbq] [gtcfc:14.1] [keggfc:14.2] [rileyfc:5.7.0] [db:gtc-escherichia coli] |
| CONTIG5808 | 14454062_f1_4 | 2798 | 16901 | 1062 | 354 | b0651 | 373 | 1.8(10)-34 | Escherichia coli | [ui:b0651] [pn:hypothetical 33.8 kd protein in leus-gltl intergenic region] [gn:ybek] [gtcfc:14.2] [keggfc:14.2] [rileyfc:5.9.0] [db:gtc-escherichia coli] |
| CONTIG2954 | 4301532_c1_6 | 2799 | 16902 | 708 | 236 | b1539 | 325 | 2.2(10)-29 | Escherichia coli | [ui:b1539] [pn:hypothetical oxidoreductase in dcp-noha intergenic region] [gn:ydfg] [gtcfc:14.2] [ec:1.-.-.-] [keggfc:14.1] [rileyfc:5.9.0] [db:gtc-escherichia coli] |
| CONTIG69 | 4301532_f3_1 | 2800 | 16903 | 630 | 210 | b1539 | 284 | 4.7(10)-25 | Escherichia coli | [ui:b1539] [pn:hypothetical oxidoreductase in dcp-noha intergenic region] [gn:ydfg] [gtcfc:14.2] [ec:1.-.-.-] [keggfc:14.1] [rileyfc:5.9.0] [db:gtc-escherichia coli] |
| b2x15517.y | 33243942_f2_1 | 2801 | 16904 | 540 | 180 | b2184 | 151 | 6.7(10)-10 | Escherichia coli | [ui:b2184] [pn:hypothetical 66.4 kd protein in rsua-rply intergenic region] [gn:yejh] [gtcfc:14.2] [keggfc:14.2] [rileyfc:5.9.0] [db:gtc-escherichia coli] |
| CONTIG5796 | 10348161_f1_6 | 2802 | 16905 | 1095 | 365 | b3039 | 130 | 4.5(10)-6 | Escherichia coli | [ui:b3039] [pn:hypothetical 29.9 kd protein in tolc-ribb intergenic region:orfc.f271] [gn:ygid] [gtcfc:14.2] [keggfc:14.2] [rileyfc:5.9.0] [db:gtc-escherichia coli] |
| CONTIG1787 | 15656875_f1_1 | 2803 | 16906 | 357 | 119 | b0036 | 112 | 3.5(10)-6 | Escherichia coli | [ui:b0036] [pn:carnitine racemase] [gn:caid] [gtcfc:9.13] [ec:5.-.-.-] [keggfc:14.1] [rileyfc:5.8.0] [db:gtc-escherichia coli] |
| CONTIG2965 | 7032092_c3_5 | 2804 | 16907 | 699 | 233 | b0256 | 94 | 0.04599 | Escherichia coli | [ui:b0256] [pn:transposase for insertion sequence element is 30] [gn:tra8_1] [gtcfc:13.5] [keggfc:14.2] [rileyfc:5.8.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2046 | 23457035_f2_2 | 2805 | 16908 | 333 | 111 | b0890 | 90 | 0.00619 | *Escherichia coli* | [db:gtc-escherichia coli] [ui:b0890] [pn:cell division protein ftsk] [gn:ftsk] [gtcfc:12.8] [keggfc:14.2] [rileyfc:5.8.0] [db:gtc-escherichia coli] |
| CONTIG5554 | 12672811_f2_7 | 2806 | 16909 | 888 | 296 | HI0611 | 191 | 3.3(10)-15 | *Haemophilus influenzae* | [ui:hi0611] [pn:fuculose-1-phosphate aldolase:1-fuculose phosphate aldolase] [gn:fuca] [gtcfc:1.4.1.8:7.1] [ec:4.1.2.17] [keggfc:1.8] [tigrfc:6.12] [db:gtc-haemophilus influenzae] |
| CONTIG5605 | 19957807_f1_1 | 2807 | 16910 | 684 | 228 | HI0611 | 152 | 2.6(10)-10 | *Haemophilus influenzae* | [ui:hi0611] [pn:fuculose-1-phosphate aldolase:1-fuculose phosphate aldolase] [gn:fuca] [gtcfc:1.4.1.8:7.1] [ec:4.1.2.17] [keggfc:1.8] [tigrfc:6.12] [db:gtc-haemophilus influenzae] |
| CONTIG5488 | 1209433_c1_11 | 2808 | 16911 | 1068 | 356 | HI0193 | 223 | 4.9(10)-24 | *Haemophilus influenzae* | [ui:hi0193] [pn:dihydrolipoamide acetyltransferase] [gn:acoc] [gtcfc:1.8] [keggfc:14.2] [tigrfc:6.11] [db:gtc-haemophilus influenzae] |
| CONTIG4812 | 1955078_f3_3 | 2809 | 16912 | 711 | 237 | HI0155 | 271 | 1.1(10)-23 | *Haemophilus influenzae* | [ui:hi0155] [pn:3-ketoacyl-acyl carrier protein reductase-3-oxoacyl-acyl-carrier protein reductase] [gn:fabg] [gtcfc:3.1.3.2] [ec:1.1.1.100] [keggfc:3.1] [tigrfc:7.1] [db:gtc-haemophilus influenzae] |
| CONTIG5669 | 4472010_c1_19 | 2810 | 16913 | 909 | 303 | HI0076 | 187 | 4.2(10)-13 | *Haemophilus influenzae* | [ui:hi0076] [pn:acyl-coa thioesterase ii] [gn:tesb] [gtcfc:3.1.3.2] [ec:3.1.2.-] [keggfc:14.1] [tigrfc:7.1] [db:gtc-haemophilus influenzae] |
| CONTIG4600 | 29312556_c3_5 | 2811 | 16914 | 1863 | 621 | HI0748 | 243 | 4.2(10)-17 | *Haemophilus influenzae* | [ui:hi0748] [pn:glycerol-3-phosphate acyltransferase] [gn:plsb] [gtcfc:3.1.3.2.8.1] [ec:2.3.1.15] [keggfc:8.1] [tigrfc:7.1] [db:gtc-haemophilus influenzae] |
| CONTIG5068 | 23867137_c1_8 | 2812 | 16915 | 270 | 90 | HI1277 | 173 | 1.3(10)-12 | *Haemophilus influenzae* | [ui:hi1277] [pn:putative atpase:mrp:protein homolog] [gn:mrp] [gtcfc:4.4] [keggfc:14.2] [tigrfc:8.5] [db:gtc-haemophilus influenzae] |
| CONTIG5316 | 7070278_f1_3 | 2813 | 16916 | 447 | 149 | HI0970 | 347 | 1.0(10)-31 | *Haemophilus influenzae* | [ui:hi0970] [pn:3-dehydroquinate dehydratase:3-dehydroquinase] [gn:aroq] [gtcfc:5.15] [ec:4.2.1.10] [keggfc:5.15] [tigrfc:1.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4751 | 1427_f1_1 | 2814 | 16917 | 1335 | 445 | HI0140 | 373 | 1.8(10)-34 | Haemophilus influenzae | haemophilus influenzae] [ui:hi0140] [pn:n-acetylglucosamine-6-phosphate deacetylase] [gn:naga] [gtcfc:7.1] [ec:3.5.1.25] [keggfc:4.4] [tigrfc:5.1] [db:gtc-haemophilus influenzae] |
| CONTIG5682 | 22851702_c2_24 | 2815 | 16918 | 873 | 291 | HI0645 | 172 | 4.7(10)-11 | Haemophilus influenzae | [ui:hi0645] [pn:lysophospholipase 12:probable lysophospholipase 12:lecithinase b] [gn:pldb] [gtcfc:8.4 13.10] [ec:3.1.1.5] [keggfc:8.4] [tigrfc:5.3] [db:gtc-haemophilus influenzae] |
| CONTIF3550 | 6273399_c1_2 | 2816 | 16919 | 642 | 214 | HI1559 | 122 | 1.3(10)-5 | Haemophilus influenzae | [ui:hi1559] [pn:protoporphyrinogen oxidase:possible protoporphyrinogen oxidase] [gn:hemk] [gtcfc:9.10] [ec:1.3.3.-] [keggfc:14.1] [tigrfc:2.3] [db:gtc-haemophilus influenzae] |
| CONTIF3548 | 157305_f2_5 | 2817 | 16920 | 438 | 146 | HI0892 | 168 | 5.4(10)-12 | Haemophilus influenzae | [ui:hi0892] [pn:atp-dependent rna helicase:atp-dependent rna helicase homolog] [gn:rhlb] [gtcfc:10.2] [keggfc:14.2] [tigrfc:11.2] [db:gtc-haemophilus influenzae] |
| CONTIG2918 | 36330092_c2_4 | 2818 | 16921 | 1221 | 407 | HI0588 | 478 | 1.3(10)-45 | Haemophilus influenzae | [ui:hi0588] [pn:n-carbamyl-1-amino acid amidohydrolase] [gtcfc:5.16] [keggfc:14.2] [tigrfc:14.7] [db:gtc-haemophilus influenzae] |
| CONTIG4823 | 1282542_f3_2 | 2819 | 16922 | 408 | 136 | HI0163 | 151 | 5.9(10)-11 | Haemophilus influenzae | [ui:hi0163] [pn:putative murein gene regulator:protein homolog] [gn:bola] [gtcfc:12.13] [keggfc:14.2] [tigrfc:9.1] [db:gtc-haemophilus influenzae] |
| b2x15627.y | 13712825_c3_4 | 2820 | 16923 | 210 | 70 | HI0060 | 115 | 5.0(10)-6 | Haemophilus influenzae | [ui:hi0060] [pn:atp dependent transport homolog:msba:probable transport atp-binding protein msba] [gn:msba:msh-1] [gtcfc:12.6] [keggfc:14.2] [tigrfc:13.6] [db:gtc-haemophilus influenzae] |
| CONTIG5677 | 23850785_c1_21 | 2821 | 16924 | 969 | 323 | HI1238 | 113 | 0.00059 | Haemophilus influenzae | [ui:hi1238] [pn:heat shock protein:protein] [gn:dnaj] [gtcfc:12.7] [keggfc:14.2] [tigrfc:4.3] [db:gtc-haemophilus influenzae] |
| CONTIG1252 | 866433_c3_4 | 2822 | 16925 | 699 | 233 | HI1374 | 101 | 0.035 | Haemophilus influenzae | [ui:hi1374] [pn:cell division protein:cell division protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5771 | 20755077_c1_27 | 2823 | 16926 | 372 | 124 | HI0798B | 115 | 3.8(10)-7 | *Haemophilus influenzae* | homolog] [gn:mukb] [gtcfc:12.8] [keggfc:14.2] [tigrfc:4.1] [db-gtc-haemophilus influenzae] [ui:hi0798b] [pn:50s ribosomal protein 136] [gn:rpmj:rp136] [gtcfc:10.4] [keggfc:14.2] [db-gtc-haemophilus influenzae] |
| CONTIG3608 | 4031700_c3_11 | 2824 | 16927 | 609 | 203 | HI0572 | 211 | 2.6(10)-17 | *Haemophilus influenzae* | [ui:hi0572] [pn:sp:p37687:hypothetical protein] [gn:hin1693] [gtcfc:14.1] [keggfc:14.2] [tigrfc:15.1] [db-gtc-haemophilus influenzae] |
| CONTIG3947 | 3906303_f2_3 | 2825 | 16928 | 1530 | 510 | HI298 | 138 | 4.5(10)-7 | *Haemophilus influenzae* | [ui:hi1298] [pn:sp:p33373:hypothetical protein] [gtcfc:14.1] [keggfc:14.2] [tigrfc:15.1] [db-gtc-haemophilus influenzae] |
| CONTIG1443 | 14569012_f2_1 | 2826 | 16929 | 912 | 304 | HI1590 | 308 | 1.3(10)-27 | *Haemophilus influenzae* | [ui:hi1590] [pn:gb:x75627_4:hypothetical protein] [gtcfc:14.1] [keggfc:14.2] [tigrfc:15.1] [db-gtc-haemophilus influenzae] |
| b3x16673.y | 25422259_c2_2 | 2827 | 16930 | 384 | 128 | HI1612 | 116 | 2.7(10)-6 | *Haemophilus influenzae* | [ui:hi1612] [pn:sp:p37340:hypothetical protein] [gtcfc:14.1] [keggfc:14.2] [tigrfc:15.1] [db-gtc-haemophilus influenzae] |
| CONTIG3357 | 4772216_c3_4 | 2828 | 16931 | 774 | 258 | HP1155 | 112 | 0.00022 | *Helicobacter pylori* | [ui:hp1155] [pn:transferase; peptidoglycan synthesis] [gn:mrug] gtcfc:1.5:7.1:8.5:11.3:11.4] [ec:2.4.1.-] [keggfc:1.5:7.2:7.3:8.5] [tigrfc:3.2] [db-gtc-helicobacter pylori] |
| CONTIG3492 | 970305_f2_4 | 2829 | 16932 | 615 | 205 | HP1261 | 357 | 8.8(10)-33 | *Helicobacter pylori* | [ui:hp1261] [pn:nadh-ubiquinone oxidoreductase, subunit:nadh-ubiquinone oxidoreductase, nqo6 subunit] [gn:nqo6] [gtcfc:2.1:9.12] [ec:1.6.5.3] [keggfc:2.1:9.13] [tigrfc:6.1] [db-gtc-helicobacter pylori] |
| CONTIG5759 | 4960962_f2_9 | 2830 | 16933 | 450 | 150 | HP1263 | 173 | 1.3(10)-12 | *Helicobacter pylori* | [ui:hp1263] [pn:nadh-ubiquinone oxidoreductase, subunit:nadh-ubiquinone oxidoreductase, nqo4 subunit] [gn:nqo4] [gtcfc:2.1:9.12] [ec:1.6.5.3] [keggfc:2.1:9.13] [tigrfc:6.1] [db-gtc-helicobacter pylori] |
| CONTIG5820 | 32064012_f3_59 | 2831 | 16934 | 372 | 124 | HP1272 | 116 | 3.2(10)-6 | *Helicobacter pylori* | [ui:hp1272] [pn:nadh-ubiquinone oxidoreductase, subunit:nadh- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5820 | 788552_f3_53 | 2832 | 16935 | 291 | 97 | HP1273 | 91 | 0.0015 | Helicobacter pylori | ubiquinone oxidoreductase, nqo13 subunit] [gn:nqo13] [gtcfc:2.1.9.12] [ec:1.6.5.3] [keggfc:2.1.9.13] [tigrfc:6.1] [db:gtc-helicobacter pylori] [ui:hp1273] [pn:nadh-ubiquinone oxidoreductase, subunit:nadh-ubiquinone oxidoreductase, nqo14 subunit] [gn:nqo14] [gtcfc:2.1.9.12] [ec:1.6.5.3] [keggfc:2.1.9.13] [tigrfc:6.1] [db:gtc-helicobacter pylori] |
| CONTIG5820 | 6672680_f3_55 | 2833 | 16936 | 381 | 127 | HP1273 | 103 | 7.5(10)-5 | Helicobacter pylori | [ui:hp1273] [pn:nadh-ubiquinone oxidoreductase, subunit:nadh-ubiquinone oxidoreductase, nqo14 subunit] [gn:nqo14] [gtcfc:2.1.9.12] [ec:1.6.5.3] [keggfc:2.1.9.13] [tigrfc:6.1] [db:gtc-helicobacter pylori] |
| CONTIG5805 | 38177_c2_30 | 2834 | 16937 | 1560 | 520 | HP0416 | 361 | 3.2(10)-33 | Helicobacter pylori | [ui:hp0416] [pn:cyclopropane fatty acid synthase] [gn:cfa] [gtcfc:3.1.3.2.8.1] [ec:2.1.1.79] [keggfc:14.1] [tigrfc:7.1] [db:gtc-helicobacter pylori] |
| CONTIG3544 | 14534556_c2_8 | 2835 | 16938 | 537 | 179 | HP0171 | 146 | 1.0(10)-9 | Helicobacter pylori | [ui:hp0171] [pn:peptide chain release factor rf-2] [gn:prfb] [gtcfc:10.7] [keggfc:14.2] [tigrfc:12.8] [db:gtc-helicobacter pylori] |
| CONTIG2099 | 24812790_f2_1 | 2836 | 16939 | 717 | 239 | HP0247 | 142 | 2.2(10)-7 | Helicobacter pylori | [ui:hp0247] [pn:atp-dependent rna helicase, dead-box family] [gn:dead] [gtcfc:10.7] [keggfc:14.2] [tigrfc:12.8] [db:gtc-helicobacter pylori] |
| CONTIG5594 | 23525277_f1_3 | 2837 | 16940 | 726 | 242 | HP0701 | 108 | 0.0035 | Helicobacter pylori | [ui:hp0701] [pn:dna gyrase, sub a gyra:dna gyrase subunit a] [gn:gyra] [gtcfc:10.8] [ec:5.99.1.3] [keggfc:14.1] [tigrfc:10.2] [db:gtc-helicobacter pylori] |
| CONTIG1082 | 234436_c3_3 | 2838 | 16941 | 1113 | 371 | HP1403 | 91 | 0.48999 | Helicobacter pylori | [ui:hp1403] [pn:type i restriction enzyme m protein] [gn:hsdm] [gtcfc:10.8] [keggfc:14.2] [tigrfc:10.2] [db:gtc-helicobacter pylori] |
| CONTIG3810 | 21515925_f1_2 | 2839 | 16942 | 1026 | 342 | HP1429 | 253 | 9.1(10)-22 | Helicobacter pylori | [ui:hp1429] [pn:polysialic acid capsule expression protein] [gn:kpsf] [gtcfc:11.3] [keggfc:14.2] [tigrfc:3.3] [db:gtc-helicobacter pylori] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4735 | 24015962_f3_3 | 2840 | 16943 | 756 | 252 | HP0244 | 100 | 0.01299 | Helicobacter pylori | [ui:hp0244] [pn:signal-transducing protein, histidine kinase] [gn:atos] [gtcfc:12.13] [keggfc:14.2] [tigrfc:9.1] [db:gtc-helicobacter pylori] |
| CONTIG5519 | 14547217_c3_9 | 2841 | 16944 | 1908 | 636 | HP0600 | 92 | 0.4 | Helicobacter pylori | [ui:hp0600] [pn:multidrug resistance protein] [gn:spab] [gtcfc:12.6] [keggfc:14.2] [tigrfc:13.1] [db:gtc-helicobacter pylori] |
| CONTIG5406 | 10007752_f3_5 | 2842 | 16945 | 1101 | 367 | HP0082 | 91 | 0.37 | Helicobacter pylori | [ui:hp0082] [pn:methyl-accepting chemotaxis transducer] [gn:tlpc] [gtcfc:12.9] [keggfc:14.2] [tigrfc:4.1] [db:gtc-helicobacter pylori] |
| CONTIG5096 | 4381577_c2_10 | 2843 | 16946 | 849 | 283 | HP0392 | 101 | 0.012 | Helicobacter pylori | [ui:hp0392] [pn:histidine kinase chea:histidine kinase] [gn:chea] [gtcfc:12.9] [ec:2.7.3-] [keggfc:14.1] [tigrfc:4.1] [db:gtc-helicobacter pylori] |
| CONTIG726 | 4978942_f1_1 | 2844 | 16947 | 642 | 214 | HP0059 | 100 | 0.00519 | Helicobacter pylori | [ui:hp0059] [pn:h] [gtcfc:14.1.14.2] [keggfc:14.2] [db:gtc-helicobacter pylori] |
| CONTIG3233 | 22343915_c1_4 | 2845 | 16948 | 432 | 144 | HP0207 | 208 | 2.1(10)-16 | Helicobacter pylori | [ui:hp0207] [pn:atp-binding protein:mpr] [gtcfc:14.1.14.2] [keggfc:14.2] [db:gtc-helicobacter pylori] |
| CONTIF4026 | 10048388_f1_1 | 2846 | 16949 | 1125 | 375 | HP0479 | 91 | 0.13 | Helicobacter pylori | [ui:hp0479] [pn:h] [gtcfc:14.1.14.2] [keggfc:14.2] [db:gtc-helicobacter pylori] |
| CONTIG2852 | 19720063_c1_3 | 2847 | 16950 | 1569 | 523 | HP0880 | 98 | 0.0014 | Helicobacter pylori | [ui:hp0880] [pn:h] [gtcfc:14.1.14.2] [keggfc:14.2] [db:gtc-helicobacter pylori] |
| CONTIG1918 | 31281693_c3_4 | 2848 | 16951 | 981 | 327 | HP1142 | 92 | 0.22 | Helicobacter pylori | [ui:hp1142] [pn:h] [gtcfc:14.1.14.2] [keggfc:14.2] [db:gtc-helicobacter pylori] |
| CONTIG2319 | 2741577_f3_1 | 2849 | 16952 | 417 | 139 | HP1142 | 90 | 0.0033 | Helicobacter pylori | [ui:hp1142] [pn:h] [gtcfc:14.1.14.2] [keggfc:14.2] [db:gtc-helicobacter pylori] |
| CONTIG3408 | 22725327_f2_5 | 2850 | 16953 | 597 | 199 | HP1117 | 127 | 5.7(10)-7 | Helicobacter pylori | [ui:hp1117] [pn:conserved hypothetical secreted protein] [gtcfc:14.1] [keggfc:15.1] [db:gtc-helicobacter pylori] |
| CONTIG3192 | 24649077_f1_1 | 2851 | 16954 | 1191 | 397 | HP1117 | 145 | 5.5(10)-8 | Helicobacter pylori | [ui:hp1117] [pn:conserved hypothetical secreted protein] [gtcfc:14.1] [keggfc:15.1] [db:gtc-helicobacter pylori] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5491 | 25579711_f2_1 | 2852 | 16955 | 594 | 198 | MG355 | 95 | 0.05999 | Mycoplasma genitalium | [ui:mg355] [pn:atp-dependent protease binding subunit:protein] [gn:clpb] [gtcfc:10.11] [keggfc:14.2] [tigrfc:12.3] [db:gtc-mycoplasma genitalium] |
| CONTIG5294 | 14664026_f1_1 | 2853 | 16956 | 807 | 269 | MG435 | 182 | 3.1(10)-14 | Mycoplasma genitalium | [ui:mg435] [pn:ribosome recycling factor:ribosome releasing factor:rrf] [gn:frr] [gtcfc:10.7] [keggfc:14.2] [tigrfc:12.4] [db:gtc-mycoplasma genitalium] |
| CONTIG4749 | 6337916_c1_6 | 2854 | 16957 | 906 | 302 | MG386 | 109 | 0.008 | Mycoplasma genitalium | [ui:mg386] [pn:cytadherence-accessory protein:hmw1] [gtcfc:11.3] [keggfc:14.2] [tigrfc:3.4] [db:gtc-mycoplasma genitalium] |
| CONTIG4889 | 33320277_f1_1 | 2855 | 16958 | 936 | 312 | MG002 | 142 | 1.8(10)-7 | Mycoplasma genitalium | [ui:mg002] [pn:heat shock protein:dnaj-like protein mg002] [gtcfc:12.7] [keggfc:14.2] [tigrfc:4.3] [db:gtc-mycoplasma genitalium] |
| CONTIG5280 | 4197137_f1_2 | 2856 | 16959 | 597 | 199 | MG019 | 144 | 1.8(10)-9 | Mycoplasma genitalium | [ui:mg019] [pn:heat shock protein:dnaj] [gtcfc:12.7] [keggfc:14.2] [tigrfc:4.3] [db:gtc-mycoplasma genitalium] |
| CONTIG4205 | 581252_c2_6 | 2857 | 16960 | 981 | 327 | MG218 | 130 | 7.2(10)-5 | Mycoplasma genitalium | [ui:mg218] [pn:hypothetical protein mg218] [gtcfc:14.1:14.2] [keggfc:14.2] [db:gtc-mycoplasma genitalium] |
| b2x17609.y | 2773313_c2_2 | 2858 | 16961 | 861 | 287 | MG397 | 95 | 0.099 | Mycoplasma genitalium | [ui:mg397] [pn:hypothetical protein mg397] [gtcfc:14.1:14.2] [keggfc:14.2] [db:gtc-mycoplasma genitalium] |
| CONTIG2583 | 24486437_f2_1 | 2859 | 16962 | 615 | 205 | MG148 | 95 | 0.01499 | Mycoplasma genitalium | [ui:mg148] [pn:hypothetical protein:gb118965__6:hypothetical protein mg148] [gtcfc:14.1] [keggfc:14.2] [tigrfc:15.1] [db:gtc-mycoplasma genitalium] |
| CONTIG5678 | 10728160_c1_11 | 2860 | 16963 | 975 | 325 | MG280 | 95 | 0.02999 | Mycoplasma genitalium | [ui:mg280] [pn:sensory rhodopsin ii transducer:htrii:hypothetical protein mg280] [gtcfc:14.3] [keggfc:14.2] [tigrfc:14.2] [db:gtc-mycoplasma genitalium] |
| CONTIG5801 | 6923161_c1_34 | 2861 | 16964 | 672 | 224 | MG328 | 102 | 0.014 | Mycoplasma genitalium | [ui:mg328] [pn:protein v] [gn:fcrv] [gtcfc:14.3] [keggfc:14.2] [tigrfc:14.2] [db:gtc-mycoplasma genitalium] |
| CONTIG4858 | 23832787_f2_1 | 2862 | 16965 | 624 | 208 | MJ0001 | 193 | 7.0(10)-15 | Methanococcus jannaschii | [ui:mj0001] [pn:aspartate aminotransferase:aspb1:probable |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5062 | 9775636_f1_3 | 2863 | 16966 | 867 | 289 | MJ1575 | 97 | 0.0063 | Methanococcus jannaschii | aspartate aminotransferase:transaminase a:aspat1 [gtcfc:2.4:5.1:5.10:5.15:5.2:5.5] [ec:2.6.1.1] [kegg fc:2.3:5.1:5.2:5.5:10.5:5.15] [tigrfc:1.3] [db:gtc-methanococcus jannaschii] |
| CONTIG2795 | 4473261_c1_6 | 2864 | 16967 | 615 | 205 | MJ0174 | 187 | 2.5(10)-14 | Methanococcus jannaschii | [ui:mj1575] [pn:gmp synthase:guaa:gmp synthetase] [gtcfc:4.1:5.1] [ec:6.3.5.2] [keggfc:4.1:5.1] [tigrfc:8.3] [db:gtc-methanococcus jannaschii] |
| CONTIG5295 | 34064518_c3_12 | 2865 | 16968 | 2103 | 701 | MJ1156 | 1346 | 1.3(10)-137 | Methanococcus jannaschii | [ui:mj0174] [pn:cell division protein pelota:pela:cell division protein] [gtcfc:12.8] [keggfc:14.2] [tigrfc:4.2] [db:gtc-methanococcus jannaschii] |
| CONTIG903 | 9798252_f1_1 | 2866 | 16969 | 882 | 294 | MJ1156 | 652 | 4.7(10)-64 | Methanococcus jannaschii | [ui:mj1156] [pn:cell division control protein 48:cdc48, aaa family:cell division cycle protein 48 homolog] [gtcfc:12.8] [keggfc:14.2] [tigrfc:4.2] [db:gtc-methanococcus jannaschii] |
| CONTIG2194 | 22437812_c3_5 | 2867 | 16970 | 549 | 183 | MJ1643 | 102 | 0.01299 | Methanococcus jannaschii | [ui:mj1156] [pn:cell division control protein 48:cdc48, aaa family:cell division cycle protein 48 homolog] [gtcfc:12.8] [keggfc:14.2] [tigrfc:4.2] [db:gtc-methanococcus jannaschii] |
| CONTIG4182 | 11132965_c1_5 | 2868 | 16971 | 1176 | 392 | MJ1643 | 145 | 1.3(10)-6 | Methanococcus jannaschii | [ui:mj1643] [pn:chromosome segregation protein:smc1:p115 protein] [gtcfc:12.8] [keggfc:14.2] [tigrfc:4.2] [db:gtc-methanococcus jannaschii] |
| CONTIG5059 | 10962750_c1_11 | 2869 | 16972 | 822 | 274 | MJ1643 | 115 | 0.0011 | Methanococcus jannaschii | [ui:mj1643] [pn:chromosome segregation protein:smc1:p115 protein] [gtcfc:12.8] [keggfc:14.2] [tigrfc:4.2] [db:gtc-methanococcus jannaschii] |
| CONTIG5636 | 10641386_f1_1 | 2870 | 16973 | 3027 | 1009 | MJ0063 | 97 | 0.035 | Methanococcus jannaschii | [ui:mj1643] [pn:chromosome segregation protein:smc1:p115 protein] [gtcfc:12.8] [keggfc:14.2] [tigrfc:4.2] [db:gtc-methanococcus jannaschii] [ui:mj0063] [pn:hypothetical protein] [gtcfc:14.1] [keggfc:15.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1386 | 29723450_f3_1 | 2871 | 16974 | 948 | 316 | MJ0064 | 90 | 0.047 | *Methanococcus jannaschii* | *methanococcus jannaschii* [ui:mj0064] [pn:hypothetical protein] [gtcfc:14.1] [keggfc:14.2] [tigrfc:15.1] [db:gtc- |
| CONTIG3038 | 35581503_c2_3 | 2872 | 16975 | 1302 | 434 | MJ0147 | 95 | 0.1 | *Methanococcus jannaschii* | *methanococcus jannaschii* [ui:mj0147] [pn:hypothetical protein:hypothetical atp-binding protein] [gtcfc:14.1] [keggfc:14.2] [tigrfc:15.1] [db:gtc- |
| CONTIG2069 | 473160_c1_4 | 2873 | 16976 | 450 | 150 | MJ0691 | 135 | 2.8(10)-9 | *Methanococcus jannaschii* | *methanococcus jannaschii* [ui:mj0691] [pn:conserved hypothetical protein:m] [gtcfc:14.1] [keggfc:14.2] [tigrfc:15.1] [db:gtc- |
| CONTIG5738 | 24656658_c3_16 | 2874 | 16977 | 2091 | 697 | MJ0895 | 97 | 0.098 | *Methanococcus jannaschii* | *methanococcus jannaschii* [ui:mj0895] [pn:hypothetical protein:m] [gtcfc:14.1] [keggfc:14.2] [tigrfc:15.1] [db:gtc- |
| CONTIG132 | 36072535_c2_4 | 2875 | 16978 | 240 | 80 | MJ1073 | 108 | 7.9(10)-16 | *Methanococcus jannaschii* | *methanococcus jannaschii* [ui:mj1073] [pn:conserved hypothetical protein:m] [gtcfc:14.1] [keggfc:14.2] [tigrfc:15.1] [db:gtc- |
| b2x12825.y | 24022655_f2_1 | 2876 | 16979 | 294 | 98 | MJ1136 | 211 | 2.0(10)-16 | *Methanococcus jannaschii* | *methanococcus jannaschii* [ui:mj1136] [pn:conserved hypothetical protein:hypothetical protein] [gtcfc:14.1] [keggfc:14.2] [tigrfc:15.1] [db:gtc- |
| CONTIG4469 | 33438217_c2_8 | 2877 | 16980 | 720 | 240 | MJ1326 | 461 | 8.4(10)-44 | *Methanococcus jannaschii* | *methanococcus jannaschii* [ui:mj1326] [pn:gtp-binding protein] [gtcfc:14.1] [keggfc:14.2] [tigrfc:15.1] [db:gtc- |
| CONTIG5130 | 20117131_f2_5 | 2878 | 16981 | 759 | 253 | MJ1332 | 512 | 3.2(10)-49 | *Methanococcus jannaschii* | *methanococcus jannaschii* [ui:mj1332] [pn:gtp-binding protein] [gtcfc:14.1] [keggfc:14.2] [tigrfc:15.1] [db:gtc- |
| CONTIG1055 | 6339517_f3_2 | 2879 | 16982 | 471 | 157 | MJ1372 | 144 | 8.3(10)-10 | *Methanococcus jannaschii* | *methanococcus jannaschii* [ui:mj1372] [pn:conserved hypothetical protein:hypothetical protein] [gtcfc:14.1] [keggfc:14.2] [tigrfc:15.1] [db:gtc- |
| CONTIG4735 | 6843878_c3_10 | 2880 | 16983 | 705 | 235 | MJ1372 | 278 | 2.1(10)-24 | *Methanococcus jannaschii* | *methanococcus jannaschii* [ui:mj1372] [pn:conserved hypothetical protein:hypothetical protein] [gtcfc:14.1] [keggfc:14.2] [tigrfc:15.1] [db:gtc- |
| CONTIG3725 | 30174007_f3_3 | 2881 | 16984 | 198 | 66 | MJ1432 | 114 | 5.0(10)-7 | *Methanococcus jannaschii* | *methanococcus jannaschii* [ui:mj1432] [pn:conserved hypothetical protein:hypothetical |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4562 | 3914062_f2_2 | 2882 | 16985 | 978 | 326 | MJ1674 | 94 | 0.14999 | *Methanococcus jannaschii* | protein] [gtcfc:14.1] [keggfc:14.2] [tigrfc:15.1] [db:gtc-methanococcus jannaschii] [ui:mj1674] [pn:hypothetical protein:m] [gtcfc:14.1] [keggfc:14.21] [tigrfc:15.1] [db:gtc-methanococcus jannaschii] |
| CONTIG1865 | 32428125_f2_1 | 2883 | 16986 | 1296 | 432 | MJ1322 | 93 | 0.40999 | *Methanococcus jannaschii* | [ui:mj1322] [pn:purine ntpase:m] [gtcfc:14.3] [keggfc:14.2] [tigrfc:4.1] [db:gtc-methanococcus jannaschii] |
| b2x11334.y | 33234637_c3_3 | 2884 | 16987 | 564 | 188 | MJ1322 | 100 | 0.00038 | *Methanococcus jannaschii* | [ui:mj1322] [pn:purine ntpase:m] [gtcfc:14.3] [keggfc:14.2] [tigrfc:4.1] [db:gtc-methanococcus jannaschii] |
| CONTIG1904 | 36367206_f1_1 | 2885 | 16988 | 954 | 318 | R02_orf648 | 95 | 0.12 | *Mycoplasma pneumoniae* | [ui:r02_orf648] [pn:transketolase-1:transketolase:tk] [gn:tktb:tkt:tkta] [gtcfc:1.3:2.4] [ec:2.2.1.1] [keggfc:1.3:2.3] [zmbhfc:5.6] [db:gtc-mycoplasma pneumoniae] |
| CONTIG5546 | 3960933_c1_16 | 2886 | 16989 | 1281 | 427 | F11_orf479 | 122 | 0.00014 | *Mycoplasma pneumoniae* | [ui:f11_orf479] [pn:nadh oxidase:probable nadh oxidase:noxase] [gn:nox] [gtcfc:2.1] [ec:1.6.-.-] [keggfc:11.1] [zmbhfc:5.1] [db:gtc-mycoplasma pneumoniae] |
| CONTIG2582 | 31444037_f2_1 | 2887 | 16990 | 939 | 313 | P02_orf793 | 95 | 0.17 | *Mycoplasma pneumoniae* | [ui:p02_orf793] [pn:putative lipoprotein, mg260 homolog:hypothetical protein] [gtcfc:11.1] [keggfc:11.2] [zmbhfc:2.1] [db:gtc-[mycoplasma pneumoniae] |
| CONTIG5541 | 12595056_c2_18 | 2888 | 16991 | 648 | 216 | H08_orf1018 | 148 | 9.0(10)-9 | *Mycoplasma pneumoniae* | [ui:h08_orf1018] [pn:cytadherence accessory protein:cytadherence high molecular weight protein 1:cytadherence accessory protein 1] [gn:hmw1] [gtcfc:11.3] [keggfc:11.2] [zmbhfc:2.2] [db:gtc-mycoplasma pneumoniae] |
| CONTIG4543 | 36339188_f3_4 | 2889 | 16992 | 861 | 287 | D12_orf390o | 174 | 1.0(10)-12 | *Mycoplasma pneumoniae* | [ui:d12_orf390o] [pn:heat shock protein dnaj:protein] [gn:dnaj] [gtcfc:12.7] [keggfc:11.2] [zmbhfc:3.3] [db:gtc-mycoplasma pneumoniae] |
| CONTIG2428 | 14179051_f1_1 | 2890 | 16993 | 267 | 89 | G12_orf168 | 93 | 0.0001 | *Mycoplasma pneumoniae* | [ui:g12_orf168] [pn:hypothetical protein] [gtcfc:14.1] [keggfc:11.2] [zmbhfc:14.0] [db:gtc-mycoplasma pneumoniae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5039 | 30526503_c1_5 | 2891 | 16994 | 1122 | 374 | MTH1789 | 619 | 1.5(10)-60 | *Methanobacterium thermoautotrophicum* | [ui:mth1789] [pn:ddp-glucose 4,6-dehydratase] [gtcfc:1.54.3] [ec:4.2.1.46] [keggfc:1.5:4.3] [genomfc:1.5] [db:gtc-methanobacterium thermoautotrophicum] |
| CONTIG5202 | 20114002_f2_3 | 2892 | 16995 | 585 | 195 | MTH1582 | 195 | 1.3(10)-15 | *Methanobacterium thermoautotrophicum* | [ui:mth1582] [pn:carbonic anhydrase] [gtcfc:2.6] [ec:4.2.1.1] [keggfc:2.5] [genomfc:2.6] [db:gtc-methanobacterium thermoautotrophicum] |
| CONTIG4609 | 14850055_f3_8 | 2893 | 16996 | 354 | 118 | MTH1811 | 95 | 0.00022 | *Methanobacterium thermoautotrophicum* | [ui:mth1811] [pn:n-carbamoyl-d-amino acid amidohydrolase] [gtcfc:5.16:6.6] [ec:3.5.1.77] [keggfc:14.1] [genomfc:6.6] [db:gtc-methanobacterium thermoautotrophicum] |
| CONTIG4609 | 13863762_f3_9 | 2894 | 16997 | 588 | 196 | MTH1811 | 382 | 2.0(10)-35 | *Methanobacterium thermoautotrophicum* | [ui:mth1811] [pn:n-carbamoyl-d-amino acid amidohydrolase] [gtcfc:5.16:6.6] [ec:3.5.1.77] [keggfc:14.1] [genomfc:6.6] [db:gtc-methanobacterium thermoautotrophicum] |
| b2x16028.y | 2042153_c3_4 | 2895 | 16998 | 576 | 192 | MTH1811 | 289 | 1.3(10)-25 | *Methanobacterium thermoautotrophicum* | [ui:mth1811] [pn:n-carbamoyl-d-amino acid amidohydrolase] [gtcfc:5.16:6.6] [ec:3.5.1.77] [keggfc:14.1] [genomfc:6.6] [db:gtc-methanobacterium thermoautotrophicum] |
| CONTIG1619 | 13065655_f2_1 | 2896 | 16999 | 1215 | 405 | MTH1516 | 430 | 1.6(10)-39 | *Methanobacterium thermoautotrophicum* | [ui:mth1516] [pn:cation-transporting p-atpase pacl] [gtcfc:9.6:12.5] [ec:3.6.1.-] [keggfc:9.7] [genomfc:12.5] [db:gtc-methanobacterium thermoautotrophicum] |
| CONTIG5242 | 20725138_f1_3 | 2897 | 17000 | 1878 | 626 | MTH1893 | 174 | 1.3(10)-10 | *Methanobacterium thermoautotrophicum* | [ui:mth1893] [pn:cation efflux system protein:zinc/cadmium] [gtcfc:9.6:12.12] [ec:3.6.1.-] [keggfc:9.7] [genomfc:12.11] [db:gtc-methanobacterium thermoautotrophicum] |
| b9x13u44.y | 26600942_c1_3 | 2898 | 17001 | 315 | 105 | MTH72 | 92 | 0.00088 | *Methanobacterium thermoautotrophicum* | [ui:mth72] [pn:o-linked glcnac transferase] [gtcfc:10.2:14.1:14.2] [keggfc:14.2] [genomfc:10.2] [db:gtc-methanobacterium thermoautotrophicum] |
| CONTIG2169 | 1221001_c2_4 | 2899 | 17002 | 648 | 216 | MTH250 | 96 | 0.0032 | *Methanobacterium thermoautotrophicum* | [ui:mth250] [pn:trna intron endonuclease] [gtcfc:10.6:14.1:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1943 | 24328182_f3_2 | 2900 | 17003 | 588 | 196 | MTH535 | 367 | 7.7(10)-34 | *Methanobacterium thermoautotrophicum* | [keggfc:14.2] [genomfc:10.6] [db:gtc-*methanobacterium thermoautotrophicum*] [ui:mth535] [pn:peptide methionine sulfoxide reductase] [gtcfc:10.7:14.1:14.2] [keggfc:14.2] [genomfc:10.7] [db:gtc-*methanobacterium thermoautotrophicum*] |
| CONTIG3927 | 34431287_f3_3 | 2901 | 17004 | 1386 | 462 | MTH1633 | 154 | 2.5(10)-8 | *Methanobacterium thermoautotrophicum* | [ui:mth1633] [pn:dna repair protein rad2] [gtcfc:10.8:14.1:14.2] [keggfc:14.2] [genomfc:10.8] [db:gtc-*methanobacterium thermoautotrophicum*] |
| CONTIG3832 | 36331311_f1_1 | 2902 | 17005 | 477 | 159 | MTH1780 | 141 | 2.1(10)-9 | *Methanobacterium thermoautotrophicum* | [ui:mth1780] [pn:stomatin-like protein] [gtcfc:11.1:14.1:14.2] [keggfc:14.2] [genomfc:11.1] [db:gtc-*methanobacterium thermoautotrophicum*] |
| CONTIG1207 | 26853825_c1_4 | 2903 | 17006 | 852 | 284 | MTH104 | 1093 | 9.0(10)-111 | *Methanobacterium thermoautotrophicum* | [ui:mth104] [pn:multidrug transporter homolog] [gtcfc:12.12:14.1:14.2] [keggfc:14.2] [genomfc:12.11] [db:gtc-*methanobacterium thermoautotrophicum*] |
| CONTIG5273 | 14720037_c2_9 | 2904 | 17007 | 891 | 297 | MTH1666 | 889 | 3.7(10)-89 | *Methanobacterium thermoautotrophicum* | [ui:mth666] [pn:ethylene-inducible protein] [gtcfc:13.2:14.1:14.2] [keggfc:14.2] [genomfc:13.2] [db:gtc-*methanobacterium thermoautotrophicum*] |
| CONTIG5796 | 11844077_c3_22 | 2905 | 17008 | 1143 | 381 | MTH875 | 146 | 1.2(10)-10 | *Methanobacterium thermoautotrophicum* | [ui:mth875] [pn:3-chlorobenzoate-3,4-dioxygenase dyhydrogenase related protein] [gtcfc:14.1:14.3] [ec:1.1.1.18] [keggfc:14.1] [genomfc:13.7] [db:gtc-*methanobacterium thermoautotrophicum*] |
| CONTIG2686 | 195312_c1_7 | 2906 | 17009 | 762 | 254 | MTH1005 | 295 | 3.2(10)-26 | *Methanobacterium thermoautotrophicum* | [ui:mth1005] [pn:conserved protein] [gtcfc:14.1:14.2] [keggfc:14.2] [genomfc:14.2] [db:gtc-*methanobacterium thermoautotrophicum*] |
| b3x13349.y | 15023312_c3_5 | 2907 | 17010 | 747 | 249 | MTH1280 | 225 | 3.7(10)-18 | *Methanobacterium thermoautotrophicum* | [ui:mth1280] [pn:pet112-like protein] [gtcfc:14.1.14.2:14.3] [keggfc:14.2] [genomfc:13.7] [db:gtc-*methanobacterium thermoautotrophicum*] |
| CONTIG3655 | 24329683_c1_5 | 2908 | 17011 | 1185 | 395 | MTH1621 | 836 | 1.5(10)-83 | *Methanobacterium thermoautotrophicum* | [ui:mth1621] [pn:gtp-binding protein, gtp1/obg family] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3976 | 6765885_c2_6 | 2909 | 17012 | 477 | 159 | MTH232 | 220 | 2.8(10)-18 | Methanobacterium thermoautotrophicum | [gtcfc:14.1:14.2:14.3] [keggfc:14.2] [genomfc:13.7] db:gtc-methanobacterium thermoautotrophicum l [ui:mth232] [pn:conserved protein] [gtcfc:14.1:14.2] [keggfc:14.2] [genomfc:14.2] [db:gtc-methanobacterium thermoautotrophicum] |
| CONTIG1704 | 31330317_c1_4 | 2910 | 17013 | 396 | 132 | MTH649 | 108 | 2.1(10)-6 | Methanobacterium thermoautotrophicum | [ui:mth649] [pn:conserved protein] [gtcfc:14.1:14.2] [keggfc:14.2] [genomfc:14.2] [db:gtc-methanobacterium thermoautotrophicum] |
| CONTIG799 | 4317062_f1_2 | 2911 | 17014 | 300 | 100 | MTH649 | 123 | 5.5(10)-8 | Methanobacterium thermoautotrophicum | [ui:mth649] [pn:conserved protein] [gtcfc:14.1:14.2] [keggfc:14.2] [genomfc:14.2] [db:gtc-methanobacterium thermoautotrophicum] |
| CONTIG5567 | 19548176_f1_5 | 2912 | 17015 | 1050 | 350 | MTH682 | 238 | 3.6(10)-20 | Methanobacterium thermoautotrophicum | [ui:mth682] [pn:conserved protein] [gtcfc:14.1:14.2] [keggfc:14.2] [genomfc:14.2] [db:gtc-methanobacterium thermoautotrophicum] |
| CONTIG5455 | 17067162_f2_2 | 2913 | 17016 | 942 | 314 | YAL054C | 1159 | 9.0(10)-118 | Saccharomyces cerevisiae | [ui:yal054c] [pn:acetyl-coa synthetase:acetyl-coenzyme a synthetase 1:acetate--coa ligase 1:acyl-activating enzyme 1] [gn:acs1:fun44] [gtcfc:1.10:1.11.8:2.5:2.8:12.6] [ec:6.2.1.1] [keggfc:1.8:1.10:2.4] [sgdfc:1.5.1.9.7.0:9.8.0] [db:g |
| CONTIG5455 | 24486326_f3_5 | 2914 | 17017 | 210 | 70 | YAL054C | 211 | 3.2(10)-16 | Saccharomyces cerevisiae | [ui:yal054c] [pn:acetyl-coa synthetase:acetyl-coenzyme a synthetase 1:acetate--coa ligase 1:acyl-activating enzyme 1] [gn:acs1:fun44] [gtcfc:1.10:1.11.8:2.5:2.8:12.6] [ec:6.2.1.1] [keggfc:1.8:1.10:2.4] [sgdfc:1.5..9.7.0:9.8.0] [db:g |
| CONTIG252 | 24896037_c2_2 | 2915 | 17018 | 795 | 265 | YER073W | 597 | 3.2(10)-58 | Saccharomyces cerevisiae | [ui:yer073w] [pn:aldehyde dehydrogenase:nad+ aldehyde dehydrogenase, mitochondrial 3 precursor] [gn:ald3] [gtcfc:1.8:2.5.3:2.3.5:8.1] [ec:1.2.1.3] [keggfc:1.7:1.8:1.10:1.11:3.2:3.5: 5.6:5.9:5.10:5.11:5.12:5.14:6.1:8.1] [sgdfc:2.6.0:9.7 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3474 | 7035662_f1_1 | 2916 | 17019 | 1149 | 383 | YER073W | 1317 | 1.6(10)-134 | Saccharomyces cerevisiae | [ui:yer073w] [pn:aldehyde dehydrogenase:nad+ aldehyde dehydrogenase, mitochondrial 3 precursor] [gn:ald3] [gtcfc:1.8.2.5.3.2.3.5.8.1] [ec:1.2.1.3] [keggfc:1.7.1.8.1.10:1.11:3.2:3.5: 5.6:5.9:5.10:5.11:5.12:5.14:6.1:8.1] [sgdk:2.6.0:9.7 |
| b2x11307.x | 19688251_c2_1 | 2917 | 17020 | 201 | 67 | YER073W | 102 | 0.00011 | Saccharomyces cerevisiae | [ui:yer073w] [pn:aldehyde dehydrogenase:nad+ aldehyde dehydrogenase, mitochondrial 3 precursor] [gn:ald3] [gtcfc:1.8.2.5.3.2.3.5.8.1] [ec:1.2.1.3] [keggfc:1.7.1.8.1.10:1.11:3.2:3.5: 5.6:5.9:5.10:5.11:5.12:5.14:6.1:8.1] [sgdk:2.6.0:9.7 |
| CONTIG2610 | 11801563_c3_3 | 2918 | 17021 | 669 | 223 | YGR019W | 626 | 2.7(10)-61 | Saccharomyces cerevisiae | [ui:ygr019w] [pn:4-aminobutyrate aminotransferase:gamma-amino-n-butyrate transaminase:gaba aminotransferase] [gn:uga1] [gtcfc:1.10:1.11:2.6:2.7:5.1:5.2:6.1: 6.6:10.2] [ec:2.6.1.19] [keggfc:1.10:1.11:5.1:5.2:6.1] [sgdf |
| CONTIG3637 | 33628160_f3_5 | 2919 | 17022 | 1308 | 436 | YGR019W | 1419 | 2.6(10)-145 | Saccharomyces cerevisiae | [ui:ygr019w] [pn:4-aminobutyrate aminotransferase:gamma-amino-n-butyrate transaminase:gaba aminotransferase] [gn:uga1] [gtcfc:1.10:1.11:2.6:2.7:5.1:5.2:6.1: 6.6:10.2] [ec:2.6.1.19] [keggfc:1.10:1.11:5.1:5.2:6.1] [sgdf |
| CONTIG5510 | 34189425_f1_7 | 2920 | 17023 | 1008 | 336 | YGR019W | 657 | 1.3(10)-64 | Saccharomyces cerevisiae | [ui:ygr019w] [pn:4-aminobutyrate aminotransferase:gamma-amino-n-butyrate transaminase:gaba aminotransferase] [gn:uga1] [gtcfc:1.10:1.11:2.6:2.7:5.1:5.2:6.1: 6.6:10.2] [ec:2.6.1.19] [keggfc:1.10:1.11:5.1:5.2:6.1] [sgdf |
| CONTIG355 | 25392812_c3_4 | 2921 | 17024 | 273 | 91 | YGR244C | 249 | 6.5(10)-21 | Saccharomyces cerevisiae | [ui:ygr244c] [pn:strong similarity to rumen fungus beta-succinyl coa synthetase:probable succinyl-coa ligase:gdp-forming, beta-chain |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1081 | 2445338_c2_2 | 2922 | 17025 | 726 | 242 | YLR153C | 799 | 1.3(10)-79 | Saccharomyces | precursor:succinyl-coa synthetase, beta chain:scs-beta] [gtcfc:1.10:1.1:1.2] [ec:6.2.1.4] [keggfc:1.2 |
| CONTIG4927 | 24339162_f2_2 | 2923 | 17026 | 2046 | 682 | YLR153C | 2212 | 2.3(10)-229 | Saccharomyces cerevisiae | [ui:ylr153c] [pn:acetyl-coenzyme a cerevisiae synthetase:acetyl-coenzyme a synthetase 2:acetate--coa ligase 2:acyl-activating enzyme 2] [gn:acs2:j9634] [ec:6.2.1.1] [keggfc:1.8:1.10:2.4] [sgdfc:1.5.1] [db:gtc-saccharomyc [ui:ylr153c] [pn:acetyl-coenzyme a synthetase:acetyl-coenzyme a synthetase 2:acetate--coa ligase 2:acyl-activating enzyme 2] [gn:acs2:j9634] [ec:6.2.1.1] [keggfc:1.8:1.10:2.4] [sgdfc:1.5.1] [db:gtc-saccharomyc |
| CONTIG3915 | 3314002_c3_3 | 2924 | 17027 | 1326 | 442 | YNR016C | 1776 | 3.7(10)-183 | Saccharomyces cerevisiae | [ui:ynr016c] [pn:acetyl-coa carboxylase:acc:contains:biotin carboxylase] [gn:fas3:acc1:n3175] [gtcfc:1.10:1.8:3.1:3.4:8.1:8.2] [keggfc:1.8:1.10:3.1] [sgdfc:1.6:1.9.2.0] [db:gtc-saccharomyces cerevisiae] |
| CONTIG4685 | 24409557_f3_3 | 2925 | 17028 | 531 | 177 | YNR016C | 314 | 1.7(10)-26 | Saccharomyces cerevisiae | [ui:ynr016c] [pn:acetyl-coa carboxylase:acc:contains:biotin carboxylase] [gn:fas3:acc1:n3175] [gtcfc:1.10:1.8:3.1:3.4:8.1:8.2] [keggfc:1.8:1.10:3.1] [sgdfc:1.6:1.9.2.0] [db:gtc-saccharomyces cerevisiae] |
| CONTIG5087 | 34189752_f2_2 | 2926 | 17029 | 3069 | 1023 | YNR016C | 3168 | 0 | Saccharomyces cerevisiae | [ui:ynr016c] [pn:acetyl-coa carboxylase:acc:contains:biotin carboxylase] [gn:fas3:acc1:n3175] [gtcfc:1.10:1.8:3.1:3.4:8.1:8.2] [keggfc:1.8:1.10:3.1] [sgdfc:1.6:1.9.2.0] [db:gtc-saccharomyces cerevisiae] |
| CONTIG5557 | 21619200_c3_18 | 2927 | 17030 | 1833 | 611 | YNR016C | 2162 | 4.7(10)-224 | Saccharomyces cerevisiae | [ui:ynr016c] [pn:acetyl-coa carboxylase:acc:contains:biotin carboxylas] [gn:fas3:acc1:n3175] [gtcfc:1.10:1.8:3.1:3.4:8.1:8.2] [keggfc:1.8:1.10:3.1] [sgdfc:1.6:1.9.2.0] [db:gtc-saccharomyces cerevisiae] |
| CONTIG4347 | 2848338_f1_2 | 2928 | 17031 | 1284 | 428 | YOR142W | 769 | 1.8(10)-76 | Saccharomyces | [ui:yor142w] [pn:strong similarity |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | to succinate--coa ligase alpha subunit:probable succinyl-coa ligase:gdp-forming, alpha-chain precursor:succinyl-coa synthetase, alpha chain:scs-alpha] [gn:yor3352w] [gtcfc:1.10:1.2) [ec:6.2.1.4] [keg |
| CONTIG1267 | 9815702_f1_1 | 2929 | 17032 | 429 | 143 | YPL028W | 393 | 1.3(10)-36 | Saccharomyces cerevisiae | [ui:ypl028w] [pn:acetyl-coa c-acetyltransferase, cytosolic:acetyl-coa acetyltransferase:acetoacetyl-coa thiolase] [gn:erg10:lpb3] [gtcfc:1.10:1.11:1.8:3.1:3.2:3.3.3.4: 5.14:5.9.8.1.8.2] [ec:2.3.1.9] [keggfc:1.8:1.10:1.11:3.1:3.2:3.3.5. |
| b3x11289.y | 29376500_c2_2 | 2930 | 17033 | 378 | 126 | YPL028W | 300 | 9.6(10)-27 | Saccharomyces cerevisiae | [ui:ypl028w] [pn:acetyl-coa c-acetyltransferase, cytosolic:acetyl-coa acetyltransferase:acetoacetyl-coa thiolase] [gn:erg10:lpb3] [gtcfc:1.10:1.11:1.8:3.1:3.2:3.3.3.4: 5.14:5.9.8.1.8.2] [ec:2.3.1.9] [keggfc:1.8:1.10:1.11:3.1:3.2:3.3.5. |
| CONTIG1300 | 5125166_f1_1 | 2931 | 17034 | 1062 | 354 | YAL038W | 1395 | 8.9(10)-143 | Saccharomyces cerevisiae | [ui:yal038w] [pn:pyruvate kinase] [gn:pyk1:cdc19] [gtcfc:1.1.1.8:2.4] [ec:2.7.1.40] [keggfc:1.1.1.8:2.3] [sgdfc:1.5.1:2.1.0.9.2.0] [db:gtc-saccharomyces cerevisiae] |
| CONTIG2666 | 957500_c2_5 | 2932 | 17035 | 225 | 75 | YBR019C | 217 | 7.2(10)-17 | Saccharomyces cerevisiae | [ui:ybr019c] [pn:udp-glucose 4-epimerase:galactowaldenase/ aldose 1-epimerase:mutarotase] [gn:gal10:ybr0301] [gtcfc:1.1.1.6:4.3] [keggfc:1.1.1.6:4.3] [sgdfc:1.5.1:9.2.0] [db:gtc-saccharomyces cerevisiae] |
| CONTIG4753 | 15058513_f1_1 | 2933 | 17036 | 1833 | 611 | YBR019C | 1475 | 3.0(10)-151 | Saccharomyces cerevisiae | [ui:ybr019c] [pn:udp-glucose 4-epimerase:galactowaldenase/ aldose 1-epimerase:mutarotase] [gn:gal10:ybr0301] [gtcfc:1.1.1.6:4.3] [keggfc:1.1.1.6:4.3] [sgdfc:1.5.1:9.2.0] [db:gtc-saccharomyces cerevisiae] |
| CONTIG5365 | 21135176_f3_12 | 2934 | 17037 | 1635 | 545 | YBR196C | 2153 | 4.2(10)-223 | Saccharomyces cerevisiae | [ui:ybr196c] [pn:glucose-6-phosphate isomerase:gpi:phosphoglucose isomerase:pgi:phosphohexose isomerase:phil] [gn:pgi1:ybr1406] [gtcfc:1.1.1.3:7.2] [ec:5.3.1.9] [keggfc:1.1.1.3:7.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5785 | 1382806_c3_33 | 2935 | 17038 | 1164 | 388 | YBR221C | 1287 | 2.5(10)-131 | Saccharomyces cerevisiae | [sgdfc:1.5.1:2.1.0:2.2.0:9.2.0] [db:gtc-saccharomyces] [ui:ybr221c] [pn:pyruvate dehydrogenase:lipoamide beta chain precursor;pyruvate dehydrogenase e1 component, beta subunit precursor:pdhe1-b] [gn:pdb1:ybr151.1] [gtcfc:1.1.:1.11.1.8:2.8:5.7] [ec:1.2.4.1] |
| CONTIG2247 | 2386458_f2_2 | 2936 | 17039 | 693 | 231 | YCL040W | 523 | 2.2(10)-50 | Saccharomyces cerevisiae | [keggfc:1.1.1.8:1.11:5.7] [sgdfc:1 [ui:ycl040w] [pn:aldohexose specific glucokinase:glucokinase:glucose kinase:glk] [gn:glk1:hor3:ycl40w:ycl312] [gtcfc:1.1.1.3:1.5:1.6:7.2:12.2:12.6] [ec:2.7.1.2] [keggfc:1.1.1.3:1.5:1.6:7.1] [sgdfc:1.5.1:1.5.3:8.7.0:9.2.0] [db:gtc-sacc |
| CONTIG4802 | 162635_c1_8 | 2937 | 17040 | 1440 | 480 | YCL040W | 1059 | 3.6(10)-107 | Saccharomyces cerevisiae | [ui:ycl040w] [pn:aldohexose specific glucokinase:glucokinase:glucose kinase:glk] [gn:glk1:hor3:ycl40w:ycl312] [gtcfc:1.1.1.3:1.5:1.6:7.2:12.2:12.6] [ec:2.7.1.2] [keggfc:1.1.1.3:1.5:1.6:7.1] [sgdfc:1.5.1:1.5.3:8.7.0:9.2.0] [db:gtc-sacc |
| CONTIG5783 | 162635_f3_15 | 2938 | 17041 | 1440 | 480 | YCL040W | 1056 | 7.5(10)-107 | Saccharomyces cerevisiae | [ui:ycl040w] [pn:aldohexose specific glucokinase:glucokinase:glucose kinase:glk] [gn:glk1:hor3:ycl40w:ycl312] [gtcfc:1.1.1.3:1.5:1.6:7.2:12.2:12.6] [ec:2.7.1.2] [keggfc:1.1.1.3:1.5:1.6:7.1] [sgdfc:1.5.1:1.5.3:8.7.0:9.2.0] [db:gtc-sacc |
| CONTIG4104 | 2_c1_8 | 2939 | 17042 | 1434 | 478 | YCR012W | 1450 | 1.3(10)-148 | Saccharomyces cerevisiae | [ui:ycr012w] [pn:phosphoglycerate kinase] [gn:pgk1:ycr12w] [gtcfc:1.1:2.4] [ec:2.7.2.3] [keggfc:1.1:2.3] |
| CONTIG5310 | 4189443_c1_7 | 2940 | 17043 | 621 | 207 | YDL168W | 715 | 1.0(10)-70 | Saccharomyces cerevisiae | [sgdfc:1.5.1:2.1.0:2.2.0:9.2.0] [db:gtc-saccharomyces cerevisiae] [ui:ydl168w] [pn:long-chain alcohol dehydrogenase:glutathione- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1950 | 13828410_c3_3 | 2941 | 17044 | 408 | 136 | YDR050C | 393 | 1.3(10)-36 | Saccharomyces cerevisiae | dependent formaldehyde dehydrogenase:fdh:fald:alcohol dehydrogenase sfa] [gn:sfa1:sfa] [gtcfc:1.1:1.8:2.2:3.2:3.5:5.12:8.1:12.12] [keggfc:1.1:1.8:2.2:3.2:3.5:5.12:8.1:sg [ui:ydr050c] [pn:triose-phosphate isomerase:tim] [gn:tpi1:yd9609] [gtcfc:1.1:1.5:2.4:8.1] [ec:5.3.1.1] [keggfc:1.1:1.5:2:3.8.1] [sgdfc:1.5.1:2.1.0:2.2.0:9.2.0] [db:gtc-saccharomyces cerevisiae] |
| CONTIG2445 | 16146893_f1_1 | 2942 | 17045 | 231 | 77 | YDR050C | 270 | 1.5(10)-23 | Saccharomyces cerevisiae | [ui:ydr050c] [pn:triose-phosphate cerevisiae isomerase:triosephosphate isomerase:tim] [gn:tpi1:yd9609] [gtcfc:1.1:1.5:2.4:8.1] [ec:5.3.1.1] [keggfc:1.1:1.5:2:3.8.1] [sgdfc:1.5.1:2.1.0:2.2.0:9.2.0] [db:gtc-saccharomyces cerevisiae] |
| CONTIG5651 | 78258_f1_2 | 2943 | 17046 | 1260 | 420 | YER178W | 1514 | 2.2(10)-155 | Saccharomyces cerevisiae | [ui:yer178w] [pn:pyruvate dehydrogenase:lipoamide alpha chain precursor:pyruvate dehydrogenase e1 component, alpha subunit precursor:pdhe1-a] [gn:pda1] [gtcfc:1.1:1.11:1.8:2.8:5.7] [ec:1.2.4.1] [keggfc:1.1:1.8:1.11:5.7] [sgdfc:1.5.1.2] |
| CONTIG5801 | 1956302_c2_37 | 2944 | 17047 | 1518 | 506 | YFL018C | 1527 | 9.1(10)-157 | Saccharomyces cerevisiae | [ui:yfl018c] [pn:dihydrolipoamide dehydrogenase precursor] [gn:lpd1:dhlp1] [gtcfc:1.1:1.21.8:2.8:5.3:6.6] [ec:1.8.1.4] [keggfc:1.1:1.21.8.5.3] [sgdfc:1.1.1:2.4.0:9.7.0][db:gtc-saccharomyces cerevisiae] |
| CONTIG4065 | 29774166_f2_2 | 2945 | 17048 | 1371 | 457 | YFR053C | 230 | 1.6(10)-16 | Saccharomyces cerevisiae | [ui:yfr053c] [pn:hexokinase i:hexokinase a:hexokinase pi] [gn:hxk1:hka] [gtcfc:1.1:1.5:1.6:7.1:7.2] [ec:2.7.1.1] [keggfc:1.1:1.5:1.6:4.4:7.1] [sgdfc:1.5.1:2.1.0:9.2.0] [db:gtc-saccharomyces cerevisiae] |
| CONTIG5810 | 3907775_c1_25 | 2946 | 17049 | 1476 | 492 | YGL253W | 1631 | 8.6(10)-168 | Saccharomyces cerevisiae | [ui:ygl253w] [pn:hexokinase ii:hexokinase b:hexokinase pii] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5145 | 29321963_c2_9 | 2947 | 17050 | 954 | 318 | YGR192C | 1094 | 7.0(10)-111 | Saccharomyces cerevisiae | [gn:hxk2:hkb:hex1:nrb486] [gtcfc:1.1.1.5:1.6:7.1:7.2:12.13] [ec:2.7.1.1] [keggfc:1.1:1.5:1.6:4.4:7.1] [sgdfc:1.5.1:1.5.2:2.1.0:9.2.0] [db:gtc-saccharomyces cerevisiae] [ui:ygr192c] [pn:glyceraldehyde-3-phosphate dehydrogenase 3:glyceraldehyde 3-phosphate dehydrogenase 3] [gn:tdh3:gpd3:g75760] [gtcfc:1.1.6.14:6.8] [ec:1.2.1.12] [keggfc:1.1:6.7] [sgdfc:1.5.1:2.1.0:9.2.0] [db:gtc-saccharomyces cerevisia] |
| CONTIG5528 | 24484691_c1_12 | 2948 | 17051 | 1023 | 341 | YGR240C | 400 | 3.2(10)-36 | Saccharomyces cerevisiae | [ui:ygr240c] [pn:6-phosphofructokinase, alpha subunit:6-phosphofructokinase alpha subunit:phosphofructokinase 1:phosphohexokinase] [gn:pfk1:g8599] [gtcfc:1.1.1.3:1.5.1.6:12.13] [ec:2.7.1.11] [keggfc:1.1.1.3:1.5.1.6] [sgdfc:1.5.1:1.5.2] |
| b9x12c78.x | 10646902_c3_5 | 2949 | 17052 | 711 | 237 | YGR240C | 604 | 3.0(10)-58 | Saccharomyces cerevisiae | [ui:ygr240c] [pn:6-phosphofructokinase, alpha subunit:6-phosphofructokinase alpha subunit:phosphofructokinase 1:phosphohexokinase] [gn:pfk1:g8599] [gtcfc:1.1.1.3:1.5.1.6:12.13] [ec:2.7.1.11] [keggfc:1.1.1.3:1.5.1.6] [sgdfc:1.5.1:1.5.2] |
| CONTIG3948 | 4105275_f2_2 | 2950 | 17053 | 903 | 301 | YGR254W | 1069 | 3.1(10)-108 | Saccharomyces cerevisiae | [ui:ygr254w] [pn:enolase i:enolase 1:2-phosphoglycerate dehydratase:2-phospho-d-glycerate hydro-lyase] [gn:eno1:enoa:hsp48:g9160] [gtcfc:1.1] [ec:4.2.1.11] [keggfc:1.1] [sgdfc:1.5.1:2.1.0:9.2.0] [db:gtc-saccharomyces cerevisiae] |
| CONTIG2892 | 9812809_c2_4 | 2951 | 17054 | 447 | 149 | YGR254W | 601 | 1.2(10)-58 | Saccharomyces cerevisiae | [ui:ygr254w] [pn:enolase i:enolase 1:2-phosphoglycerate dehydratase:2-phospho-d-glycerate hydro-lyase] [gn:eno1:enoa:hsp48:g9160] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5145 | 16835300_c1_8 | 2952 | 17055 | 255 | 85 | YJR009C | 310 | 8.4(10)-28 | Saccharomyces cerevisiae | [gtcfc:1.1] [ec:4.2.1.11] [keggfc:1.1] [sgdfc:1.5.1:2.1.0:9.2.0] [db:gtc-saccharomyces cerevisiae] [ui:yjr009c] [pn:glyceraldehyde-3-phosphate dehydrogenase 2 glyceraldehyde 3-phosphate dehydrogenase 2] [gn:tdh2:gpd2:j1433] [gtcfc:1.1:6.14:6.8] [ec:1.2.1.12] [keggfc:1.1:6.7] [sgdfc:1.5.1:2.1.0:9.2.0] [db:gtc-saccharomyces cerevisia] |
| CONTIG1975 | 4801385_c2_7 | 2953 | 17056 | 414 | 138 | YKL152C | 525 | 1.3(10)-50 | Saccharomyces cerevisiae | [ui:ykl152c] [pn:phosphoglycerate mutase:phosphoglyceromutase:pgam:mpgm:bpg-dependent pgam] [gn:gpm1:gpm:ykl607] [gtcfc:1.1] [ec:5.4.2.1] [keggfc:1.1] [sgdfc:1.5.1:2.1.0:9.2.0] [db:gtc-saccharomyces cerevisiae] |
| CONTIG2345 | 1284500_f2_1 | 2954 | 17057 | 372 | 124 | YKL152C | 412 | 1.3(10)-38 | Saccharomyces cerevisiae | [ui:ykl152c] [pn:phosphoglycerate mutase:phosphoglyceromutase:pgam:mpgm:bpg-dependent pgam] [gn:gpm1:gpm:ykl607] [gtcfc:1.1] [ec:5.4.2.1] [keggfc:1.1] [sgdfc:1.5.1:2.1.0:9.2.0] [db:gtc-saccharomyces cerevisiae] |
| CONTIG4584 | 21640652_f2_2 | 2955 | 17058 | 807 | 269 | YKL152C | 585 | 6.0(10)-57 | Saccharomyces cerevisiae | [ui:ykl152c] [pn:phosphoglycerate mutase:phosphoglyceromutase:pgam:mpgm:bpg-dependent pgam] [gn:gpm1:gpm:ykl607] [gtcfc:1.1] [ec:5.4.2.1] [keggfc:1.1] [sgdfc:1.5.1:2.1.0:9.2.0] [db:gtc-saccharomyces cerevisiae] |
| CONTIG3611 | 4094055_c2_7 | 2956 | 17059 | 1101 | 367 | YKL060C | 1339 | 7.7(10)-137 | Saccharomyces cerevisiae | [ui:ykl060c] [pn:fructose-bisphosphate aldolase] [gn:fba1:ykl320] [gtcfc:1.1.1.3:1.5.2.4] [ec:4.1.2.13] [keggfc:1.1.3:1.5:2.3] [sgdfc:1.5.1:2.1.0:9.2.0] [db:gtc-saccharomyces cerevisiae] |
| CONTIG2376 | 10829012_f1_1 | 2957 | 17060 | 1323 | 441 | YLR044C | 865 | 2.1(10)-113 | Saccharomyces cerevisiae | [ui:ylr044c] [pn:pyruvate decarboxylase, isozyme 1:pyruvate decarboxylase isozyme 1] [gn:pdc1] [gtcfc:1.1.2.2:2.8] [ec:4.1.1.1] [keggfc:1.1] [sgdfc:1.5.1:2.5.0:2.6.0:9.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5280 | 2932825_c2_14 | 2958 | 17061 | 960 | 320 | YLR044C | 1083 | 1.0(10)-109 | *Saccharomyces cerevisiae* | [ui:ylr044c] [pn:pyruvate decarboxylase, isozyme 1:pyruvate decarboxylase isozyme 1] [gn:pdc1] [gtcfc:1.1:2.2:2.8] [ec:4.1.1.1] [keggfc:1.1] [sgdfc:1.5.1:2.5.0:2.6.0:9.2.0] [db:gtc-*saccharomyces cerevisiae*] |
| CONTIG5280 | 4866287_c1_11 | 2959 | 17062 | 777 | 259 | YLR044C | 893 | 1.3(10)-89 | *Saccharomyces cerevisiae* | [ui:ylr044c] [pn:pyruvate decarboxylase, isozyme 1:pyruvate decarboxylase isozyme 1] [gn:pdc1] [gtcfc:1.1:2.2:2.8] [ec:4.1.1.1] [keggfc:1.1] [sgdfc:1.5.1 :2.5.0:2.6.0:9.2.0] [db:gtc-*saccharomyces cerevisiae*] |
| b2x18774.y | 9788376_f2_2 | 2960 | 17063 | 234 | 78 | YLR044C | 210 | 2.7(10)-16 | *Saccharomyces cerevisiae* | [ui:ylr044c] [pn:pyruvate decarboxylase, isozyme 1:pyruvate decarboxylase isozyme 1] [gn:pdc1] [gtcfc:1.1:2.2:2.8] [ec:4.1.1.1] [keggfc:1.1] [sgdfc:1.5.1:2.5.0:2.6.0:9.2.0] [db:gtc-*saccharomyces cerevisiae*] |
| CONTIG5432 | 14547013_c2_22 | 2961 | 17064 | 711 | 237 | YLR377C | 740 | 2.2(10)-73 | *Saccharomyces cerevisiae* | [ui:ylr377c] [pn:fructose-1,6-bisphosphatase:d-fructose-1,6-bisphosphate 1-phosphohydrolase:fbpase] [gn:fbp1:l8039] [gtcfc:1.1:1.3:1.5:2.4] [ec:3.1.3.11] [keggfc:1.1:1.3:1.5:2.3] [sgdfc:1.5.1:2.2.0:9.2.0] [db:gtc-*saccharomyces cerevi*] |
| CONTIG2467 | 24307150_c1_3 | 2962 | 17065 | 942 | 314 | YMR083W | 1139 | 1.2(10)-115 | *Saccharomyces cerevisiae* | [ui:ymr083w] [pn:alcohol dehydrogenase iii:alcohol dehydrogenase iii precursor] [gn:adh3:ym9582] [gtcfc:1.1.2.8:3.2:3.5.5.12:8.1] [ec:1.1.1.1] [keggfc:1.1.3.2:3.5.5.12:8.1] [sgdfc:1.5.1:9.7.0] [db:gtc-*saccharomyces cerevisiae*] |
| CONTIG5698 | 14220276_f2_14 | 2963 | 17066 | 1059 | 353 | YMR083 | 1207 | 7.4(10)-123 | *Saccharomyces cerevisiae* | [ui:ymr083w] [pn:alcohol dehydrogenase iii:alcohol dehydrogenase iii precursor] [gn:adh3:ym9582] [gtcfc:1.1.2.8:3.2:3.5.5.12:8.1] [ec:1.1.1.1] [keggfc:1.1.3.2:3.5.5.12:8.1] [sgdfc:1.5.1:9.7.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5021 | 1175126_f2_3 | 2964 | 17067 | 1308 | 436 | YMR105C | 1585 | 6.5(10)-163 | Saccharomyces cerevisiae | [ui:ym105c] [pn:phosphoglucomutase, major isoform:phosphoglucomutase 2:glucose phosphomutase 2:pgm 2] [gn:pgm2:gal5:ym9718] [gtcfc:1.1:6:7.1:7.2] [ec:5.4.2.2] [keggfc:1.1.1.6:7.1] [sgdfc:1.5.1:2.7.0:9.2.0] [db:gtc-saccharomyces cer |
| CONTIG5021 | 24298762_f1_1 | 2965 | 17068 | 447 | 149 | YMR105C | 318 | 4.9(10)-28 | Saccharomyces cerevisiae | [ui:ym105c] [pn:phosphoglucomutase, major isoform:phosphoglucomutase 2:glucose phosphomutase 2:pgm 2] [gn:pgm2:gal5:ym9718] [gtcfc:1.1:6:7.1:7.2] [ec:5.4.2.2] [keggfc:1.1.1.6:7.1] [sgdfc:1.5.1:2.7.0:9.2.0] [db:gtc-saccharomyces cer |
| CONTIG5634 | 22379531_c3_27 | 2966 | 17069 | 297 | 99 | YMR205C | 117 | 5.7(10)-6 | Saccharomyces cerevisiae | [ui:ymr205c] [pn:6-phosphofructokinase, beta subunit:6-phosphofructokinase beta subunit:phosphofructokinase 1:phosphohexokinase] [gn:pfk2:ym8325] [gtcfc:1.1:1.3:1.5:1.6:12.13] [ec:2.7.1.11] [keggfc:1.1:1.3:1.5:1.6] [sgdfc:1.5.1:1.5.2: |
| CONTIG5634 | 6834712_c2_24 | 2967 | 17070 | 1632 | 544 | YMR205C | 1854 | 2.0(10)-191 | Saccharomyces cerevisiae | [ui:ymr205c] [pn:6-phosphofructokinase, beta subunit:6-phosphofructokinase beta subunit:phosphofructokinase 1:phosphohexokinase] [gn:pfk2:ym8325] [gtcfc:1.1:1.3:1.5:1.6:12.13] [ec:2.7.1.11] [keggfc:1.1:1.3:1.5:1.6] [sgdfc:1.5.1:1.5.2: |
| CONTIG5634 | 4892193_c1_15 | 2968 | 17071 | 300 | 100 | YMR205C | 341 | 6.5(10)-30 | Saccharomyces cerevisiae | [ui:ymr205c] [pn:6-phosphofructokinase, beta subunit:6-phosphofructokinase beta subunit:phosphofructokinase 1:phosphohexokinase] [gn:pfk2:ym8325] [gtcfc:1.1:1.3:1.5:1.6:12.13] [ec:2.7.1.11] [keggfc:1.1:1.3:1.5:1.6] [sgdfc:1.5.1:1.5.2: |
| CONIG5634 | 14570316_c2_23 | 2969 | 17072 | 816 | 272 | YMR205C | 309 | 1.7(10)-26 | Saccharomyces | [ui:ymr205c] [pn:6- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | phosphofructokinase, beta subunit:6-phosphofructokinase beta subunit:phosphofructokinase 1phosphohexokinase [gn:ptk2:ym8325] [gtcfc:1.1:1.3:1.5:1.6:12.13] [ec:2.7.1.11] [keggfc:1.1:1.3:1.5:1.6] [sgdfc:1.5.1:1.5.2:] |
| b3x15367.x | 20525058_c3_2 | 2970 | 17073 | 396 | 132 | YMR303C | 121 | 4.9(10)-7 | Saccharomyces cerevisiae | [ui:ym303c] [pn:alcohol dehydrogenase ii] [gn:adh2:adf2:ym9952] [gtcfc:1.1:2.3:2.3:5.5.12:8.1] [ec:1.1.1.1] [keggfc:1.1.3.2:3.5.5.12:8.1] [sgdfc:1.5.1:2.6.0:9.2.0] [db:gtc-saccharomyces cerevisiae] |
| CONTIG4969 | 10975252_f2_3 | 2971 | 17074 | 528 | 176 | YNL071W | 361 | 3.2(10)-33 | Saccharomyces cerevisiae | [ui:ynl071w] [pn:dihydrolipoamides acetyltransferase:dihydrolipoamide acetyltransferase component:e2 of pyruvate dehydrogenase complex precursor:pdc-e2] [gn:pda:lat1:n2374] [gtcfc:1.1:1.8:2.8] [ec:2.3.1.12] [keggfc:1.1:1.8] [sgdfc:1] |
| CONTIG4969 | 24665786_f3_5 | 2972 | 17075 | 1215 | 405 | YNL071W | 701 | 3.1(10)-69 | Saccharomyces cerevisiae | [ui:ynl071w] [pn:dihydrolipoamides acetyltransferase:dihydrolipoamide acetyltransferase component:e2 of pyruvate dehydrogenase complex precursor:pdc-e2] [gn:pda2:lat1:n2374] [gtcfc:1.1:1.8:2.8] [ec:2.3.1.12] [keggfc:1.1:1.8] [sgdfc:1] |
| CONTIG4567 | 36000_c3_8 | 2973 | 17076 | 669 | 223 | YGR193C | 314 | 3.2(10)-28 | Saccharomyces cerevisiae | [ui:ygr193c] [pn:pyruvate dehydrogenase complex protein x:pyruvate dehydrogenase protein x component precursor] [gn:pdx1:g75797] [gtcfc:1.1:2.8] [keggfc:14.2] [sgdfc:1.5.1:2.1.0:9.7.0] [db:gtc-saccharomyces cerevisiae] |
| CONTIG4920 | 35344675_f2_3 | 2974 | 17077 | 1143 | 381 | YIL107C | 309 | 1.3(10)-26 | Saccharomyces cerevisiae | [ui:yil107c] [pn:6-phosphofructose-2-kinase, isozyme 1:6-phosphofructo-2-kinase:phosphofructokinase 2] [gn:pfk26] [gtcfc:1.1:1.5:12.13] [ec:2.7.1.105] [keggfc:1.5] [sgdfc:1.5.1:1.5.2:2.1.0:9.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5066 | 20319181_c3_18 | 2975 | 17078 | 1365 | 455 | YIL107C | 810 | 8.6(10)-81 | *Saccharomyces cerevisiae* | [ui:yil107c] [pn:6-phosphofructose-2-kinase, isozyme 1:6-phosphofructo-2-kinase:phosphofructokinase 2] [gn:pfk26] [gtcfc:1.1.1.5:12.13] [ec:2.7.1.105] [keggfc:1.5] [sgdfc:1.5.1.1.5.2.2.1.0.9.2.0] [db:gtc-*saccharomyces cerevisiae*] |
| CONTIG5066 | 30273463_c2_17 | 2976 | 17079 | 183 | 61 | YIL107C | 165 | 3.5(10)-11 | *Saccharomyces cerevisiae* | [ui:yil107c] [pn:6-phosphofructose-2-kinase, isozyme 1:6-phosphofructo-2-kinase:phosphofructokinase 2] [gn:pfk26] [gtcfc:1.1.1.5:12.13] [ec:2.7.1.105] [keggfc:1.5] [sgdfc:1.5.1.1.5.2.2.1.0.9.2.0] [db:gtc-*saccharomyces cerevisiae*] |
| CONTIG5066 | 14553952_c1_12 | 2977 | 17080 | 1986 | 662 | YIL107C | 261 | 2.2(10)-19 | *Saccharomyces cerevisiae* | [ui:yil107c] [pn:6-phosphofructose-2-kinase, isozyme 1:6-phosphofructo-2-kinase:phosphofructokinase 2] [gn:pfk26] [gtcfc:1.1.1.5:12.13] [ec:2.7.1.105] [keggfc:1.5] [sgdfc:1.5.1.1.5.2.2.1.0.9.2.0] [db:gtc-*saccharomyces cerevisiae*] |
| CONTIG3176 | 893802_f3_2 | 2978 | 17081 | 279 | 93 | YKL029C | 115 | 6.0(10)-6 | *Saccharomyces cerevisiae* | [ui:ykl029c] [pn:strong similarity to s. pombe malate oxidoreductase:probable malate oxidoreductase:nad malic enzyme:me] [gtcfc:1.1:1.8] [ec:1.1.1.38] [keggfc:1.8] [sgdfc:1.5.1:2.1.0] [db:gtc-*saccharomyces cerevisiae*] |
| CONTIG3176 | 20444443_f3_3 | 2979 | 17082 | 855 | 285 | YKL029C | 1096 | 4.2(10)-111 | *Saccharomyces cerevisiae* | [ui:ykl029c] [pn:strong similarity tos. *pombe* malate oxireductase:probable malate oxidoreductase:nad malic enzyme:me] [gtcfc:1.1:1.8] [ec:1.1.1.38] [keggfc:1.8] [sgdfc:1.5.1:2.1.0] [db:gtc-*saccharomyces cerevisiae*] |
| CONTIG5433 | 172156_f1_1 | 2980 | 17083 | 801 | 267 | YKL029C | 875 | 1.1(10)-87 | *Saccharomyces cerevisiae* | [ui:ykl029c] [pn:strong similarity tos. *pombe* malate oxireductase:probable malate oxidoreductase:nad malic enzyme:me] [gtcfc:1.1:1.8] [ec:1.1.1.38] [keggfc:1.8] [sgdfc:1.5.1:2.1.0] [db:gtc-*saccharomyces cerevisiae*] |
| CONTIG147 | 32553308_f2_1 | 2981 | 17084 | 285 | 95 | YKR043C | 125 | 3.7(10)-12 | *Saccharomyces* | [ui:ykr043c] [pn:weak similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | phosphoglycerate mutase:hypothetical 31.0 kd protein in gap1-nap1 intergenic region] [gtcfc:1.1] [keggfc:14.2] [sgdfc:1.5.1:2.1.0] [db-gtc-saccharomyces cerevisiae] |
| CONTIG495 | 4410010_f1_1 | 2982 | 17085 | 474 | 158 | YKR043C | 323 | 3.5(10)-29 | Saccharomyces cerevisiae | [ui:ykr043c] [pn:weak similarity to phosphoglycerate mutase:hypothetical 31.0 kd protein in gap1-nap1 intergenic region] [gtcfc:1.1] [keggfc:14.2] [sgdfc:1.5.1:2.1.0] [db-gtc-saccharomyces cerevisiae] |
| CONTIG5808 | 14531880_c1_22 | 2983 | 17086 | 831 | 277 | YKR043C | 455 | 1.0(10)-57 | Saccharomyces cerevisiae | [ui:ykr043c] [pn:weak similarity to phosphoglycerate mutase:hypothetical 31.0 kd protein in gap1-nap1 intergenic region] [gtcfc:1.1] [keggfc:14.2] [sgdfc:1.5.1:2.1.0] [db-gtc-saccharomyces cerevisiae] |
| CONTIG3889 | 25681252_c3_10 | 2984 | 17087 | 738 | 246 | YLR345W | 530 | 4.0(10)-51 | Saccharomyces cerevisiae | [ui:ylr345w] [pn:similarity to pfk26p and other 6-phosphofructo-2-kinases] [gtcfc:1.1.12.13] [keggfc:14.2] [sgdfc:1.5.2:2.1.0] [db-gtc-saccharomyces cerevisiae] |
| CONTIG3889 | 10750702_c1_7 | 2985 | 17088 | 861 | 287 | YLR345W | 376 | 8.5(10)-35 | Saccharomyces cerevisiae | [ui:ylr345w] [pn:similarity to pfk26p and other 6-phosphofructo-2-kinases] [gtcfc:1.1.12.13] [keggfc:14.2] [sgdfc:1.5.2:2.1.0] [db-gtc-saccharomyces cerevisiae] |
| CONTIG5226 | 26289018_f2_4 | 2986 | 17089 | 2454 | 818 | YMR125W | 840 | 5.7(10)-84 | Saccharomyces cerevisiae | [ui:ymr125w] [pn:transcription factor for glycolytic genes:gcr3 protein:sto1 protein:sut1 protein] [gn:gcr3:sto1:sut1:ym8564] [gtcfc:1.1:10.2] [keggfc:14.2] [sgdfc:1.5.2:2.1.9:9.5.0] [db-gtc-saccharomyces cerevisiae] |
| CONTIG4859 | 14882635_f1_1 | 2987 | 17090 | 675 | 225 | YOR283W | 433 | 7.7(10)-41 | Saccharomyces cerevisiae | [ui:yor283w] [pn:weak similarity to phosphoglycerate mutases] [gtcfc:1.1] [keggfc:14.2] [sgdfc:1.5.1:2.1.0] [db-gtc-saccharomyces cerevisiae] |
| CONTIG532 | 24650192_f3_1 | 2988 | 17091 | 666 | 222 | YBR218C | 845 | 1.7(10)-84 | Saccharomyces cerevisiae | [ui:ybr218c] [pn:pyruvate carboxylase 2:pyruvic carboxylase 2:pcb 2] [gn:pyc2:ybr1507] [gtcfc:1.1:1.2:1.8.5.2] [ec:6.4.1.1] [keggfc:1.2:1.8.5.2] [sgdfc:1.5.1:2.2.0:9.2.0] [db-gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1968 | 34409567_c3_4 | 2989 | 17092 | 501 | 167 | YER065C | 637 | 1.8(10)-62 | *Saccharomyces cerevisiae* | [ui:yer065c] [pn:isocitrate lyase:isocitrataseicl] [gn:icl1] [gtcfc:1.1.1.81:9:12.6] [ec4.1.3.1] [keggfc:1.9] [sgdfc:1.5.1:2.2.0:2.8.0:9.8.0] [db:gtc-*saccharomyces cerevisiae*] |
| CONTIG4616 | 34566587_c3_9 | 2990 | 17093 | 1074 | 358 | YER065C | 1126 | 2.8(10)-114 | *Saccharomyces cerevisiae* | [ui:yer065c] [pn:isocitrate lyase:isocitrataseicl] [gn:icl1] [gtcfc:1.1.1.81:9:12.6] [ec4.1.3.1] [keggfc:1.9] [sgdfc:1.5.1:2.2.0:2.8.0:9.8.0] [db:gtc-*saccharomyces cerevisiae*] |
| CONTIG2543 | 4085906_c3_5 | 2991 | 17094 | 1428 | 476 | YGL062W | 1795 | 3.7(10)-185 | *Saccharomyces cerevisiae* | [ui:ygl062w] [pn:pyruvate carboxylase 1:pyruvic carboxylase 1:pcb1] [gn:pyc1:pyv] [gtcfc:1.1.1.2:1.8:5.2] [ec:6.4.1.1] [keggfc:1.2:1.8:5.2] [sgdfc:1.5.1:2.2.0:9.2.0] [db:gtc-*saccharomyces cerevisiae*] |
| CONTIG1319 | 16411385_f1_1 | 2992 | 17095 | 351 | 117 | YIL167W | 126 | 3.1(10)-8 | *Saccharomyces cerevisiae* | [ui:yil167w] [pn:serine dehydratase:putative 1-serine dehydratase c-terminal section] [gn:sdl1] [gtcfc:1.1.5.3:5.5] [ec:4.2.1.13] [keggfc:5.3:5.5] [sgdfc:1.1.4:2.2.0:9.2.0] [db:gtc-*saccharomyces cerevisiae*] |
| CONTIG5766 | 4335050_c1_22 | 2993 | 17096 | 1671 | 557 | YKR097W | 2129 | 1.5(10)-220 | *Saccharomyces cerevisiae* | [ui:ykr097w] [pn:phosphoenolpyruvate carboxykinase:atp] [gn:pck1:ppc1:pepc] [gtcfc:1.1.1.2:1.8:2.4] [ec:4.1.1.49] [keggfc:1.2:1.8:2.3] [sgdfc:1.5.1:2.2.0:9.2.0] [db:gtc-*saccharomyces cerevisiae*] |
| CONTIG169 | 10833262_f3_2 | 2994 | 17097 | 738 | 246 | YMR280C | 152 | 1.7(10)-9 | *Saccharomyces cerevisiae* | [ui:ymr280c] [pn:transcription factor involved in gluconeogenesis:regulatory protein cat8] [gn:cat8:msp8:ym8021] [gtcfc:1.1:10.2] [keggfc:14.2] [sgdfc:1.5.2:2.2.0:4.8.2:9.5.0] [db:gtc-*saccharomyces cerevisiae*] |
| CONTIG2265 | 182030_f3_2 | 2995 | 17098 | 1377 | 459 | YMR280C | 159 | 7.2(10)-12 | *Saccharomyces cerevisiae* | [ui:ymr280c] [pn:transcription factor involved in gluconeogenesis:regulatory protein cat8] [gn:cat8:msp8:ym8021] [gtcfc:1.1:10.2] [keggfc:14.2] [sgdfc:1.5.2:2.2.0:4.8.2:9.5.0] [db:gtc-*saccharomyces cerevisiae*] |
| CONTIG3354 | 4398317_c3_9 | 2996 | 17099 | 1008 | 336 | YMR280C | 171 | 1.3(10)-9 | *Saccharomyces cerevisiae* | [db:gtc-*saccharomyces cerevisiae*] [ui:ymr280c] [pn:transcription |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | factor involved in gluconeogenesis:regulatory protein cat8] [gn:cat8:mspt8:ym8021] [gtcfc:1.1:10.2] [keggfc:14.2] [sgdfc:1.5.2:2.2.0:4.8.2:9.5.0] db:gtc-saccharomyces cerevisiae |
| CONTIG5285 | 2812758_c1_9 | 2997 | 17100 | 975 | 325 | YAL061W | 598 | 2.5(10)-58 | Saccharomyces cerevisiae | [ui:yal061w] [pn:similarity to alcohol/sorbitol dehydrogenase:hypothetical zinc-type alcohol dehydrogenase-like protein in gdh3-cne1 intergenic region] [gn:fun50] [gtcfc:1.1:2.2] [keggfc:14.2] [sgdfc:1.5.1:2.6.0] [db:gtc-saccharomyces |
| CONTIG4523 | 10048408_f3_2 | 2998 | 17101 | 849 | 283 | YAL060W | 551 | 2.3(10)-53 | Saccharomyces cerevisiae | [ui:yal060w] [pn:similarity to alcohol/sorbitol dehydrogenase:hypothetical zinc-type alcohol dehydrogenase-like protein in gdh3-cne1 intergenic region] [gn:fun49] [gtcfc:1.1:2.2] [keggfc:14.2] [sgdfc:1.5.1:2.6.0] [db:gtc-saccharomyces |
| CONTIG5145 | 24492160_c2_10 | 2999 | 17102 | 2109 | 703 | YAL023C | 2237 | 5.2(10)-232 | Saccharomyces cerevisiae | [ui:yal023c] [pn:mannosyltransferase:dolichyl-phosphate-mannose--protein mannosyltransferase 2] [gn:pmt2:ftun25] [gtcfc:1.1:7.1:10.7:11.3:12.16] [ec:2.4.1.109] [keggfc:7.2] [sgdfc:1.5.1:6.3.0:9.4.0] [db:gtc-saccharomyces cerevisiae] |
| CONTIG4677 | 4484501_c2_8 | 3000 | 17103 | 843 | 281 | YBL082C | 380 | 3.2(10)-35 | Saccharomyces cerevisiae | [ui:ybl082c] [pn:mannosyltransferase:hm-1 killer toxin resistance protein] [gn:rhk1:alg3:ybl0720] [gtcfc:1.1:10.7:12.16] [keggfc:14.2] [sgdfc:1.5.1:6.3.0:9.4.0] [db:gtc-saccharomyces cerevisiae] |
| CONTIG755 | 12673375_c2_2 | 3001 | 17104 | 771 | 257 | YBL082C | 198 | 6.7(10)-24 | Saccharomyces cerevisiae | [ui:ybl082c] [pn:mannosyltransferase:hm-1 killer toxin resistance protein] [gn:rhk1:alg3:ybl0720] [gtcfc:1.1:10.7:12.16] [keggfc:14.2] |
| CONTIG5425 | 23939752_f3_6 | 3002 | 17105 | 294 | 98 | YBL001C | 280 | 1.3(10)-24 | Saccharomyces cerevisiae | [ui:ybl001c] [pn:strong similarity tos. xylosusglucose |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4877 | 12277313_c2_3 | 3003 | 17106 | 540 | 180 | YBR018C | 505 | 1.8(10)-48 | Saccharomyces cerevisiae | kinase:hypothetical 1.5 kd protein in htb2-nth2 intergenic region] [gn:yb10105] [sgdfc:1.5.1] [dbgtc-keggfc:14.2] [gtcfc:1.1] [ui:ybr018c] [pn:udp-glucose--hexose-1-phosphate uridylyltransferase:galactose-1-phosphate uridylyltransferase] [gn:gal7:ybr0226] [gtcfc:1.1.1.6:4.3] [ec:2.7.7.10] [keggfc:1.6:4.3] [sgdfc:1.5.1:9.2.0] [db:gtc-saccharomyces cerevisiae] |
| CONTIG5039 | 10601413_f1_3 | 3004 | 17107 | 495 | 165 | YBR018C | 477 | 1.7(10)-45 | Saccharomyces cerevisiae | [ui:ybr018c] [pn:udp-glucose--hexose-1-phosphate uridylyltransferase:galactose-1-phosphate uridylyltransferase] [gn:gal7:ybr0226] [gtcfc:1.1.1.6:4.3] [ec:2.7.7.10] [keggfc:1.6:4.3] [sgdfc:1.5.1:9.2.0] [db:gtc-saccharomyces cerevisiae] |
| CONTIG5709 | 32244212_f1_3 | 3005 | 17108 | 3282 | 1094 | YBR023C | 3197 | 0 | Saccharomyces cerevisiae | [ui:ybr023c] [pn:chitin synthase iii:chitin synthase 3:chitin-udp acetyl-glucosaminyl transferase 3] [gn:chs3:cal1:csd2:dit101:kit2:ybr0305] [gtcfc:11.4:7.2] [ec:2.4.1.16] [sgdfc:1.5.1:3.2.0:3.3.0:3.4.0:9.1.0:9.9.0] [dbg keggfc:4.4] |
| CONTIG5407 | 4378465_f3_8 | 3006 | 17109 | 2238 | 746 | YBR038W | 1545 | 1.1(10)-158 | Saccharomyces cerevisiae | [ui:ybr038w] [pn:chitin synthase ii:chitin synthase 2:chitin-udp acetyl-glucosaminyl transferase 2] [gn:chs2:ybr0407] [gtcfc:11.4:7.2] [ec:2.4.1.16] [keggfc:4.4] [sgdfc:1.5.1:3.2.0:9.1.0] [db:gtc-saccharomyces cerevisiae] |
| CONTIG5750 | 16587807_f3_12 | 3007 | 17110 | 1512 | 504 | YBR056W | 763 | 8.3(10)-76 | Saccharomyces cerevisiae | [ui:ybr056w] [pn:similarity to glucan 1,3-beta-glucosidase:hypothetical 57.8 kd protein in prp6-ubp14 intergenic region] [gn:ybr0510] [sgdfc:1.5.1] [gtcfc:1.1] [keggfc:14.2] [dbgtc-saccharomyces cerevisiae] |
| CONTIG4111 | 22401037_f1_1 | 3008 | 17111 | 534 | 178 | YBR084W | 497 | 1.2(10)-46 | Saccharomyces cerevisiae | [ui:ybr084w] [pn:c1-tetrahydrofolate synthase precursor, mitochondrial:c-1-tetrahydrofolate synthase mitochondrial precursor:c1-thf synthase:methylenetetrahydrofolate |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4111 | 5173563_f2_2 | 3009 | 17112 | 279 | 93 | YBR084W | 198 | 1.3(10)-14 | Saccharomyces cerevisiae | dehydrogenase/methenyltetrahydrofolate cyclohydrolase/formyltetr [ui:ybr084w] [pn:c1-tetrahydrofolate synthase precursor, mitochondrial:c-1-tetrahydrofolate synthase mitochondrial precursor:c1-thf synthase:methylenetetrahydrofolate dehydrogenase/methenyltetrahydrofolate cyclohydrolase/formyltetr |
| CONTIG4111 | 1228412_f3_4 | 3010 | 17113 | 243 | 81 | YBR084W | 124 | 1.0(10)-6 | Saccharomyces cerevisiae | [ui:ybr084w] [pn:c1-tetrahydrofolate synthase precursor, mitochondrial:c-1-tetrahydrofolate synthase mitochondrial precursor:c1-thf synthase:methylenetetrahydrofolate dehydrogenase/methenyltetrahydrofolate cyclohydrolase/formyltetr |
| CONTIG4111 | 972662_f2_3 | 3011 | 17114 | 1536 | 512 | YBR084W | 1725 | 9.5(10)-178 | Saccharomyces cerevisiae | [ui:ybr084w] [pn:c1-tetrahydrofolate synthase precursor, mitochondrial:c-1-tetrahydrofolate synthase mitochondrial precursor:c1-thf synthase:methylenetetrahydrofolate dehydrogenase/methenyltetrahydrofolate cyclohydrolase/formyltetr |
| CONTIG5680 | 31422827_c3_47 | 3012 | 17115 | 3063 | 1021 | YBR084W | 2843 | 3.2(10)-296 | Saccharomyces cerevisiae | [ui:ybr084w] [pn:c1-tetrahydrofolate synthase precursor, mitochondrial:c-1-tetrahydrofolate synthase mitochondrial precursor:c1-thf synthase:methylenetetrahydrofolate dehydrogenase/methenyltetrahydrofolate cyclohydrolase/formyltetr |
| CONTIG4603 | 5087562_c2_10 | 3013 | 17116 | 267 | 89 | YBR110W | 134 | 3.0(10)-8 | Saccharomyces cerevisiae | [ui:ybr110w] [pn:beta-mannosyltransferase] [gn:alg1:ybr0906] [gtcfc:1.1.1.5:7.1:8.5:10.7:11.3:11.4:12.16] [ec:2.4.1.-] [keggfc:1.5:7.2:7.3:8.5] [sgdfc:1.5.1:6.3.0:9.4.0] [db:gtc-saccharomyces cerevisiae] |
| CONTIG4603 | 33317155_c1_8 | 3014 | 17117 | 1194 | 398 | YBR110W | 773 | 7.2(10)-77 | Saccharomyces cerevisiae | [ui:ybr110w] [pn:beta-mannosyltransferase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5444 | 4772937_c3_14 | 3015 | 17118 | 1446 | 482 | YBR126C | 1855 | 1.6(10)-191 | Saccharomyces cerevisiae | [gn:alg1:ybr0906] [gtcfc:1.1:1.5:7:1:8.5:10.7:11.3:11.4: 12.16] [ec:2.4.1.-] [keggfc:1.5:7.2:7.3:8.5] [sgdfc:1.5.1:6.3.0:9.4.0] [db:gtc-saccharomyces cerevisiae] [ui:ybr126c] [pn:alpha,alpha-trehalose-phosphate synthase, 56 kd subunit:alpha,alpha-trehalose-phosphate synthase:udp-forming 56 kd subunit:trehalose-6-phosphate synthase:udp-glucose-glucosephosphate glucosyltransferase:general gluco |
| CONTIG1352 | 9767807_c1_3 | 3016 | 17119 | 624 | 208 | YBR149W | 446 | 3.2(10)-42 | Saccharomyces cerevisiae | [ui:ybr149w] [pn:similarity to gcy1p and aldose reductases:hypothetical 38.9 kd protein in ysw1-rib7 intergenic region] [gn:ybr1127] [gtcfc:1.1] [keggfc:14.2] [sgdfc:1.5.1] [db:gtc-saccharomyces cerevisiae] |
| CONTIG4959 | 21656687_c3_9 | 3017 | 17120 | 1347 | 449 | YBR199W | 868 | 6.2(10)-87 | Saccharomyces cerevisiae | [ui:ybr199w] [pn:strong similarity to alpha-1,2-mannosyltransferase:probable mannosyltransferase ktr4] [gn:ktr4:ybr1411] [gtcfc:1.1.7:11:10.7:11.3] [ec:2.4.1.131] [keggfc:7.2] [sgdfc:1.5.1:6.3.0] [db:gtc-saccharomyces cerevisiae] |
| CONTIG5462 | 25567318_f1_1 | 3018 | 17121 | 2190 | 730 | YBR229C | 1929 | 2.2(10)-199 | Saccharomyces cerevisiae | [ui:ybr229c] [pn:glucosidase ii, catalytic subunit:putative family 31 glucosidase in pcs60-abd1 intergenic region] [gn:rot2:ybr1526] [gtcfc:1.1:4.3:7.1:7.2] [ec:3.2.1.-] [keggfc:4.3:4.4] [sgdfc:1.5.1:2.7.0] [db:gtc-saccharomyces cerev |
| CONTIG5761 | 4377176_f3_15 | 3019 | 17122 | 1494 | 498 | YBR243C | 789 | 4.5(10)-109 | Saccharomyces cerevisiae | [ui:ybr243c] [pn:udp-n-acetylglucosamine-1-phosphate transferase:udp-n-acetylglucosamine--dolichyl-phosphate n-acetylglucosaminephosphotransferase: gpt:g1pt:n- acetylglucosamine-1-phosphate transferase:glcnac-1-p transferase:tunicamyci |
| CONTIG1695 | 4063925_c2_4 | 3020 | 17123 | 612 | 204 | YCR034W | 624 | 4.5(10)-61 | Saccharomyces cerevisiae | [ui:ycr034w] [pn:probable beta-1,3-glucan synthase subunit:gns1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | protein] [gn:gns1:ycr34w:ycr521] [gtcfc:1.1:3.4:8.1:8.2:11.1:12.15:12.8: 12.9] [keggfc:14.2] [sgdfc:1.5:1.6.1:3.1.0:3.2.0:3.3.0: 3.4.0:9.1.0] [db:gtc-saccharomyces cerevi |
| CONTIG1695 | 2_c1_1 | 3021 | 17124 | 384 | 128 | YCR034W | 270 | 1.5(10)-23 | Saccharomyces cerevisiae | [ui:ycr034w] [pn:probable beta-1,3-glucan synthase subunit:gns1 protein] [gn:gns1:ycr34w:ycr521] [gtcfc:1.1:3.4:8.1:8.2:11.1:12.15:12.8: 12.9] [keggfc:14.2] [sgdfc:1.5:1.6.1:3.1.0:3.2.0:3.3.0: 3.4.0:9.1.0] [db:gtc-saccharomyces cerevi |
| CONTIG3665 | 4493931_f3_3 | 3022 | 17125 | 888 | 296 | YCR034W | 760 | 1.7(10)-75 | Saccharomyces cerevisiae | [ui:ycr034w] [pn:probable beta-1,3-glucan synthase subunit:gns1 protein] [gn:gns1:ycr34w:ycr521] [gtcfc:1.1:3.4:8.1:8.2:11.1:12.15:12.8: 12.9] [keggfc:14.2] [sgdfc:1.5:1.6.1:3.1.0:3.2.0:3.3.0: 3.4.0:9.1.0] [db:gtc-saccharomyces cerevi |
| CONTIG5358 | 4493931_c1_9 | 3023 | 17126 | 429 | 143 | YCR034W | 270 | 1.5(10)-23 | Saccharomyces cerevisiae | [ui:ycr034w] [pn:probable beta-1,3-glucan synthase subunit:gns1 protein] [gn:gns1:ycr34w:ycr521] [gtcfc:1.1:3.4:8.1:8.2:11.1:12.15:12.8: 12.9] [keggfc:14.2] [sgdfc:1.5:1.6.1:3.1.0:3.2.0:3.3.0: 3.4.0:9.1.0] [db:gtc-saccharomyces cerevi |
| CONTIG1596 | 29722631_c3_3 | 3024 | 17127 | 687 | 229 | YCR036W | 150 | 2.8(10)-10 | Saccharomyces cerevisiae | [ui:ycr036w] [pn:ribokinase:probable ribokinase] [gn:rbk1:ycr36w:ycr523] [gtcfc:1.1:1.3] [ec:2.7.1.15] [sgdfc:1.5.1] [db:gtc-saccharomyces cerevisiae |
| CONTIG2716 | 6281562_c2_5 | 3025 | 17128 | 309 | 103 | YCR036W | 179 | 1.7(10)-13 | Saccharomyces cerevisiae | [ui:ycr036w] [pn:ribokinase:probable ribokinase] [gn:rbk1:ycr36w:ycr523] [gtcfc:1.1:1.3] [ec:2.7.1.15] [sgdfc:1.5.1] [db:gtc-saccharomyces cerevisiae |
| CONTIG5447 | 15645177_f2_6 | 3026 | 17129 | 534 | 178 | YDL246C | 306 | 2.2(10)-27 | Saccharomyces cerevisiae | [ui:ydl246c] [pn:strong similarity to sor1p] [gtcfc:1.1] [keggfc:14.2] [sgdfc:1.5.1] [db:gtc-saccharomyces cerevisiae |
| CONTIG5447 | 11964657_f1_2 | 3027 | 17130 | 816 | 272 | YDL246C | 564 | 1.0(10)-54 | Saccharomyces cerevisiae | [ui:ydl246c] [pn:strong similarity to sor1p] [gtcfc:1.1] [keggfc:14.2] [sgdfc:1.5.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1067 | 4807887_c2_4 | 3028 | 17131 | 726 | 242 | YDL174C | 442 | 8.6(10)-42 | *Saccharomyces cerevisiae* | *saccharomyces cerevisiae* [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [ec:1.1.2.4] [keggfc:1.8] [sgdk:1.5.1:2 |
| CONTIG4144 | 10162766_f2_2 | 3029 | 17132 | 1140 | 380 | YDL174C | 789 | 1.5(10)-78 | *Saccharomyces cerevisiae* | [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [8 ec:1.1.2.4] [keggfc:1.8] [sgdfc:1.5.1:2 |
| CONTIG5161 | 1173275_c2_9 | 3030 | 17133 | 570 | 190 | YDL174C | 163 | 3.5(10)-11 | *Saccharomyces cerevisiae* | [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [ec:1.1.2.4] [keggfc:1.8] [sgdfc:1.5.1:2 |
| CONTIG3136 | 22667053_f2_3 | 3031 | 17134 | 429 | 143 | YDL174C | 113 | 8.1(10)-6 | *Saccharomyces cerevisiae* | [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [ec:1.1.2.4] [keggfc:1.8] [sgdfc:1.5.1:2 |
| CONTIG4904 | 15709552_f1_1 | 3032 | 17135 | 1092 | 364 | YDL174C | 825 | 2.2(10)-82 | *Saccharomyces cerevisiae* | [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [ec:1.1.2.4] [keggfc:1.8] [sgdfc:1.5.1:2 |
| CONTIG4967 | 33254813_c1_8 | 3033 | 17136 | 402 | 134 | YDL174C | 375 | 2.5(10)-34 | *Saccharomyces cerevisiae* | [ui:ydl174c] [pn:d-lactate ferricytochrome c oxidoreductase:d-lactate dehydrogenase:cytochrome precursor:d- lactate ferricytochrome c oxidoreductase:d-lcr] [gn:dld1:dld] [gtcfc:1.1.1.8:2.2.2.8] [ec:1.1.2.4] [keggfc:1.8] [sgdfc:1.5.1:2 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2952 | 33400443_c2_2 | 3034 | 17137 | 732 | 244 | YDL131W | 1075 | 7.2(10)-109 | Saccharomyces cerevisiae | [ui:ydl131w] [pn:similarity to homocitrate synthases and isopropylmalate synthases] [gtcfc:1.16.6] [keggfc:14.2] [sgdfc:1.1.1.1.5.1] [db:gtc-saccharomyces cerevisiae] |
| CONTIG5285 | 4718875_f1_2 | 3035 | 17138 | 1446 | 482 | YDL131W | 1832 | 4.4(10)-189 | Saccharomyces cerevisiae | [ui:ydl131w] [pn:similarity to homocitrate synthases and isopropylmalate synthases] [gtcfc:1.16.6] [keggfc:14.2] [sgdfc:1.1.1.1.5.1] [db:gtc-saccharomyces cerevisiae] |
| CONTIG5022 | 29557677_f3_5 | 3036 | 17139 | 522 | 174 | YDL124W | 278 | 2.1(10)-24 | Saccharomyces cerevisiae | [ui:ydl124w] [pn:similarity to aldose reductases] [gtcfc:1.1] [keggfc:14.2] [sgdfc:1.5.1] [db:gtc-saccharomyces cerevisiae] |
| CONTIG5207 | 22453383_f3_4 | 3037 | 17140 | 432 | 144 | YDL124W | 270 | 1.5(10)-23 | Saccharomyces cerevisiae | [ui:ydl124w] [pn:similarity to aldose reductases] [gtcfc:1.1] [keggfc:14.2] [sgdfc:1.5.1] [db:gtc-saccharomyces cerevisiae] |
| CONTIG3542 | 2554692_f1_1 | 3038 | 17141 | 888 | 296 | YDL124W | 349 | 6.2(10)-32 | Saccharomyces cerevisiae | [ui:ydl124w] [pn:similarity to aldose reductases] [gtcfc:1.1] [keggfc:14.2] [sgdfc:1.5.1] [db:gtc-saccharomyces cerevisiae] |
| CONTIG2193 | 4569503_f1_1 | 3039 | 17142 | 930 | 310 | YDL095W | 294 | 5.2(10)-25 | Saccharomyces cerevisiae | [ui:ydl095w] [pn:mannosyltransferase:dolichyl-phosphate-mannose--protein mannosyltransferase 1] [gn:pmt1:d2390] [gtcfc:1.1:7.1:10.7:11.3:12.16] [keggfc:7.2] [ec:2.4.1.109] [sgdfc:1.5.1.6.3:0.9.4.0] [db:gtc-saccharomyces cerevisiae] |
| CONTIG3599 | 12509450_c3_3 | 3040 | 17143 | 834 | 278 | YDL095W | 383 | 1.3(10)-34 | Saccharomyces cerevisiae | [ui:ydl095w] [pn:mannosyltransferase:dolichyl-phosphate-mannose--protein mannosyltransferase 1] [gn:pmt1:d2390] [gtcfc:1.1:7.1:10.7:11.3:12.16] [keggfc:7.2] [ec:2.4.1.109] [sgdfc:1.5.1.6.3:0.9.4.0] [db:gtc-saccharomyces cerevisiae] |
| CONTIG4614 | 4104500_f3_4 | 3041 | 17144 | 1383 | 461 | YDL095W | 631 | 8.0(10)-62 | Saccharomyces cerevisiae | [ui:ydl095w] [pn:mannosyltransferase:dolichyl-phosphate-mannose--protein mannosyltransferase 1] [gn:pmt1:d2390] [gtcfc:1.1:7.1:10.7:11.3:12.16] [keggfc:7.2] [ec:2.4.1.109] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5222 | 7787_c1_8 | 3042 | 17145 | 1776 | 592 | YDL095W | 1545 | 1.1(10)-158 | Saccharomyces cerevisiae | [sgdfc:1.5.1.6.3.0:9.4.0] [db:gtc-saccharomyces cerevisiae] [ui:ydl095w] cerevisiae [pn:mannosyltransferase:doli-chyl-phosphate-mannose--protein mannosyltransferase 1 [gn:pmt1:d2390] [gtcfc:1.1.7.1:10.7:11.3:12.16] [ec:2.4.1.109] [keggfc:7.21] [sgdfc:1.5.1.6.3.0:9.4.0] [db:gtc-saccharomyces cerevisiae] |
| CONTIG4498 | 26362557_f3_2 | 3043 | 17146 | 1323 | 441 | YDL066W | 1467 | 2.1(10)-150 | Saccharomyces cerevisiae | [ui:ydl066w] [pn:nadp+, mitochondrial isocitrate dehydrogenase:nadp, mitochondrial precursor:oxalosuccinate decarboxylase:idb:nadp+ specific icdh:idp] [gn:idp1] [gtcfc:1.1.1.2:1.8:2.5:2.8:6.16] [ec:1.1.1.42] [keggfc:1.2.2.4:6.9] [sgdf |
| CONTIG5772 | 31328125_f2_13 | 3044 | 17147 | 219 | 73 | YDL055C | 91 | 0.0096 | Saccharomyces cerevisiae | [ui:ydl055c] [pn:mannose-1-phosphate guanyltransferase:atp-mannose-1-phosphate guanyltransferase:ndp-hexose pyrophosphorylase] [gn:mpg1:psa1] [gtcfc:1.1.1.5:9.12] [keggfc:1.5.9.13] [sgdfc:1.5.1] [db:gtc-saccharomyces cerevisiae] |
| CONTIG5772 | 25820161_f2_14 | 3045 | 17148 | 984 | 328 | YDL055C | 1374 | 1.5(10)-140 | Saccharomyces cerevisiae | [ui:ydl055c] [pn:mannose-1-phosphate guanyltransferase:atp-mannose-1- phosphate guanyltransferase:ndp-hexose pyrophosphorylase] [gn:mpg1:psa1] [gtcfc:1.1.1.5:9.12] [keggfc:1.5.9.13] [sgdfc:1.5.1] [db:gtc-saccharomyces cerevisiae] |
| CONTIG5779 | 6647157_c1_15 | 3046 | 17149 | 1389 | 463 | YDL055C | 173 | 4.4(10)-24 | Saccharomyces cerevisiae | [ui:ydl055c] [pn:mannose-1-phosphate guanyltransferase:atp-mannose-1-phosphate guanyltransferase:ndp-hexose pyrophosphorylase] [gn:mpg1:psa1] [gtcfc:1.1.1.5:9.12] [keggfc:1.5.9.13] [sgdfc:1.5.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4188 | 31808333_f3_2 | 3047 | 17150 | 1332 | 444 | YDL022W | 1253 | 9.9(10)-128 | Saccharomyces cerevisiae | [ui:ydl022w] [pn:nad+, cytoplasmic:glycerol-3-phosphate dehydrogenase:nad+ 1] [gn:gpd1:osg1:dar1:hor1:d2830] [gtcfc:1.1.8.1:12.11] [ec:1.1.1.8] [keggfc:8.1] [sgdfc:1.5.1.9.2.0:10.3.5] [db:gtc-saccharomyces cerevisiae] |
| CONTIG5474 | 4867002_f3_7 | 3048 | 17151 | 1143 | 381 | YDL022W | 1039 | 4.7(10)-105 | Saccharomyces cerevisiae | [ui:ydl022w] [pn:nad+, cytoplasmic:glycerol-3-phosphate dehydrogenase:nad+ 1] [gn:gpd1:osg1:dar1:hor1:d2830] [gtcfc:1.1.8.1:12.11] [ec:1.1.1.8] [keggfc:8.1] [sgdfc:1.5.1.9.2.0:10.3.5] [db:gtc-saccharomyces cerevisiae] |
| CONTIG2937 | 14884650_f3_3 | 3049 | 17152 | 279 | 93 | YDR001C | 343 | 2.2(10)-30 | Saccharomyces cerevisiae | [ui:ydr001c] [pn:neutral trehalase:alpha, alpha-trehalase:alpha, alpha-trehalose glucohydrolase] [gn:nth1:nth:yd8119] [gtcfc:1.1.7.1:7.2] [ec:3.2.1.28] [keggfc:7.1] [sgdfc:1.5.1.2.7.0:9.2.0] [db:gtc-saccharomyces cerevisiae] |
| CONTIG4715 | 14625305_f3_7 | 3050 | 17153 | 960 | 320 | YDR074W | 542 | 1.1(10)-51 | Saccharomyces cerevisiae | [ui:ydr074w] [pn:catalyzes the hydrolysis of trehalose 6-phosphate to trehalose:trehalose-phosphatase:trehalose 6-phosphate phosphatase:tpp] [gn:tps2:pfk3:yd8554] [gtcfc:1.1.7.1:7.2:13.2] [ec:3.1.3.12] [keggfc:7.1] [sgdfc:1.5.1.2.7.0] |
| CONTIG4715 | 7320953_f1_3 | 3051 | 17154 | 273 | 91 | YDR074W | 178 | 1.6(10)-12 | Saccharomyces cerevisiae | [ui:ydr074w] [pn:catalyzes the hydrolysis of trehalose 6-phosphate to trehalose:trehalose-phosphatase:trehalose 6-phosphate phosphatase:tpp] [gn:tps2:pfk3:yd8554] [gtcfc:1.1.7.1:7.2:13.2] [ec:3.1.3.12] [keggfc:7.1] [sgdfc:1.5.1.2.7.0] |
| CONTIG5613 | 16804668_c1_17 | 3052 | 17155 | 1398 | 466 | YDR074W | 1257 | 3.7(10)-128 | Saccharomyces cerevisiae | [ui:ydr074w] [pn:catalyzes the hydrolysis of trehalose 6-phosphate to trehalose:trehalose-phosphatase:trehalose 6-phosphate phosphatase:tpp] [gn:tps2:pfk3:yd8554] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1934 | 4409650_c1_4 | 3053 | 17156 | 972 | 324 | YDR148C | 388 | 6.2(10)-62 | Saccharomyces cerevisiae | [gtcfc:1.1.7.1.7.2:13.2] [ec:3.1.3.12] [keggfc:7.1] [sgdfc:1.5.1:2.7.0] [ui:ydr148c] [pn:2-oxoglutarate dehydrogenase complex e2 component:dihydrolipoamide succinyltransferase component:e2 of 2-oxoglutarate dehydrogenase complex precursor] [gn:kgd2:yd8358] [gtcfc:1.1.1.2:2.8] [ec:2.3.1.61] [keggfc:1.2] [s |
| CONTIG2364 | 11042506_f1_1 | 3054 | 17157 | 264 | 88 | YDR148C | 373 | 1.8(10)-34 | Saccharomyces cerevisiae | [ui:ydr148c] [pn:2-oxoglutarate dehydrogenase complex e2 component:dihydrolipoamide succinyltransferase component:e2 of 2-oxoglutarate dehydrogenase complex precursor] [gn:kgd2:yd8358] [gtcfc:1.1.1.2:2.8] [ec:23.1.61] [keggfc:1.2] [s |
| CONTIG5523 | 988557_f1_4 | 3055 | 17158 | 600 | 200 | YDR178W | 305 | 2.8(10)-27 | Saccharomyces cerevisiae | [ui:ydr178w] [pn:succinate dehydrogenase membrane anchor subunit for sdh2p:succinate dehydrogenase membrane anchor subunit precursor] [gn:sdh4:yd9395] [gtcfc:1.1.2:2.8] [keggfc:14.2] [sgdfc:1.5.1:2.4.0:2.5.0:9.7.0] [db:gtc-saccharom |
| CONTIG866 | 14900381_f2_1 | 3056 | 17159 | 435 | 145 | YDR178W | 355 | 1.3(10)-32 | Saccharomyces cerevisiae | [ui:ydr178w] [pn:succinate dehydrogenase membrane anchor subunit for sdh2p:succinate dehydrogenase membrane anchor subunit precursor] [gn:sdh4:yd9395] [gtcfc:1 1.1.2:2.8] [keggfc:14.2] [sgdfc:1.5.1:2.4.0:2.5.0:9.7.0] [db:gtc-saccharom |
| CONTIG3342 | 267212_f1_3 | 3057 | 17160 | 831 | 277 | YDR245W | 365 | 1.2(10)-33 | Saccharomyces cerevisiae | [ui:ydr245w] [pn:similarity to s. pombe galactosyltransferase:galactosyltransferase mnn10:bud emergence delay protein 1] [gn:mnn10:bed1:yd8419] [gtcfc:1.1.1.5:7.1:8.5:10.7:11.3:11.4: 12.16:12.8] [ec:2.4.1.-] [keggfc:1.5:7.2:7.3:8.5] [sg |
| CONTIG3345 | 31287567_c1_6 | 3058 | 17161 | 360 | 120 | YDR245W | 461 | 8.4(10)-44 | Saccharomyces | [ui:ydr245w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | s. pombe galactosyltransferase:galactosyltransferase mnn 10:bud emergence delay protein 1] [gn:mnn10:bed1:yd8419] [gtcfc:1.11.5.7.1:8.5:10.7:11.3:11.4: 12.16.12.8] [ec:2.4.1.-] [keggfc:1.5.7.2:7.3:8.5] [sg |
| CONTIG4410 | 14882157_c3_9 | 3059 | 17162 | 582 | 194 | YDR248C | 352 | 3.0(10)-32 | Saccharomyces cerevisiae | [ui:ydr248c] [pn:similarity to e. coli thermoresistant gluconokinase] [gtcfc:1.1] [keggfc:14.2] [sgdfc:1.5.1] [db:gtc-saccharomyces cerevisiae] |
| b9x13d94.y | 22864593_f1_1 | 3060 | 17163 | 702 | 234 | YDR261C | 258 | 1.7(10)-21 | Saccharomyces cerevisiae | [ui:ydr261c] [pn:exo-beta-1,3-glucanase minor isoform:glucan 1,3-beta-glucosidase 2 precursor:exo-1,3-beta-glucanase 2] [gn:exg2:yd920a] [gtcfc:1.11.1.12.15:12.8:12.9] [ec:3.2.1.58] [keggfc:14.1] [sgdfc:1.5.1.3.1.0:3.3.0:3.4.0:9.1 |
| CONTIG2277 | 25969375_f3_2 | 3061 | 17164 | 336 | 112 | YDR371W | 140 | 8.4(10)-9 | Saccharomyces cerevisiae | [ui:ydr371w] [pn:similarity to chitinases] [gtcfc:11.4:7.2] [keggfc:14.2] [sgdfc:1.5.1] [db-gtc-saccharomyces cerevisiae] |
| CONTIG4409 | 819407_f2_3 | 3062 | 17165 | 564 | 188 | YDR380W | 317 | 9.4(10)-28 | Saccharomyces cerevisiae | [ui:ydr380w] [pn:similarity to pdc6p, thi3p and to pyruvate decarboxylases] [gtcfc:1.1:2.2] [keggfc:14.2] [sgdfc:1.5.1:2.6.0] [db:gtc-saccharomyces cerevisiae] |
| CONTIG5019 | 4869458_f2_2 | 3063 | 17166 | 1551 | 517 | YDR380W | 555 | 9.1(10)-54 | Saccharomyces cerevisiae | [ui:ydr380w] [pn:similarity to pdc6p, thi3p and to pyruvate decarboxylases] [gtcfc:1.1:2.2] [keggfc:14.2] [sgdfc:1.5.1:2.6.0] [db:gtc-saccharomyces cerevisiae] |
| CONTIG5449 | 22665811_c1_6 | 3064 | 17167 | 1443 | 481 | YDR483W | 1019 | 6.2(10)-103 | Saccharomyces cerevisiae | [ui:ydr483w] [pn:glycolipid 2-alpha-mannosyltransferase:alpha-1,2-mannosyltransferase] [gn:kre2:mnt1:d8035] [gtcfc:1.1.7:1:10.7:11.3:12.16] [ec:2.4.1.31] [keggfc:7.2] [sgdfc:1.5.1.6.3.0:9.4.0] [db:gtc-saccharomyces cerevisiae] |
| CONTIG1247 | 11954562_f3_2 | 3065 | 17168 | 300 | 100 | YEL058W | 312 | 2.1(10)-27 | Saccharomyces cerevisiae | [ui:yel058w] [pn:phosphoacetylglucosamine mutase:acetylglucosamine phosphomutase:n-acetylglucosamine-phosphate mutase] [gn:pcm1:agm1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4592 | 4775257_f3_4 | 3066 | 17169 | 1005 | 335 | YEL058W | 589 | 2.2(10)-57 | Saccharomyces cerevisiae | [gtcfc:1.1:7.1] [ec:5.4.2.3] [keggfc:4.4] [sgdfc:1.5.1][db:gtc-saccharomyces cerevisiae] [ui:yel058w] [pn:phosphoacetylglucosamine mutase:acetylglucosamine phosphomutase:n-acetylglucosamine-phosphate mutase] [gn:pcm1:agm1] [gtcfc:1.1:7.1] [9] [ec:5.4.2.3] [keggfc:4.4] [sgdfc:1.5.1] [db:gtc-saccharomyces cerevisiae] |
| CONTIG2326 | 16808312_c1_2 | 3067 | 17170 | 639 | 213 | YEL011W | 663 | 3.2(10)-65 | Saccharomyces cerevisiae | [ui:yel011w] [pn:1,4-glucan branching enzyme:1,4-alpha-glucan branching enzyme:glycogen branching enzyme] [gn:glc3] [gtcfc:1.1:7.1:7.2] [ec:2.4.1.18] [keggfc:7.1] [sgdfc:1.5.1:2.7.0:9.2.0] [db:gtc-saccharomyces cerevisiae] |
| CONTIG639 | 13875325_f3_1 | 3068 | 17171 | 525 | 175 | YEL011W | 590 | 1.8(10)-57 | Saccharomyces cerevisiae | [ui:yel011w] [pn:1,4-glucan branching enzyme:1,4-alpha-glucan branching enzyme:glycogen branching enzyme] [gn:glc3] [gtcfc:1.1:7.1:7.2] [ec:2.4.1.18] [keggfc:7.1] [sgdfc:1.5.1:2.7.0:9.2.0] [db:gtc-saccharomyces cerevisiae] |
| CONTIG5305 | 2937780_f2_5 | 3069 | 17172 | 780 | 260 | YEL002C | 215 | 4.0(10)-17 | Saccharomyces cerevisiae | [ui:yel002c] [pn:oligosaccharyl transferase beta subunit precursor:dolichyl-diphosphooligosaccharide--protein glycosyltransferase beta subunit precursor:oligosaccharyl transferase beta subunit] [gn:wbp1] [gtcfc:1.1:7.1:10.7:11.3:12.16] |
| CONTIG2053 | 4960878_f3_1 | 3070 | 17173 | 729 | 243 | YER001W | 104 | 0.00689 | Saccharomyces cerevisiae | [ui:yer001w] [pn:alpha-1,3-mannosyltransferase] [gn:mnn1] [gtcfc:1.1.1.5:7.1:8.5:10.7:11.3:11.4: 12.16] [ec:2.4.1.-] [keggfc:1.5:7.2:7.3:8.5] [sgdfc:1.5.1.6.3.0:9.4.0] [db:gtc-saccharomyces cerevisiae] |
| CONTIG4094 | 29391927_f1_1 | 3071 | 17174 | 1479 | 493 | YER001W | 415 | 3.7(10)-38 | Saccharomyces cerevisiae | [ui:yer001w] [pn:alpha-1,3-mannosyltransferase] [gn:mnn1] [gtcfc:1.1.1.5:7.1:8.5:10.7:11.3:11.4: 12.16] [ec:2.4.1.-] [keggfc:1.5:7.2:7.3:8.5] [sgdfc:1.5.1.6.3.0:9.4.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5102 | 4719577_c2_4 | 3072 | 17175 | 1065 | 355 | YER001W | 251 | 1.8(10)-20 | *Saccharomyces* | *saccharomyces cerevisiae* [ui:yer001w] [pn:alpha-1,3-cerevisiae mannosyltransferase] [gn:mnn1] [gtcfc:1.1.1.5.7.1:8.5:10.7:11.3:11.4:12.16] [ec:2.4.1.-] [keggfc:1.5:7.2:7.3:8.5] [sgdfc:1.5.1.6.3:0:9.4.0] [db:gtc-saccharomyces cerevisiae] |
| CONTIG2078 | 2070212_f1_1 | 3073 | 17176 | 654 | 218 | YER003C | 657 | 1.3(10)-64 | *Saccharomyces cerevisiae* | [ui:yer003c] [pn:mannose-6-phosphate isomerase;phosphomannose isomerase;pmi:phosphohexomutase] [gn:pmi40] [gtcfc:1.1.1.5] [ec:5.3.1.8] [keggfc:1.5] [sgdfc:1.5.1.9.2.0] [db:gtc-saccharomyces cerevisiae] |
| CONTIG2078 | 197825_f2_2 | 3074 | 17177 | 630 | 210 | YER003C | 617 | 2.5(10)-60 | *Saccharomyces cerevisiae* | [ui:yer003c] [pn:mannose-6-phosphate isomerase;phosphomannose isomerase;pmi:phosphohexomutase] [gn:pmi40] [gtcfc:1.1.1.5] [ec:5.3.1.8] [keggfc:1.5] [sgdfc:1.5.1.9.2.0] [db:gtc-saccharomyces cerevisiae] |
| CONTIG5632 | 22459692_c3_14 | 3075 | 17178 | 1812 | 604 | YFL053W | 1131 | 8.4(10)-115 | *Saccharomyces cerevisiae* | [ui:yfl053w] [pn:similarity to c. freundii dihydroxyacetone kinase;putative dihydroxyacetone kinase;glycerone kinase] [gtcfc:1.18.1] [ec:2.7.1.29] [keggfc:8.1] [sgdfc:1.5.1] [db:gtc-saccharomyces cerevisiae] |
| CONTIG2334 | 21494050_f2_2 | 3076 | 17179 | 369 | 123 | YFL045C | 446 | 3.2(10)-42 | *Saccharomyces cerevisiae* | [ui:yfl045c] [pn:phosphomannomutase;pmm] [gn:sec53;alg4] [gtcfc:1.1.1.5:10.7] [ec:5.4.2.8] [keggfc:1.5] [sgdfc:1.5.1.6.3:0.9.2.0] [db:gtc-saccharomyces cerevisiae] |
| CONTIG4663 | 87782_f2_3 | 3077 | 17180 | 450 | 150 | YFL045C | 579 | 2.6(10)-56 | *Saccharomyces cerevisiae* | [ui:yfl045c] [pn:phosphomannomutase;pmm] [gn:Sec53;atg4] [gtcfc:1.1.1.5:10.7] [ec:5.4.2.8] [keggfc:1.5] [sgdfc:1.5.1.6.3:0.9.2.0] [db:gtc-saccharomyces cerevisiae] |
| CONTIG5374 | 12345302_f3_3 | 3078 | 17181 | 546 | 182 | YFL014W | 194 | 1.6(10)-15 | *Saccharomyces cerevisiae* | [ui:yfl014w] [pn:heat shock protein;12 kd heat shock protein;glucose and lipid regulated protein] [gn:hsp12:glp1:hor5] [gtcfc:12.7:1.1.3.1:12.11:13.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5290 | 14727125_c1_10 | 3079 | 17182 | 1998 | 666 | YFR015C | 2352 | 2.0(10)-254 | *Saccharomyces cerevisiae* | [sgdfc:1.5.1.1.6.3:10.3.5:11.1.0:11.2.1] [db:gtc-saccharomyces cerevi [ui:yfr015c] [pn:udp glucose--starch glucosyltransferase, isoform 1:glycogen:starch synthase, isoform 1] [gn:gsy1] [gtcfc:1.1:7.1:7.2] [ec:2.4.1.11] [keggfc:7.1] [sgdfc:1.5.1.2.7.0:9.2.0] [db:gtc-saccharomyces cerevisiae] |
| CONTIG3286 | 1376512_f1_1 | 3080 | 17183 | 768 | 256 | YGL257C | 184 | 1.7(10)-13 | *Saccharomyces cerevisiae* | [ui:ygl257c] [pn:similarity to mnn1p:hypothetical 64.9 kd protein in adh4 5'region] [gn:nrd558] [gtcfc:1.1.1.5:7.1:8.5:10.7:11.3:11.4] [ec:2.4.1.-] [keggfc:1.5:7.2:7.3:8.5] [sgdfc:1.5.1.6.3.0] [db:gtc-saccharomyces cerevisiae] |
| CONTIG5102 | 21900180_c1_2 | 3081 | 17184 | 234 | 78 | YGL257C | 94 | 0.00084 | *Saccharomyces cerevisiae* | [ui:ygl257c] [pn:similarity to mnn1p:hypothetical 64.9 kd protein in adh4 5'region] [gn:nrd558] [gtcfc:1.1.1.5:7.1:8.5:10.7:11.3:11.4] [ec:2.4.1.-] [keggfc:1.5:7.2:7.3:8.5] [sgdfc:1.5.1.6.3.0] [db:gtc-saccharomyces cerevisiae] |
| CONTIG455 | 3941563_c1_1 | 3082 | 17185 | 618 | 206 | YGL156W | 384 | 2.0(10)-34 | *Saccharomyces cerevisiae* | [ui:ygl156w] [pn:alpha-mannosidase:alpha-d-mannoside mannohydrolase] [gn:ams1:g1861] [gtcfc:1.1:12.16] [ec:3.2.1.24] [keggfc:14.1] [sgdfc:1.5.1.9.10.0] [db:gtc-saccharomyces cerevisiae] |
| CONTIG5170 | 13938551_f2_2 | 3083 | 17186 | 1704 | 568 | YGL156W | 1543 | 1.8(10)-158 | *Saccharomyces cerevisiae* | [ui:ygl156w] [pn:alpha-mannosidase:alpha-d-mannoside mannohydrolase] [gn:ams1:g1861] [gtcfc:1.1:12.16] [ec:3.2.1.24] [keggfc:14.1] [sgdfc:1.5.1.9.10.0] [db:gtc-saccharomyces cerevisiae] |
| CONTIG757 | 35647067_f2_1 | 3084 | 17187 | 714 | 238 | YGL156W | 167 | 3.5(10)-22 | *Saccharomyces cerevisiae* | [ui:ygl156w] [pn:alpha-mannosidase:alpha-d-mannoside mannohydrolase] [gn:ams1:g1861] [gtcfc:1.1:12.16] [ec:3.2.1.24] [keggfc:14.1] [sgdfc:1.5.1.9.10.0] [db:gtc-saccharomyces cerevisiae] |
| CONTIG5180 | 20523263_f1_1 | 3085 | 17188 | 1338 | 446 | YGL065C | 1055 | 9.5(10)-107 | *Saccharomyces cerevisiae* | [ui:ygl065c] [pn:mannosyltransferase:glycosyltransferase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5618 | 189436_c1_20 | 3086 | 17189 | 264 | 88 | YGL038C | 190 | 2.8(10)-14 | *Saccharomyces cerevisiae* | [gn:alg2] [gtcfc:1.1.5:7.1:8.5:10.7:11.3:11.4] [ec:2.4.1.-] [keggfc:1.5:7.2:7.3:8.5] [sgdfc:1.5.1.6.3.0] [db:gtc-*saccharomyces cerevisiae*] [ui:ygl038c] [pn:alpha-1,6-mannosyltransferase] [gn:och1] [gtcfc:1.1.1.5:7.1:8.5:10.7:11.3:11.4:12.16] [ec:2.4.1.-] [keggfc:1.5:7.2:7.3:8.5] [sgdfc:1.5.1.6.3.0:9.4.0] [db:gtc-*saccharomyces cerevisiae*] |
| CONTIG5618 | 234410_c1_19 | 3087 | 17190 | 495 | 165 | YGL038C | 194 | 1.1(10)-14 | *Saccharomyces cerevisiae* | [ui:ygl038c] [pn:alpha-1,6-mannosyltransferase] [gn:och1] [gtcfc:1.1.1.5:7.1:8.5:10.7:11.3:11.4:12.16] [ec:2.4.1.-] [keggfc:1.5:7.2:7.3:8.5] [sgdfc:1.5.1.6.3.0:9.4.0] [db:gtc-*saccharomyces cerevisiae*] |
| CONTIG5088 | 25664200_c3_10 | 3088 | 17191 | 1995 | 665 | YGL027C | 1063 | 1.3(10)-107 | *Saccharomyces cerevisiae* | [ui:ygl027c] [pn:beta-1,6-glucan assembly protein:protein] [gn:cwh41] [gtcfc:1.1.12.16] [keggfc:14.2] [sgdfc:1.5.1.9.4.0] [db:gtc-*saccharomyces cerevisiae*] |
| CONTIG1629 | 31454501_c3_3 | 3089 | 17192 | 867 | 289 | YGL022W | 919 | 2.5(10)-92 | *Saccharomyces cerevisiae* | [ui:ygl022w] [pn:oligosaccharyl transferase subunit:oligosaccharyl transferase subunit] [gn:stt3] [gtcfc:1.1.10:7.12.16] [keggfc:14.2] [sgdfc:1.5.1.6.3.0:9.4.0] [db:gtc-*saccharomyces cerevisiae*] |
| CONTIG2349 | 20492336_f2_2 | 3090 | 17193 | 594 | 198 | YGL022W | 658 | 1.1(10)-64 | *Saccharomyces cerevisiae* | [ui:ygl022w] [pn:oligosaccharyl transferase subunit:oligosaccharyl transferase subunit] [gn:stt3] [gtcfc:1.1.10:7.12.16] [keggfc:14.2] [sgdfc:1.5.1.6.3.0:9.4.0] [dg:gtc-*saccharomyces cerevisiae*] |
| CONTIG1430 | 22152312_c3_2 | 3091 | 17194 | 1233 | 411 | YGR032W | 1388 | 4.9(10)-142 | *Saccharomyces cerevisiae* | [ui:ygr032w] [pm:1,3-beta-d-glucan synthase subunit:1,3-beta glucansynthase component gls2:1,3-beta-d-glucan-udp glucosyltransferase] [gn:gls2:fks2:gsc2] [gtcfc:1.1:7.2:11.1:12.15] [ec:2.4.1.34] [keggfc:7.1] [sgdfc:1.5.1.3.4.0:9.1.0] |
| CONTIG2205 | 33464218_f2_1 | 3092 | 17195 | 807 | 269 | YGR032W | 679 | 1.8(10)-65 | *Saccharomyces cerevisiae* | [ui:ygr032w] [pm:1,3-beta-d-glucan synthase subunit:1,3-beta-d-glucan synthase component gls2:1,3-beta-d-glucan-udp glucosyltransferase] [gn:gls2:fks2:gsc] [gtcfc:1.1:7.2:11.1:12.15] [ec:2.4.1.34] [keggfc:7.1] [sgdfc:1.5.1.3.4.0:9.1.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4132 | 16054160_c3_5 | 3093 | 17196 | 2424 | 808 | YGR032W | 1970 | 4.7(10)-222 | Saccharomyces cerevisiae | [ui:ygr032w] [pn:1,3-beta-d-glucan synthase subunit:1,3-beta-glucan synthase component gls2:1,3-beta-d-glucan-udp glucosyltransferase] [gn:gls2:fks2:gsc2] [gtcfc:1.1.7.2:11.1.12.15] [ec:2.4.1.34] [keggfc:7.1] [sgdfc:1.5.1:3.4.0:9.1.0] |
| CONTIG293 | 10016706_f3_1 | 3094 | 17197 | 681 | 227 | YGR032W | 547 | 2.2(10)-51 | Saccharomyces cerevisiae | [ui:ygr032w] [pn:1,3-beta-d-glucan synthase subunit:1,3-beta-glucan synthase component gls2:1,3-beta-d-glucan-udp glucosyltransferase] [gn:gls2:fks2:gsc2] [gtcfc:1.1.7.2:11.1.12.15] [ec:2.4.1.34] [keggfc:7.1] [sgdfc:1.5.1:3.4.0:9.1.0] |
| b2x17884.x | 26368942_f1_1 | 3095 | 17198 | 465 | 155 | YGR032W | 674 | 6.5(10)-65 | Saccharomyces cerevisiae | [ui:ygr032w] [pn:1,3-beta-d-glucan synthase subunit:1,3-beta-glucan synthase component gls2:1,3-beta-d-glucan-udp glucosyltransferase] [gn:gls2:fks2:gsc2] [gtcfc:1.1.7.2:11.1.12.15] [ec:2.4.1.34] [keggfc:7.1] [sgdfc:1.5.1:3.4.0:9.1.0] |
| CONTIG2901 | 2921875_f3_2 | 3096 | 17199 | 1059 | 353 | YGR282C | 914 | 8.3(10)-92 | Saccharomyces cerevisiae | [ui:ygr282c] [pn:endo-beta-1,3-glucanase of the cell wall:glucan 1,3-beta-glucosidase precursor:exo-1,3-beta-glucanase:gp29] [gn:bgl2] [gtcfc:1.1.11.1] [ec:3.2.1.58] [keggfc:14.1] [sgdfc:1.5.1:9.1.0] [db:gtc-saccharomyces cerevisiae] |
| CONTIG5189 | 22472006_c2_19 | 3097 | 17200 | 954 | 318 | YGR282C | 187 | 1.0(10)-12 | Saccharomyces cerevisiae | [ui:ygr282c] [pn:endo-beta-1,3-glucanase of the cell wall:glucan 1,3-beta-glucosidase precursor:exo-1,3-beta-glucanase:gp29] [gn:bgl2] [gtcfc:1.1.11.1] [ec:3.2.1.58] [keggfc:14.1] [sgdfc:1.5.1:9.1.0] [db:gtc-saccharomyces cerevisiae] |
| CONTIG5723 | 14538403_c2_23 | 3098 | 17201 | 1029 | 343 | YGR282C | 1004 | 2.3(10)-101 | Saccharomyces cerevisiae | [ui:ygr282c] [pn:endo-beta-1,3-glucanase of the cell wall:glucan 1,3-beta-glucosidase precursor:exo-1,3-beta-glucanase:gp29] [gn:bgl2] [gtcfc:1.1.11.1] [ec:3.2.1.58] [keggfc:14.1] [sgdfc:1.5.1:9.1.0] [db:gtc-saccharomyces cerevisiae] |
| CONTIG3749 | 5104186_c1_4 | 3099 | 17202 | 1533 | 511 | YGR287C | 1219 | 4.0(10)-124 | Saccharomyces cerevisiae | [ui:ygr287c] [pn:strong similarity to maltase:probable alpha-glucosidase:maltase-flocculent specific protein 2] [gn:fsp2] [gtcfc:1.1.6:7.2] [ec:3.2.1.20] [keggfc:1.6.7.1] [sgdfc:1.5.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2949 | 13834406_c3_6 | 3100 | 17203 | 1284 | 428 | YHL032C | 1243 | 1.1(10)-126 | Saccharomyces cerevisiae | [ui:yhl032c] [pn:glycerol kinase:atp:glycerol 3-phosphotransferase:glycerokinase:gk] [gn:gut1] [gtcfc:1.1.8.1] [ec:2.7.1.30] [keggfc:8.1] [sgdfc:1.5.1] [db:gtc-saccharomyces cerevisiae] |
| CONTIG2949 | 13163142_c2_5 | 3101 | 17204 | 234 | 78 | YHL032C | 123 | 9.0(10)-7 | Saccharomyces cerevisiae | [ui:yhl032c] [pn:glycerol kinase:atp:glycerol 3-phosphotransferase:glycerokinase:gk] [gn:gut1] [gtcfc:1.1.8.1] [ec:2.7.1.30] [keggfc:8.1] [sgdfc:1.5.1] [db:gtc-saccharomyces cerevisiae] |
| CONTIG5707 | 9769766_f3_10 | 3102 | 17205 | 780 | 260 | YHR043C | 407 | 4.4(10)-38 | Saccharomyces cerevisiae | [ui:yhr043c] [pn:2-deoxyglucose-6-phosphate phosphatase:2-deoxyglucose-6-phosphate phosphatase 2:2-dog-6-p 2] [gn:dog2] [gtcfc:1.1.7.1:9.1:9.3:9.4:13.10] [ec:3.1.3.-] [keggfc:4.4:9.1:9.3:9.4] [sgdfc:1.4.1:1.5.1] [db:gtc-saccharomyces] |
| CONTIG3875 | 34414013_f3_1 | 3103 | 17206 | 777 | 259 | YHR101C | 233 | 1.2(10)-19 | Saccharomyces cerevisiae | [ui:yhr101c] [pn:big cells phenotype:hypothetical 39.1 kd protein in hxt5-nrk1 intergenic region precursor] [gn:big1] [gtcfc:1.1:12.8] [keggfc:14.2] [sgdfc:1.5.1:3.8.0] [db:gtc-saccharomyces cerevisiae] |
| CONTIG4454 | 23437500_f1_1 | 3104 | 17207 | 1233 | 411 | YHR104W | 925 | 5.7(10)-93 | Saccharomyces cerevisiae | [ui:yhr104w] [pn:strong similarity to d-xylose 1-dehydrogenase:hypothetical 37.1 kd protein in nrk1-cdc12 intergenic region] [gtcfc:1.1] [keggfc:14.2] [sgdfc:1.5.1] [db:gtc-saccharomyces cerevisiae] |
| CONTIG818 | 25978312_f3_3 | 3105 | 17208 | 453 | 151 | YHR183W | 542 | 2.2(10)-52 | Saccharomyces cerevisiae | [ui:yhr183w] [pn:6-phosphogluconate dehydrogenase:6-phosphogluconate dehydrogenase, decarboxylating] [gn:gnd1] [gtcfc:1.3] [ec:1.1.1.44] [keggfc:1.3] [sgdfc:1.5.1:2.3.0:9.2.0] [db:gtc-saccharomyces cerevisiae] |
| b1x12596.y | 26359680_c2_5 | 3106 | 17209 | 777 | 259 | YHR183W | 898 | 4.0(10)-90 | Saccharomyces cerevisiae | [ui:yhr183w] [pn:6-phosphogluconate dehydrogenase:6-phosphogluconate dehydrogenase, decarboxylating] [gn:gnd1] [gtcfc:1.3] [ec:1.1.1.44] [keggfc:1.3] [sgdfc:1.5.1:2.3.0:9.2.0] [db:gtc-saccharomyces cerevisiae] |
| CONTIG5119 | 9630_c3_6 | 3107 | 17210 | 2532 | 844 | YHR204W | 917 | 4.0(10)-92 | Saccharomyces cerevisiae | [ui:yhr204w] [pn:similarity to alpha-mannosidases:hypothetical 91.2 kd protein in rps7a-sch9 intergenic region] [gtcfc:1.1] [keggfc:14.2] [sgdfc:1.5.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1374 | 21914692_c3_2 | 3108 | 17211 | 621 | 207 | YIL155C | 443 | 9.8(10)-42 | Saccharomyces cerevisiae | [ui:yil155c] [pn:glycerol-3-phosphate dehydrogenase, mitochondrial:glycerol-3-phosphate dehydrogenase mitochondrial precursor:gpd-m:gpdh-m] [gn:gut2] [gtcfc:1.1.2.8:8.1] [ec:1.1.99.5] [sgdfc:1.5.1.9.7.0] [db:gtc-saccharom keggfc:8.1] |
| CONTIG1666 | 14531286_f2_3 | 3109 | 17212 | 303 | 101 | YIL155C | 107 | 4.0(10)-5 | Saccharomyces cerevisiae | [ui:yil155c] [pn:glycerol-3-phosphate dehydrogenase, mitochondrial:glycerol-3-phosphate dehydrogenase mitochondrial precursor:gpd-m:gpdh-m] [gn:gut2] [gtcfc:1.1.2.8:8.1] [ec:1.1.99.5] [sgdfc:1.5.1.9.7.0] [db:gtc-saccharom keggfc:8.1] |
| CONTIG5150 | 13682650_c3_14 | 3110 | 17213 | 390 | 130 | YIL155C | 239 | 2.7(10)-19 | Saccharomyces cerevisiae | [ui:yil155c] [pn:glycerol-3-phosphate dehydrogenase, mitochondrial:glycerol-3-phosphate dehydrogenase mitochondrial precursor:gpd-m:gpdh-m] [gn:gut2] [gtcfc:1.1.2.8:8.1] [ec:1.1.99.5] [sgdfc:1.5.1.9.7.0] [db:gtc-saccharom keggfc:8.1] |
| CONTIG5150 | 4798162_c2_12 | 3111 | 17214 | 597 | 199 | YIL155C | 433 | 1.3(10)-40 | Saccharomyces cerevisiae | [ui:yil155c] [pn:glycerol-3-phosphate dehydrogenase, mitochondrial:glycerol-3-phosphate dehydrogenase mitochondrial precursor:gpd-m:gpdh-m] [gn:gut2] [gtcfc:1.1.2.8:8.1] [ec:1.1.99.5] [sgdfc:1.5.1.9.7.0] [db:gtc-saccharom keggfc:8.1] |
| CONTIG5555 | 3328437_f1_2 | 3112 | 17215 | 2313 | 771 | YIL125W | 2906 | 0 | Saccharomyces cerevisiae | [ui:yil125w] [pn:2-oxoglutarate dehydrogenase complex e1 component:2-oxoglutarate dehydrogenase e1 component precursor:alpha-ketoglutarate dehydrogenase] [gn:kgd1] [gtcfc:1.1.1.2:2.8:5.14:5.9] [ec:1.2.4.2] [keggfc:1.2:5.9:5.14] [sgdf |
| CONTIG5555 | 10628761_f1_3 | 3113 | 17216 | 681 | 227 | YIL125W | 833 | 3.2(10)-83 | Saccharomyces cerevisiae | [ui:yil125w] [pn:2-oxoglutarate dehydrogenase complex e1 component:2-oxoglutarate dehydrogenase e1 component precursor:alpha-ketoglutarate dehydrogenase] [gn:kgd1] [gtcfc:1.1.1.2:2.8:5.14:5.9] [ec:1.2.4.2] [keggfc:1.2:5.9:5.14] [sgdf] |
| CONTIG5034 | 14532806_c1_9 | 3114 | 17217 | 930 | 310 | YIL124W | 448 | 2.0(10)-42 | Saccharomyces cerevisiae | [ui:yil124w] [pn:similarity to c. perfringens nanh protein:hypothetical oxidoreductase in kgd1-sim1 intergenic region] [gtcfc:1.1] [ec:1.-.-.-] [keggfc:14.1] [sgdfc:1.5.1] [db:gtc-saccharomyces cerevisiae] |
| CONTIG5649 | 12691892_f1_1 | 3115 | 17218 | 978 | 326 | YIL124W | 411 | 1.7(10)-38 | Saccharomyces cerevisiae | [ui:yil124w] [pn:similarity to c. perfringens nanh protein:hypothetical oxidoreductase in kgd1-sim1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5652 | 954401_c3_31 | 3116 | 17219 | 909 | 303 | YIL124W | 695 | 1.3(10)-68 | Saccharomyces cerevisiae | intergenic region] [gtcfc:1.1] [ec:1.-.-.-] [keggfc:14.1] [sgdfc:15.1] [dbgtc-saccharomyces cerevisiae [ui:yil124w] [pn:similarity to c. perfringens nanh protein:hypothetical oxidoreductase in kgd1-sim1 |
| CONTIG838 | 4069012_c2_1 | 3117 | 17220 | 378 | 126 | YIL124W | 135 | 1.0(10)-8 | Saccharomyces cerevisiae | intergenic region] [gtcfc:1.1] [ec:1.-.-.-] [keggfc:14.1] [sgdfc:15.1] [dbgtc-saccharomyces cerevisiae [ui:yil124w] [pn:similarity to c. perfringens nanh protein:hypothetical oxidoreductase in kgd1-sim1 intergenic region] [gtcfc:1.1] [ec:1.-.-.-] [keggfc:14.1] [sgdfc:15.1] [dbgtc-saccharomyces cerevisiae |
| b9x12k34.x | 214513_f3_1 | 3118 | 17221 | 612 | 204 | YIL099W | 203 | 1.5(10)-15 | Saccharomyces cerevisiae | [ui:yil099w] [pn:sporulation specific glucan 1,4-alpha-glucosidase:glucoamylase, intracellular sporulation-specific:glucan 1,4-alpha-glucosidase:1,4-alpha-d-glucang[ucohydrolase] [gn:sga1:sga1] [gtcfc:1.1:7.2: 12.15.12.16] [ec:3.2.1.3] |
| CONTIG4840 | 23673437_f3_7 | 3119 | 17222 | 843 | 281 | YIL053W | 605 | 4.5(10)-59 | Saccharomyces cerevisiae | [ui:yil053w] [pn:dl-glycerol phosphatase:glycerol-3-phosphatase 1] [gn:gpp1:rhr2] [gtcfc: 1.1:7.1:9.1:9.3:9.4] [ec:3.1.3.-] [keggfc:4.4.9.1.9.3:9.4] [sgdfc:15.1] [dbgtc-saccharomyces cerevisiae |
| CONTIG3128 | 31649166_c3_2 | 3120 | 17223 | 684 | 228 | YIL014W | 103 | 0.00749 | Saccharomyces cerevisiae | [ui:yil014w] [pn:similarity to mnn1p:hypothetical 72.4 kd protein in bar1-pdr11 intergenic region] [gtcfc:1.1:5.7:1.8.5:10.7:11.3:11.4] [ec:2.4.1.-] [keggfc:1.5:7.2:7.3:8.5] [sgdfc:1.5.1:6.3.0] [dbgtc-saccharomyces cerevisiae |
| CONTIG3805 | 36142267_f1_1 | 3121 | 17224 | 405 | 135 | YIL014W | 126 | 3.6(10)-7 | Saccharomyces cerevisiae | [ui:yil014w] [pn:similarity to mnn1p:hypothetical 72.4 kd protein in bar1-pdr11 intergenic region] [gtcfc:1.1:5.7:1.8.5:10.7:11.3:11.4] [ec:2.4.1.-] [keggfc:1.5:7.2:7.3:8.5] [sgdfc:1.5.1:6.3.0] [dbgtc-saccharomyces cerevisiae |
| CONTIG5133 | 3308155_c3_10 | 3122 | 17225 | 1170 | 390 | YIL014W | 312 | 3.8(10)-33 | Saccharomyces cerevisiae | [ui:yil014w] [pn:similarity to mnn1p:hypothetical 72.4 kd protein in bar1-pdr11 intergenic region] [gtcfc:1.1:5.7:1.8.5:10.7:11.3:11.4] [ec:2.4.1.-] [keggfc:1.5:7.2:7.3:8.5] [sgdfc:1.5.1:6.3.0] [dbgtc-saccharomyces cerevisiae |
| CONTIG2354 | 10042502_c1_4 | 3123 | 17226 | 576 | 192 | YIR019C | 99 | 0.04 | Saccharomyces cerevisiae | [ui:yir019c] [pn:extracellular alpha-1,4-glucan glucosidase:glucoamylase s1/s2 precursor:glucan 1,4-alpha- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2436 | 19615942_f3_2 | 3124 | 17227 | 1386 | 462 | YIR019C | 191 | 1.0(10)-11 | Saccharomyces cerevisiae | glucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: [ui:yir019c] [pn:extracellular alpha-1,4-glucan glucoamylase s1/s2 precursor:glucan 1,4-alphaglucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: |
| CONTIG3786 | 4688136_f1_1 | 3125 | 17228 | 1665 | 555 | YIR019C | 124 | 0.00055 | Saccharomyces cerevisiae | [ui:yir019c] [pn:extracellular alpha-1,4-glucan glucoamylase s1/s2 precursor:glucan 1,4-alphaglucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: |
| CONTIG5196 | 24328150_f1_3 | 3126 | 17229 | 966 | 322 | YIR019C | 103 | 0.02999 | Saccharomyces cerevisiae | [ui:yir019c] [pn:extracellular alpha-1,4-glucan glucoamylase s1/s2 precursor:glucan 1,4-alphaglucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: |
| CONTIG5526 | 35604642_f2_3 | 3127 | 17230 | 1800 | 600 | YIR019C | 117 | 0.00289 | Saccharomyces cerevisiae | [ui:yir019c] [pn:extracellular alpha-1,4-glucan glucoamylase s1/s2 precursor:glucan 1,4-alphaglucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: |
| CONTIG2924 | 26688474_c1_6 | 3128 | 17231 | 2460 | 820 | YIR019C | 134 | 4.9(10)-5 | Saccharomyces cerevisiae | [ui:yir019c] [pn:extracellular alpha-1,4-glucan glucoamylase s1/s2 precursor:glucan 1,4-alphaglucosidase:1,4-alpha-d-glucan glucohydrolase] [gn:sta1sta2:mal5] [gtcfc:1.1:7.2] [ec:3.2.1.3] [keggfc:7.1] [sgdfc:1.5.1] [db: |
| CONTIG1145 | 13866412_c1_3 | 3129 | 17232 | 444 | 148 | YIL216C | 221 | 1.8(10)-17 | Saccharomyces cerevisiae | [ui:yjl216c] [pn:strong similarity to mal62p:probable alpha-glucosidase yjl216c:maltase] [gn:j0228:hrf581] [gtcfc:1.1.1.6:7.1:7.2] [ec:3.2.1.20] [keggfc:1.6:7.1] [sgdfc:1.5.1:2.7.0] [db:gtc-saccharomyces cerevisiae] |
| CONTIG5760 | 11724137_c1_27 | 3130 | 17233 | 945 | 315 | YJL155C | 859 | 5.5(10)-86 | Saccharomyces cerevisiae | [ui:yjl155c] [pn:fructose-2,6-bisphosphatase] [gn:fbp26:j0575] [gtcfc:1.1.5.12.13] [ec:3.1.3.46] keggfc:1.5 [sgdfc:1.5.1.1.5.2:9.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5812 | 550051_f2_10 | 3131 | 17234 | 1578 | 526 | YJL153C | 1722 | 2.0(10)-177 | Saccharomyces cerevisiae | [ui:yjl153c] [pn:myo-inositol-1-phosphate synthase;ips] [gn:inol;j0610] [gtcfc:1.18.2] [ec:5.5.1.4] [keggfc:8.2] [sgdfc:1.5.1:9.2.0] [db:gtc-saccharomyces cerevisiae] |
| CONTIG4143 | 14453192_c1_3 | 3132 | 17235 | 1170 | 390 | YJL137C | 316 | 1.8(10)-28 | Saccharomyces cerevisiae | [ui:yjl137c] [pn:self-glucosylating initiator of glycogen synthesis;glycogen synthesis initiator protein glg2] [gn:glg2;j0663] [gtcfc:1.1:7.1:7.2] [keggfc:14.2] [sgdfc:1.5.1:2.7.0] [db:gtc-saccharomyces cerevisiae] |
| b9x10p49.y | 14851563_c3_2 | 3133 | 17236 | 630 | 210 | YJL137C | 251 | 1.8(10)-21 | Saccharomyces cerevisiae | [ui:yjl137c] [pn:self-glucosylating initiator of glycogen synthesis;glycogen synthesis initiator protein glg2] [gn:glg2;j0663] [gtcfc:1.1:7.1:7.2] [keggfc:14.2] [sgdfc:1.5.1:2.7.0] [db:gtc-saccharomyces cerevisiae] |
| CONTIG4913 | 31515787_c3_10 | 3134 | 17237 | 795 | 265 | YJL121C | 780 | 1.3(10)-77 | Saccharomyces cerevisiae | [ui:yjl121c] [pn:d-ribulose-5-phosphate 3-epimerase;ribulose-phosphate 3-epimerase;ppe:rpe] [gn:pos18:rpe1;j0731] [gtcfc:1.1.1.3:1.4:2.4] [ec:5.1.3.1] [keggfc:1.3:1.4:2.3] [sgdfc:1.5.1:2.3.0] [db:gtc-s |
| b1x19409.y | 1431686_f1_1 | 3135 | 17238 | 648 | 216 | YJL099W | 151 | 9.5(10)-10 | Saccharomyces cerevisiae | [ui:yjl099w] [pn:chitin biosynthesis protein-;chitin biosynthesis protein chs6;csd3 protein] [gn:chs6:csd3;j0838] [gtcfc:11.4:7.2] [keggfc:14.2] [sgdfc:1.5.1] [db:gtc-saccharomyces cerevisiae] |
| CONTIG593 | 553442_c1_1 | 3136 | 17239 | 828 | 276 | YJL002C | 404 | 9.1(10)-38 | Saccharomyces cerevisiae | [ui:yjl002c] [pn:oligosaccharyltransferase, alpha subunit:dolichyl-diphosphooligosaccharide--protein glycosyltransferase alpha subunit precursor:oligosaccharyl transferase alpha subunit:o-ligosaccharyl transferase 64 kd subunit] [gn:ost |
| CONTIG1556 | 25593818_f3_1 | 3137 | 17240 | 732 | 244 | YJR075W | 644 | 3.3(10)-63 | Saccharomyces cerevisiae | [ui:yjr075w] [pn:suppressor of pkel:hypothetical 46.3 kd protein in pem2-cdc11 intergenic region precursor] [gn:hoc1;j1830] [gtcfc:1.1:10.7:12.8] [keggfc:14.2] [sgdfc:1.5.1.3.1.0:3.2.0:6.3.0] [db:gtc-saccharomyces cerevisiae] |
| CONTIG1933 | 10972806_c2_3 | 3138 | 17241 | 774 | 258 | YJR096W | 514 | 2.0(10)-49 | Saccharomyces cerevisiae | [ui:yjr096w] [pn:similarity to corynebacterium 2,5-diketo-d-gluconic acid reductase and aldehyde reductases:hypothetical 32.3 kd protein in acr1-yuh1 intergenic region] [gn:j1926] [gtcfc:1.1] [keggfc:14.2] [sgdfc:1.5.1] [db:gtc-saccha |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3185 | 24846062_f2_1 | 3139 | 17242 | 474 | 158 | YJR096W | 490 | 7.0(10)-47 | Saccharomyces cerevisiae | [ui:yjr096w] [pn:similarity to corynebacterium 2,5-diketo-d-gluconic acid reductase and aldehyde reductases:hypothetical 32.3 kd protein in acr1-yuh1 intergenic region] [gn:j1926] [gtcfc:1.1] [keggfc:14.2] [sgdfc:1.5.1] [db:gtc-saccha |
| CONTIG3374 | 4188388_c2_6 | 3140 | 17243 | 789 | 263 | YJR131W | 419 | 2.3(10)-39 | Saccharomyces cerevisiae | [ui:yjr131w] [pn:alpha1,2-mannosidase:mannosyl-oligosaccharide alpha-1,2-mannosidase:man-9-alpha-mannosidase] [gn:mns1;j2110] [gtcfc:1.1.4.3;7.1;10.7;11.3;12.16] [keg-gfc:7.4] [sgdfc:1.5.1.6.3;0-9.4.0] [db:gtc-saccharomyces cer |
| CONTIG3374 | 24039035_c2_5 | 3141 | 17244 | 972 | 324 | YJR131W | 634 | 3.8(10)-62 | Saccharomyces cerevisiae | [ui:yjr131w] [pn:alpha1,2-mannosidase:mannosyl-oligosaccharide alpha-1,2-mannosidase:man-9-alpha-mannosidase] [gn:mns1;j2110] [gtcfc:1.1.4.3;7.1;10.7;11.3;12.16] [keg-gfc:7.4] [sgdfc:1.5.1.6.3;0-9.4.0] [db:gtc-saccharomyces cer |
| CONTIG1648 | 25672158_c3_3 | 3142 | 17245 | 1005 | 335 | YJR143C | 909 | 2.7(10)-91 | Saccharomyces cerevisiae | [ui:yjr143c] [pn:dolichyl-phosphate-mannose--protein o-mannosyl transferase:dolichyl-phosphate-mannose--protein mannosyltransferase 4] [gn:pmt4;j2176] [gtcfc:1.1;7.1;10.7;11.3;12.16] [ec:2.4.1.109] [keggfc:7.2] [sgdfc:1.5.1.6.3;0-9.4. |
| CONTIG899 | 22265693_c1_3 | 3143 | 17246 | 840 | 280 | YJR143C | 594 | 6.7(10)-58 | Saccharomyces cerevisiae | [ui:yjr143c] [pn:dolichyl-phosphate-mannose--protein o-mannosyl transferase:dolichyl-phosphate-mannose--protein mannosyltransferase 4] [gn:pmt4;j2176] [gtcfc:1.1;7.1;10.7;11.3;12.16] [ec:2.4.1.109] [keggfc:7.2] [sgdfc:1.5.1.6.3;0-9.4. |
| CONTIG1855 | 30111090_c2_6 | 3144 | 17247 | 1056 | 352 | YKL148C | 1183 | 2.6(10)-120 | Saccharomyces cerevisiae | [ui:ykl148c] [pn:succinate dehydrogenase flavoprotein precursor:succinate dehydrogenase:ubiquinone flavoprotein subunit precursor:flavoprotein subunit of complex ii] [gn:sdh1;sdha;ykl602] [gtcfc:1.1.1.2.9.12] [keg-ykl602] [gtc |
| CONTIG4678 | 4335002_c1_7 | 3145 | 17248 | 1239 | 413 | YKL148C | 1629 | 1.3(10)-167 | Saccharomyces cerevisiae | [ui:ykl148c] [pn:succinate dehydrogenase flavoprotein precursor:succinate dehydrogenase: gfc:1.5:2.15.3:5. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4990 | 14072152_c1_10 | 3146 | 17249 | 744 | 248 | YKL148C | 901 | $2.0(10)^{-90}$ | Saccharomyces cerevisiae | ubiquinone flavoprotein subunit precursor:f-p:flavoprotein subunit of complex ii) [gn:sdh1:sdha: ykl602] [gtcfc:1.1.1.2:9.12] [keg-gtc:1.5:2.15.3:5. [ui:ykl148c] [pn:succinate dehydrogenase flavoprotein precursor:succinate dehydroge-nase: |
| CONTIG3744 | 1448762_c2_6 | 3147 | 17250 | 1464 | 488 | YKL104C | 1631 | $8.6(10)^{-168}$ | Saccharomyces cerevisiae | ubiquinone flavoprotein subunit precursor:f-p:flavoprotein subunit of complex ii) [gn:sdh1:sdha: ykl602] [gtcfc:1.1.1.2:9.12] [keg-gtc:1.5:2.15.3:5. [ui:ykl104c] [pn:glucosamine--fructose-6-phosphate transaminase:glucosamine--fruc-tose-6-phosphate aminotransferase:isomerizing-:hexosephosphate aminotransferase:d-fruc-tose-6-phosphate amidotransferase:gfat] [gn:gfa1:ykl457] |
| CONTIG2790 | 35400277_c2_8 | 3148 | 17251 | 207 | 69 | YKL104C | 196 | $1.3(10)^{-14}$ | Saccharomyces cerevisiae | [ui:ykl104c] [pn:glucosamine--fructose-6-phosphate transaminase:glucosamine--fruc-tose-6-phosphate aminotransferase:isomerizing-:hexosephosphate aminotransferase:d-fruc-tose-6-phosphate amidotransferase:gfat] [gn:gfa1:ykl457] [gtcfc:1.1:] |
| CONTIG3300 | 7070312_f3_5 | 3149 | 17252 | 1029 | 343 | YKL085W | 768 | $2.5(10)^{-76}$ | Saccharomyces cerevisiae | [ui:ykl085w] [pn:malate dehydrogenase precursor, mitochondrial:malate dehydroge-nase, mitochondrial precursor] [gn:mdh1] [gtcfc:1.1.1.37] [keggfc:1.2:1.8:1.9:2.4:2.5:2.8] [ec:1.1.1.37] [keggfc:1.2:1.8:1.9.2.3:2.4] [sgdfc:1.5.1:2.8.0:9.7.0] [db:gtc-s |
| CONTIG4726 | 156500_c3_7 | 3150 | 17253 | 1077 | 359 | YKL085W | 764 | $6.5(10)^{-76}$ | Saccharomyces cerevisiae | [ui:ykl085w] [pn:malate dehydrogenase precursor, mitochondrial:malate dehydroge-nase, mitochondrial precursor] [gn:mdh1] [gtcfc:1.1.1.37] [keggfc:1.2:1.8:1.9.2.3:2.4] [ec:1.1.1.37] [keggfc:1.2:1.8:1.9.2.3:2.4] [sgdfc:1.5.1:2.8.0:9.7.0] [db:gtc-s |
| CONTIG5378 | 9775312_c2_13 | 3151 | 17254 | 1002 | 334 | YKL085W | 1007 | $1.2(10)^{-101}$ | Saccharomyces cerevisiae | [ui:ykl085w] [pn:malate dehydrogenase precursor, mitochondrial:malate dehydroge-nase, mitochondrial precursor] [gn:mdh1] [gtcfc:1.1.1.37] [keggfc:1.2:1.8:1.9.2.3:2.4] [ec:1.1.1.37] [keggfc:1.2:1.8:1.9.2.3:2.4] [sgdfc:1.5.1:2.8.0:9.7.0] [db:gtc-s |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1698 | 16804630_f3_1 | 3152 | 17255 | 507 | 169 | YKL035W | 747 | 4.0(10)-74 | Saccharomyces cerevisiae | [ui:ykl035w] [pn:utp-glucose-1-phosphate uridylyltransferase:probable utp--glucose-1-phosphate uridylyltransferase:udp-glucose pyrophosphorylase:udpgp] [gn:ugp1:ykl248] [gtcfc:1.1.4: 1.6.4.3:7.1:7.2:10.7] [ec:2.7.7.9] [keggfc:1.1.4:. |
| CONTIG3835 | 24031308_c1_4 | 3153 | 17256 | 255 | 85 | YKL035W | 228 | 2.2(10)-18 | Saccharomyces cerevisiae | [ui:ykl035w] [pn:utp-glucose-1-phosphate uridylyltransferase:probable utp--glucose-1-phosphate uridylyltransferase:udp-glucose pyrophosphorylase:udpgp] [gn:ugp1:ykl248] [gtcfc:1.1.4: 1.6.4.3:7.1:7.2:10.7] [ec:2.7.7.9] [keggfc:1.1.4:. |
| b2x18129.x | 2110413_f1_1 | 3154 | 17257 | 510 | 170 | YKL035W | 660 | 6.9(10)-65 | Saccharomyces cerevisiae | [ui:ykl035w] [pn:utp-glucose-1-phosphate uridylyltransferase:probable utp--glucose-1-phosphate uridylyltransferase:udp-glucose pyrophosphorylase:udpgp] [gn:ugp1:ykl248] [gtcfc:1.1.4: 1.6.4.3:7.1:7.2:10.7] [ec:2.7.7.9] [keggfc:1.1.4:. |
| CONTIG114 | 589582_f2_2 | 3155 | 17258 | 615 | 205 | YKR096W | 110 | 4.0(10)-5 | Saccharomyces cerevisiae | [ui:ykr096w] [pn:similarity to mitochondrial aldehyde dehydrogenase ald1p:hypothetical 137.5 kd protein in mpl1-ppc1 intergenic region] [gtcfc:1.1.2.2] [keggfc:14.2] [sgdfc:1.5.1: 2.6.0] [db:gtc-saccharomyces cerevisiae] |
| CONTIG2645 | 34062765_c1_3 | 3156 | 17259 | 477 | 159 | YKR096W | 167 | 4.5(10)-14 | Saccharomyces cerevisiae | [ui:ykr096w] [pn:similarity to mitochondrial aldehyde dehydrogenase ald1p:hypothetical 137.5 kd protein in mpl1-ppc1 intergenic region] [gtcfc:1.1.2.2] [keggfc:14.2] [sgdfc:1.5.1: 2.6.0] [db:gtc-saccharomyces cerevisiae] |
| CONTIG4305 | 33207500_c2_6 | 3157 | 17260 | 1293 | 431 | YKR096W | 402 | 1.5(10)-38 | Saccharomyces cerevisiae | [ui:ykr096w] [pn:similarity to mitochondrial aldehyde dehydrogenase ald1p:hypothetical 137.5 kd protein in mpl1-ppc1 intergenic region] [gtcfc:1.1.2.2] [keggfc:14.2] [sgdfc:1.5.1: 2.6.0] [db:gtc-saccharomyces cerevisiae] |
| CONTIG525 | 5084437_f3_1 | 3158 | 17261 | 843 | 281 | YKR096W | 132 | 1.5(10)-5 | Saccharomyces cerevisiae | [ui:ykr096w] [pn:similarity to mitochondrial aldehyde dehydrogenase ald1p:hypothetical 137.5 kd protein in mpl1-ppc1 intergenic region] [gtcfc:1.1.2.2] [keggfc:14.2] [sgdfc:1.5.1: 2.6.0] [db:gtc-saccharomyces cerevisiae] |
| CONTIG5031 | 1968761_c3_7 | 3159 | 17262 | 591 | 197 | YLR174W | 694 | 1.7(10)-68 | Saccharomyces cerevisiae | [ui:ylr174w] [pn:isocitrate dehydrogenase, cytosolic:isocitrate dehydrogenase:nadp cytoplasmic: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | oxalosuccinate decarboxylase:idh:nadp+-specific icdh:idp] [gn:idp2:19470] [gtcfc:1.1.1.2;2.5.6.16] [ec:1.1.1.42] [keggfc:1.2.2.4;6.9] [sgdf |
| CONTIG5812 | 4788275_c3_33 | 3160 | 17263 | 921 | 307 | YLR286C | 867 | 8.0(10)-87 | Saccharomyces cerevisiae | [ui:ylr286c] [pn:endochitinase precursor] [gn:cts1:18003] [gtcfc:11.4: 7.2] [ec:3.2.1.14] [keggfc:4.4] [sgdfc:1.5.1.3.9.0] [db:gtc-saccharomyces cerevisiae] |
| CONTIG5786 | 20954511_f2_9 | 3161 | 17264 | 1296 | 432 | YLR300W | 1277 | 2.7(10)-130 | Saccharomyces cerevisiae | [ui:ylr300w] [pn:exo-beta-1,3-glucanase:i/ii, major isoform:glucan 1,3-beta-glucosidase i/ii precursor:exo-1,3-beta-glucanase i/ii] [gn-:exgl:18003] [gtcfc:1.1.12.15:12.8.12.9] [ec:3.2.1.58] |
| CONTIG4035 | 33699013_c3_11 | 3162 | 17265 | 1167 | 389 | YLR304C | 1478 | 1.3(10)-151 | Saccharomyces cerevisiae | [keggfc:14.1] [sgdfc:1.5.1.3.1.0:3.3.0:3.4. [ui:ylr304c] [pn:aconitate hydratase:aconitate hydratase, mitochondrial precursor-:citrate hydro-lyase:aconitase] [gn:acol:glu1:18003] [gtcfc:1.1.1.2:1.9.2.5:2.8] [ec:4.2.1.3] [keggfc:1.2:1.9.2.4] [sgdfc:1.5.1.2.4.0:9.7.0] [db:gtc-sacc] |
| CONTIG5600 | 22453250_c2_22 | 3163 | 17266 | 1278 | 426 | YLR304C | 1732 | 1.7(10)-178 | Saccharomyces cerevisiae | [ui:ylr304c] [pn:aconitate hydratase:aconitate hydratase, mitochondrial precursor-:citrate hydro-lyase:aconitase] [gn:acol:glu1:18003] [gtcfc:1.1.1.2:1.9.2.5:2.8] [ec:4.2.1.3] [keggfc:1.2:1.9.2.4] [sgdfc:1.5.1.2.4.0:9.7.0] [db:gtc-sacc] |
| CONTIG4536 | 22286518_f3_5 | 3164 | 17267 | 1224 | 408 | YLR308W | 647 | 1.6(10)-63 | Saccharomyces cerevisiae | [ui:ylr308w] [pn:sporulation-specific chitin deacetylase] [gn:cda2] [gtcfc: 12.15:11.4:7.2] [deggfc:14.2] [sgdfc:1.5.1.3.4.0] [db:gtc-saccharomyces cerevisiae] |
| CONTIG4773 | 24297055_c3_10 | 3165 | 17268 | 1689 | 563 | YLR342W | 2594 | 7.7(10)-270 | Saccharomyces cerevisiae | [ui:ylr342w] [pn:1,3-beta-d-glucan synthase, catalytic subunit:1,3-beta-glucan synthase component gls1:1,3-beta-d-glucan-udp glucosyltransferase:cnd1 protein:cwn53 protein:fks1 protein: papulacandin b sensitivity protein 1] |
| CONTIG5533 | 20395001_c1_7 | 3166 | 17269 | 1185 | 395 | YML086C | 1011 | 4.4(10)-102 | Saccharomyces cerevisiae | [gn:gls1:cn [ui:yml086c] [pn:d-arabinono-1,4-lactone oxidase:alo:1-galactonolactone oxidase:1-xylono-1,4-lactone oxidase] [gn:alo] [keggfc:4.3] [ec:1.1.3.24] [sgdfc:1.5.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1090 | 36132942_f2_1 | 3167 | 17270 | 351 | 117 | YML054C | 323 | 1.6(10)-28 | Saccharomyces cerevisiae | [ui:yml054c] [pn:lactate dehydrogenase cytochrome b2:cytochrome b2 precursor:1-lactate dehydrogenase:cytochrome:1-lactate ferri-cytochrome c oxidoreductase:1-lcr] [gn:cyb2:ym9958] [gtcfc:1.1:1.8:2.8] [ec:1.1.2.3] [keggfc:1.8] [sgdfc:1. |
| blx17434.y | 20566405_f2_1 | 3168 | 17271 | 612 | 204 | YML054C | 462 | 6.5(10)-44 | Saccharomyces cerevisiae | [ui:yml054c] [pn:lactate dehydrogenase cytochrome b2:cytochrome b2 precursor:1-lactate dehydrogenase:cytochrome:1-lactate ferri-cytochrome c oxidoreductase:1-lcr] [gn:cyb2:ym9958] [gtcfc:1.1:1.8:2.8] [ec:1.1.2.3] [keggfc:1.8] [sgdfc:1. |
| CONTIG5466 | 36367167_c1_10 | 3169 | 17272 | 2241 | 747 | YMR261C | 1328 | 4.5(10)-165 | Saccharomyces cerevisiae | [ui:ymr261c] [pn:alpha,alpha-trehalose-phosphate synthase, 115 kd subunit:alpha, alpha-trehalose-phosphate synthase:udp- forming 115 kd subunit:trehalose-6-phosphate synthase:udp-glucose-glucosephosphate glucosyltransferase] [gn:tps3:y |
| CONTIG5308 | 34079140_f3_5 | 3170 | 17273 | 1641 | 547 | YMR278W | 946 | 8.6(10)-102 | Saccharomyces cerevisiae | [ui:ymr278w] [pn:similarity to phosphomannomutases] [gtcfc:1.1] [keggfc:14.2] [sgdfc:1.5.1] [db:gtc-saccharomyces cerevisiae] |
| blx15395.x | 165937_c3_2 | 3171 | 17274 | 612 | 204 | YMR306W | 492 | 1.5(10)-45 | Saccharomyces cerevisiae | [ui:ymr306w] [pn:similarity to 1,3-beta-glucan synthases] [gtcfc:1.1] [keggfc:14.2] [sgdfc:1.5.1] [db:gtc-saccharomyces cerevisiae] |
| CONTIG4903 | 3381880_c3_8 | 3172 | 17275 | 1089 | 363 | YMR318C | 704 | 1.5(10)-69 | Saccharomyces cerevisiae | [ui:ymr318c] [pn:similarity to alcohol-dehydrogenase] [gtcfc:1.1:2.2] [keggfc:14.2] [sgdfc:1.5.1:2.6.0] [db:gtc-saccharomyces cerevisiae] |
| CONTIG1076 | 213538_f1_1 | 3173 | 17276 | 1149 | 383 | YNL283C | 122 | 7.0(10)-7 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG2028 | 12236555_f2_1 | 3174 | 17277 | 1839 | 613 | YNL283C | 105 | 0.00559 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG243 | 25627043_f1_1 | 3175 | 17278 | 477 | 159 | YNL283C | 91 | 0.0061 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG4673 | 3907182_c2_9 | 3176 | 17279 | 435 | 145 | YNL283C | 203 | 1.2(10)-15 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG4971 | 24609436_f3_4 | 3177 | 17280 | 1182 | 394 | YNL283C | 102 | 0.00889 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG5359 | 22366063_c1_11 | 3178 | 17281 | 1824 | 608 | YNL283C | 110 | 0.0032 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG5420 | 26834811_f1_3 | 3179 | 17282 | 2226 | 742 | YNL283C | 101 | 0.047 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG5597 | 26285926_c3_20 | 3180 | 17283 | 1125 | 375 | YNL283C | 112 | 0.00064 | Saccharomyces cerevisiae | [ui:ynl283c] [pn:glucoamylase iii:alpha-1,4-glucan-glucosidase:hypothetical 52.3 kd protein in mrpl10-erg24 intergenic region precursor] [gn:n0583] [gtcfc:1.1] [keggfc:14.2] [sgdfc:1.5.1] [db:gtc-saccharomyces cerevisiae] |
| CONTIG4516 | 4897181_c1_7 | 3181 | 17284 | 1059 | 353 | YNL274C | 849 | 6.4(10)-85 | Saccharomyces cerevisiae | [ui:ynl274c] [pn:similarity to glycerate- and formate-dehydrogenases:hypothetical 38.8 kd protein in met2-sec2 intergenic region] [gn:n0631] [gtcfc:1.1] [keggfc:14.2] [sgdfc:1.5.1] [db:gtc-saccharomyces cerevisiae] |
| CONTIG4829 | 4328177_f2_3 | 3182 | 17285 | 501 | 167 | YNL274C | 308 | 1.3(10)-27 | Saccharomyces cerevisiae | [ui:ynl274c] [pn:similarity to glycerate- and formate-dehydrogenases:hypothetical 38.8 kd protein in |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4829 | 1069078_f2_4 | 3183 | 17286 | 492 | 164 | YNL274C | 457 | 2.2(10)-43 | Saccharomyces cerevisiae | met2-sec2 intergenic region] [gn:n0631] [gtcfc:1.1] [keggfc:14.2] [sgdfc:1.5.1] [db:gtc-saccharomyces cerevisiae] [ui:ynl274c] [pn:similarity to glycerate- and formate-dehydrogenases:hypothetical 38.8 kd protein in |
| CONTIG5786 | 9938825_c2_27 | 3184 | 17287 | 1095 | 365 | YNL274C | 889 | 3.7(10)-89 | Saccharomyces cerevisiae | met2-sec2 intergenic region] [gn:n0631] [gtcfc:1.1] [keggfc:14.2] [sgdfc:1.5.1] [db:gtc-saccharomyces cerevisiae] [ui:ynl274c] [pn:similarity to glycerate- and formate-dehydrogenases:hypothetical 38.8 kd protein in met2-sec2 intergenic region] [gn:n0631] [gtcfc:1.1] [keggfc:14.2] [sgdfc:1.5.1] [db:gtc-saccharomyces cerevisiae] |
| CONTIG4392 | 50906_c3_10 | 3185 | 17288 | 744 | 248 | YNL241C | 617 | 2.5(10)-60 | Saccharomyces cerevisiae | [ui:ynl241c] [pn:glucose-6-phosphate dehydrogenase:glucose-6-phosphate 1-dehydrogenase:g6pd] [gn:zwf1:met19:n1110] [gtcfc:1.1.1.3:6.16] [ec:1.1.1.49] [keggfc:1.3:6.9] [sgdfc:1.5.1:2.3.0: 9.2.0] [db:gtc-saccharomyces cerevisiae] |
| b9x10k86.y | 23725010_c1_2 | 3186 | 17289 | 243 | 81 | YNL241C | 226 | 4.0(10)-18 | Saccharomyces cerevisiae | [ui:ynl241c] [pn:glucose-6-phosphate dehydrogenase:glucose-6-phosphate 1-dehydrogenase:g6pd] [gn:zwf1:met19:n1110] [gtcfc:1.1.1.3:6.16] [ec:1.1.1.49] [keggfc:1.3:6.9] [sgdfc:1.5.1:2.3.0: 9.2.0] [db:gtc-saccharomyces cerevisiae] |
| b9x10k86.y | 14116439_c1_1 | 3187 | 17290 | 210 | 70 | YNL241C | 226 | 4.0(10)-18 | Saccharomyces cerevisiae | [ui:ynl241c] [pn:glucose-6-phosphate dehydrogenase:glucose-6-phosphate 1-dehydrogenase:g6pd] [gn:zwf1:met19:n1110] [gtcfc:1.1.1.3:6.16] [ec:1.1.1.49] [keggfc:1.3:6.9] [sgdfc:1.5.1:2.3.0: 9.2.0] [db:gtc-saccharomyces cerevisiae] |
| CONTIG765 | 4345332_f3_2 | 3188 | 17291 | 333 | 111 | YNL219C | 119 | 1.7(10)-6 | Saccharomyces cerevisiae | [ui:ynl219c] [pn:mannosyltransferase:hypothetical 63.8 kd protein in ade12-rap1 intergenic region] [gn:alg9:n1295] [gtcfc:1.1.3.4:8.1:8.2] [keggfc:14.2] [sgdfc:1.5.1:1.6.1] [db:gtc-saccharomyces cerevisiae] |
| CONTIG2407 | 11883593_f3_3 | 3189 | 17292 | 1002 | 334 | YNL192W | 771 | 3.0(10)-76 | Saccharomyces cerevisiae | [ui:ynl192w] [pn:chitin synthase i:chitin synthase 1:chitin-udp acetyl-glucosaminyl transferase 1] [gn:chs1:n1404] [gtcfc:11.4:7.2] [ec:2.4.1.16] [keggfc:4.4] [sgdfc:1.5.1:3.3.0:3.4.0:3.9.0:9.1.0: 9.9.0] [db:gtc-saccharomyces cerevisiae] |
| CONTIG605 | 24417067_f3_1 | 3190 | 17293 | 342 | 114 | YNL192W | 150 | 2.1(10)-9 | Saccharomyces cerevisiae | [ui:ynl192w] [pn:chitin synthase i:chitin synthase 1:chitin-udp acetyl-glucosaminyl transferase 1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG933 | 782035_c3_5 | 3191 | 17294 | 867 | 289 | YNL192W | 172 | 1.3(10)-10 | Saccharomyces cerevisiae | [ui:ynl192w][pn:chitin synthase i:chitin synthase 1:chitin-udp acetyl-glucosaminyl transferase 1][gn:chs1:n1404][gtcfc:11.4:7.2][ec:2.4.1.16][keggfc:4.4][sgdfc:1.5.1.3.3.0:3.4.0:3.9.0:9.1.0:9.9.0][db:gtc-saccharomyces cerevisia |
| CONTIG5805 | 882825_c3_40 | 3192 | 17295 | 888 | 296 | YNL117W | 808 | 1.3(10)-80 | Saccharomyces cerevisiae | [ui:ynl117w][pn:malate synthase 1:malate synthase 1, glyoxysomal][gn:mls1:n1921][gtcfc:1.1:11.8:1.9:12.6][ec:4.1.3.2][keggfc:1.8:1.9][sgdfc:1.5.1:2.8.0:9.8.0][db:gtc-saccharomyces cerevisiae] |
| CONTIG5805 | 12203265_c2_31 | 3193 | 17296 | 804 | 268 | YNL117W | 708 | 5.5(10)-70 | Saccharomyces cerevisiae | [ui:ynl117w][pn:malate synthase 1:malate synthase 1, glyoxysomal][gn:mls1:n1921][gtcfc:1.1:11.8:1.9:12.6][ec:4.1.3.2][keggfc:1.5.1:2.8.0:9.8.0][db:gtc-saccharomyces cerevisiae] |
| CONTIG1926 | 20345077_c1_1 | 3194 | 17297 | 843 | 281 | YNL048W | 335 | 5.2(10)-30 | Saccharomyces cerevisiae | [ui:ynl048w][pn:required for asparagine-linked glycosylation:hypothetical 63.1 kd protein in cox5a-yip3 intergenic region][gn:alg11:n2510:ynl2510w][gtcfc:1.1:10.7][keggfc:14.2][sgdfc:1.5.1:6.3.0][db:saccharomyces cerevisiae] |
| CONTIG3977 | 165932_f2_5 | 3195 | 17298 | 780 | 260 | YNL048W | 284 | 2.2(10)-24 | Saccharomyces cerevisiae | [ui:ynl048w][pn:required for asparagine-linked glycosylation:hypothetical 63.1 kd protein in cox5a-yip3 intergenic region][gn:alg11:n2510:ynl2510w][gtcfc:1.1:10.7][keggfc:14.2][sgdfc:1.5.1:6.3.0][db:gtc-saccharomyces cerevisiae] |
| CONTIG3864 | 25424128_c2_3 | 3196 | 17299 | 378 | 126 | YNL037C | 192 | 1.0(10)-18 | Saccharomyces cerevisiae | [ui:ynl037c][pn:nad+ subunit 1, mitochondrial:isocitrate dehydrogenase:nad+-specific icdh precursor:isocitric dehydrogenase, mitochondrial subunit 1 precursor:isocitric dehydrogenase:nad+-specific icdh][gn:idh1:n2690][gtcfc:1.1.1.41][keggfc:1.2][sgdfc:1.5.[ec:1.1.1.41] |
| CONTIG4323 | 25424128_c1_5 | 3197 | 17300 | 189 | 63 | YNL037C | 167 | 4.7(10)-12 | Saccharomyces cerevisiae | [ui:ynl037c][pn:nad+ subunit 1, mitochondrial:isocitrate dehydrogenase:nad+-specific icdh precursor:isocitric dehydrogenase, mitochondrial subunit 1 precursor:isocitric dehydrogenase:nad+-specific icdh][gn:idh1:n2690][gtcfc:1.1.1.2:2.8:10.2][ec:1.1.1.41][keggfc:1.2][sgdfc:1.5. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5615 | 31285037_f2_6 | 3198 | 17301 | 582 | 194 | YNL037C | 549 | 4.0(10)-53 | Saccharomyces cerevisiae | [ui:ynl037c] [pn:nad+ subunit 1, mitochondrial:isocitrate dehydrogenase:nad, mitochondrial 1 precursor:isocitric dehydrogenase:nad+ specific icdh] [gn:idh1:n2690] [ec:1.1.1.41] [keggfc:1.2] [sgdfc:1.5. gtcfc:1.1.1.2:2.8:10.2] |
| CONTIG5615 | 33785937_f3_14 | 3199 | 17302 | 528 | 176 | YNL037C | 607 | 2.7(10)-59 | Saccharomyces cerevisiae | [ui:ynl037c] [pn:nad+ subunit 1, mitochondrial:isocitrate dehydrogenase:nad, mitochondrial 1 precursor:isocitric dehydrogenase:nad+ specific icdh] [gn:idh1:n2690] [ec:1.1.1.41] [keggfc:1.2] [sgdfc:1.5. gtcfc:1.1.1.2:2.8:10.2] |
| CONTIG4480 | 203183_c1_7 | 3200 | 17303 | 309 | 103 | YNL037C | 94 | 1.0(10)-10 | Saccharomyces cerevisiae | [ui:ynl037c] [pn:nad+ subunit 1, mitochondrial:isocitrate dehydrogenase:nad, mitochondrial 1 precursor:isocitric dehydrogenase:nad+ specific icdh] [gn:idh1:n2690] [ec:1.1.1.41] [keggfc:1.2] [sgdfc:1.5. gtcfc:1.1.1.2:2.8:10.2] |
| CONTIG3933 | 34408518_c2_8 | 3201 | 17304 | 1200 | 400 | YNR001C | 1631 | 8.6(10)-168 | Saccharomyces cerevisiae | [ui:ynr001c] [pn:citrate:si-synthase, mitochondrial:citrate synthase, mitochondrial precursor] [gn:cit1:lys6:glu3:n2019] [ec:4.1.3.7] [keggfc:1.2:1.9] [sgdfc:1.5.1:2.4.0:9.7.0] [db:gtc-saccharomyces cerevisiae] |
| CONTIG5102 | 20392202_c3_6 | 3202 | 17305 | 1170 | 390 | YNR059W | 137 | 3.7(10)-6 | Saccharomyces cerevisiae | [ui:ynr059w] [pn:similarity to to alpha-1,3-mannosyltransferase:hypothetical 68.1 kd protein in bio3-hxt17 intergenic region] [gn:n3514] [gtcfc:1.1.1.5:7.1:8.5:10.7:11.3:11.4] [ec:2.4.1.-] [keggfc:1.5:7.2:7.3:8.5] [sgdfc:1.5.1:6.3.0] |
| CONTIG4580 | 33244763_f3_4 | 3203 | 17306 | 1167 | 389 | YOL155C | 114 | 0.0023 | Saccharomyces cerevisiae | [ui:yol155c] [pn:similarity to glucan 1,4-alpha-glucosidase mal5p] [gtcfc:1.1] [keggfc:14.2] [sgdfc:1.5.1] [db:gtc-saccharomyces cerevisiae] |
| CONTIG5313 | 4329050_c2_10 | 3204 | 17307 | 2481 | 827 | YOL155C | 144 | 7.4(10)-7 | Saccharomyces cerevisiae | [ui:yol155c] [pn:similarity to glucan 1,4-alpha-glucosidase mal5p] [gtcfc:1.1] [keggfc:14.2] [sgdfc:1.5.1] [db:gtc-saccharomyces cerevisiae] |
| CONTIG1522 | 23990637_c1_2 | 3205 | 17308 | 1407 | 469 | YOR002W | 712 | 6.9(10)-75 | Saccharomyces cerevisiae | [ui:yor002w] [pn:glucosyltransferase] [gn:alg6] [gtcfc:1.1.10.7] [keggfc:14.2] [sgdfc:1.5.1:6.3.0] [db:gtc-saccharomyces cerevisiae] |
| CONTIG3696 | 24501625_c3_7 | 3206 | 17309 | 798 | 266 | YOR067C | 630 | 1.0(10)-61 | Saccharomyces cerevisiae | [ui:yor067c] [pn:glucosyltransferase] [gn:alg8] [gtcfc:1.1.5:7.1:8.5:10.7:11.3:11.4:12.16] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | [ec:2.4.1.-] [keggfc:1.5:7.2:7.3:8.5: 9.4.0] [sgdfc:1.5:1:6.3:0: |
| CONTIG5602 | 31689583_f2_5 | 3207 | 17310 | 312 | 104 | YOR085W | 167 | 4.4(10)-12 | Saccharomyces cerevisiae | [ui:yor085w] [pn:oligosaccharyltransferase gamma subunit:dolichyl-diphosphooligosac-charide--proteinglycosyltransferase gamma subunit precursor:oligosaccharyl transferase gamma subunit: oligosaccharyl transferase 34 kd subunit] [gn:ost3 |
| CONTIG5602 | 24801576_f3_8 | 3208 | 17311 | 729 | 243 | YOR085W | 267 | 3.0(10)-23 | Saccharomyces cerevisiae | [ui:yor085w] [pn:oligosaccharyltransferase gamma subunit:dolichyl-diphosphooligosac-charide--proteinglycosyltransferase gamma subunit precursor:oligosaccharyl transferase gamma subunit: oligosaccharyl transferase 34 kd subunit] [gn:ost3 |
| CONTIG5667 | 804501_c2_22 | 3209 | 17312 | 723 | 241 | YOR085W | 128 | 3.2(10)-6 | Saccharomyces cerevisiae | [ui:yor085w] [pn:oligosaccharyltransferase gamma subunit:dolichyl-diphosphooligosac-charide--proteinglycosyltransferase gamma subunit precursor:oligosaccharyl transferase gamma subunit: oligosaccharyl transferase 34 kd subunit] [gn:ost3 |
| CONTIG337 | 15830465_c2_3 | 3210 | 17313 | 255 | 85 | YOR099W | 322 | 4.5(10)-29 | Saccharomyces cerevisiae | [ui:yor099w] [pn:strong similarity to man-nosyltransferases:probable mannosyltrans-ferase ktr1] [gn:ktr1: yor3189w] [gtcfc:1.1:7.1:10.7:11.3:12.16] [ec:2.4.1.131] [sgdfc:1.5:1.6.3:0:9.4.0] [db:gtc-saccharomyces cerevisiae] |
| CONTIG3056 | 4100277_c3_5 | 3211 | 17314 | 537 | 179 | YOR103C | 117 | 1.1(10)-15 | Saccharomyces cerevisiae | [ui:yor103c] [pn:oligosaccharyltransferase epsilon subunit:dolichyl-diphosphooligosac-charide--protein glycosyltransferase epsilon subunit:oligosaccharyl transferase epsilon subunit: oligosaccharyl transferase 16 kd subunit] [gn:ost2:yor |
| CONTIG274 | 10397135_f1_1 | 3212 | 17315 | 831 | 277 | YOR120W | 588 | 2.8(10)-57 | Saccharomyces cerevisiae | [ui:yor120w] [pn:galactose-induced protein of aldo/keto reductase family:gcy protein] [gn:gcy1:gcy:o31567:yor3269w] [gtcfc:1.1:1.11.1.5:1.6:1.7:3.5.4.3:5.13:5.3:5.9:9.3] [ec:1.1.1.-] [keg- |
| CONTIG3907 | 16103382_c3_4 | 3213 | 17316 | 873 | 291 | YOR120W | 608 | 2.2(10)-59 | Saccharomyces cerevisiae | gfc:1.5:1.6:1.7:1.11:3.5.4.3:5.3:5.9:5.13:9.3] [ui:yor120w] [pn:galactose-induced protein of aldo/keto reductase family:gcy protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | [gn:gcy1:gcy1o31567:yor3269w] [gtcfc:1.1.1.11.1.5:1.6:1.7:3.5:4.3:5.13:5.9:9.3] [ec:1.1.1.-] [keg-gfc:1.5:1.6:1.7:1.11.3:5.4.:3:5.3:5.9.5.13:9.3] |
| CONTIG5471 | 30603437_c3_28 | 3214 | 17317 | 810 | 270 | YOR126C | 286 | 7.5(10)-38 | Saccharomyces cerevisiae | [ui:yor126c] [pn:isoamyl acetate hydrolytic enzyme:hypothetical 27.3 kd protein in cat5-rga1 intergenic region] [gn:est2:o3287] [gtcfc:1.1:2.2] [keggfc:14.2] [sgdfc:1.5.1:2.6.0] [db:gtc-saccharomyces cerevisiae] |
| CONTIG2708 | 6735432_f1_1 | 3215 | 17318 | 1089 | 363 | YOR136W | 1190 | 4.7(10)-121 | Saccharomyces cerevisiae | [ui:yor136w] [pn:nad+ subunit 2, mitochondrial:isocitrate dehydrogenase;nad, mitochondrial subunit 2 precursor:isocitric dehydrogenase:nad+ specific icdh] [gn:idh2:o3326:yor3326w] [gtcfc:1.1.1.2:2:8:10.2] [ec:1.1.1.41] [keg-gfc:1.2.] |
| CONTIG2324 | 2157751_f2_1 | 3216 | 17319 | 1107 | 369 | YOR190W | 491 | 5.5(10)-47 | Saccharomyces cerevisiae | [ui:yor190w] [pn:exo-1,3-beta-glucanase precursor:sporulation-specific glucan 1,3-beta-glucosidase precursor:exo-1,3-beta-glucanase] [gn:spr1:ssg1] [gtcfc:1.1.11.1:12.15 14.1] [sgdfc:1.5.1:3.4.0:9.1.0] [db:gtc-s ec:3.2.1.58] |
| CONTIG1230 | 34251586_c2_2 | 3217 | 17320 | 834 | 278 | YOR299W | 301 | 9.3(10)-36 | Saccharomyces cerevisiae | [ui:yor299w] [pn:weak similarity to csd3p] [gtcfc:1.1] [keggfc:14.2] [sgdfc:1.5.1] [db:gtc-saccharomyces cerevisiae] |
| CONTIG3825 | 22454200_f3_3 | 3218 | 17321 | 423 | 141 | YOR299W | 441 | 4.9(10)-41 | Saccharomyces cerevisiae | [ui:yor299w] [pn:weak similarity to csd3p] [gtcfc:1.1] [keggfc:14.2] [sgdfc:1.5.1] [db:gtc-saccharomyces cerevisiae] |
| CONTIG3825 | 36111388_f3_4 | 3219 | 17322 | 933 | 311 | YOR299W | 346 | 1.1(10)-30 | Saccharomyces cerevisiae | [ui:yor299w] [pn:weak similarity to csd3p] [gtcfc:1.1] [keggfc:14.2] sgdfc:1.5.1] [db:gtc-saccharomyces cerevisiae] |
| CONTIG4154 | 2116531_f2_2 | 3220 | 17323 | 1134 | 378 | YOR321W | 634 | 3.8(10)-62 | Saccharomyces cerevisiae | [ui:yor321w] [pn:mannosyltransferase:dolichyl-phosphate-mannose--protein mannosyltransferase 3] [gn:pmt3:o6148] [gtcfc:1.1.7:1.10.7:11.3:12.16] [ec:2.4.1.109] [keggfc:7.2] [db:gtc-saccharomyces cerevisiae] |
| CONTIG4154 | 36578117_f1_1 | 3221 | 17324 | 1134 | 378 | YOR321W | 719 | 3.7(10)-71 | Saccharomyces cerevisiae | [ui:yor321w] [pn:mannosyltransferase:dolichyl-phosphate-mannose--protein mannosyltransferase 3] [gn:pmt3:o6148] [gtcfc:1.1.7:1.10.7:11.3:12.16] [ec:2.4.1.109] [keggfc:7.2] [sgdfc:1.5.1:6.3:0:9.4.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5263 | 24336527_c2_12 | 3222 | 17325 | 1935 | 645 | YOR336W | 261 | 9.5(10)-19 | Saccharomyces cerevisiae | [ui:yor336w] [pn:killer toxin-resistance protein:killer toxin-resistance protein 5 precursor] [gn:kre5] [gtcfc:1.1.12.16.12.8] [keggfc:14.2] [sgdfc:1.5.1.3.1.0:9.4.0] [db:gtc-saccharomyces cerevisiae] |
| CONTIG5263 | 3907950_c3_13 | 3223 | 17326 | 1086 | 362 | YOR336W | 152 | 2.5(10)-7 | Saccharomyces cerevisiae | [ui:yor336w] [pn:killer toxin-resistance protein:killer toxin-resistance protein 5 precursor] [gn:kre5] [gtcfc:1.1.12.16.12.8] [keggfc:14.2] [sgdfc:1.5.1.3.1.0:9.4.0] [db:gtc-saccharomyces cerevisiae] |
| CONTIG5649 | 15907187_c2_18 | 3224 | 17327 | 1509 | 503 | YOR377W | 133 | 1.5(10)-5 | Saccharomyces cerevisiae | [ui:yor377w] [pn:alcohol acetyltransferase:alcohol o-acetyltransferase:aatase] [gn:atf1] [gtcfc:1.1] [ec:2.3.1.84] [keggfc:14.1] [sgdfc:1.5.1.1] [db:gtc-saccharomyces cerevisiae] |
| CONTIG5202 | 30521890_c2_8 | 3225 | 17328 | 321 | 107 | YPL227C | 304 | 3.6(10)-27 | Saccharomyces cerevisiae | [ui:ypl227c] [pn:dolichyl-phosphate beta-glucosyltransferase] [gn:alg5:p1437] [gtcfc:1.1.7.1:10.7:11.3:12.16] [ec:2.4.1.117] [keggfc:7.2] [sgdfc:1.5.1.6.3.0:9.4.0] [db:gtc-saccharomyces cerevisiae] |
| CONTIG5202 | 11756513_c1_6 | 3226 | 17329 | 687 | 229 | YPL227C | 443 | 6.7(10)-42 | Saccharomyces cerevisiae | [ui:ypl227c] [pn:dolichyl-phosphate beta-glucosyltransferase] [gn:alg5:p1437] [gtcfc:1.1.7.1:10.7:11.3:12.16] [ec:2.4.1.117] [keggfc:7.2] [sgdfc:1.5.1.6.3.0:9.4.0] [db:gtc-saccharomyces cerevisiae] |
| CONTIG3289 | 25878901_c3_4 | 3227 | 17330 | 396 | 132 | YPL175W | 219 | 1.8(10)-17 | Saccharomyces cerevisiae | [ui:ypl175w] [pn:n-acetylglucosaminyl-transferase:n-acetylglucosaminyl-phosphatidylinositol biosynthetic protein:gpi:cnac-pi synthesis protein] [gn:spt14:gpi3] [gtcfc:1.1:3.4:8.1:8.2:10.2] [keggfc:14.2] [sgdfc:1.5.1.1.6.1:9.5.0] [db:gtc-saccharomyces cerevisiae] |
| CONTIG3690 | 20603387_c2_6 | 3228 | 17331 | 213 | 71 | YPL175W | 233 | 5.2(10)-19 | Saccharomyces cerevisiae | [ui:ypl175w] [pn:n-acetylglucosaminyl-transferase:n-acetylglucosaminyl-phosphatidylinositol biosynthetic protein:gpi:cnac-pi synthesis protein] [gn:spt14:gpi3] [gtcfc:1.1:3.4:8.1:8.2:10.2] [keggfc:14.2] [sgdfc:1.5.1.1.6.1:9.5.0] [db:gtc-saccharomyces cerevisiae] |
| b9x13v36.y | 2635466_f1_1 | 3229 | 17332 | 354 | 118 | YPL175W | 311 | 7.7(10)-28 | Saccharomyces cerevisiae | [ui:ypl175w] [pn:n-acetylglucosaminyl-transferase:n-acetylglucosaminyl-phosphatidylinositol biosynthetic protein:gpi:cnac-pi synthesis protein] [gn:spt14:gpi3] [gtcfc:1.1:3.4:8.1:8.2:10.2] [keggfc:14.2] [sgdfc:1.5.1.1.6.1:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x13v36.y | 12319055_f1_2 | 3230 | 17333 | 459 | 153 | YPL175W | 347 | 1.0(10)-31 | Saccharomyces cerevisiae | [ui:ypl175w] [pn:n-acetylglucosaminyl-transferase:n-acetylglucosaminyl-phosphati-dylinositol biosynthetic protein;g]cnac-pi synthesis protein] [gn:spt14:gpi3] [gtcfc:1.1:3.4:8.1:8.2:10.2] [keggfc:14.2] [sgdfc:1.5.1:1.6.1:9.5.0] [db:gtc-keggfc:14.2] |
| CONTIG5435 | 23706287_f1_2 | 3231 | 17334 | 894 | 298 | YPL113C | 167 | 3.5(10)-10 | Saccharomyces cerevisiae | [ui:ypl113c] [pn:similarity to glycerate dehydrogenases] [gtcfc:1.1] [keggfc:14.2] [sgdfc:1.5.1] [db-gtc-saccharomyces cerevisiae] |
| CONTIG5451 | 24394162_f3_7 | 3232 | 17335 | 1170 | 390 | YPL113C | 314 | 3.2(10)-28 | Saccharomyces cerevisiae | [ui:ypl113c] [pn:similarity to glycerate dehydrogenases] [gtcfc:1.1] [keggfc:14.2] [sgdfc:1.5.1] [db-gtc-saccharomyces cerevisiae] |
| CONTIG1756 | 23833126_c2_7 | 3233 | 17336 | 1143 | 381 | YPL088W | 833 | 3.2(10)-83 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG2214 | 30672192_c3_6 | 3234 | 17337 | 210 | 70 | YPL088W | 96 | 0.00025 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG2434 | 12540625_c1_3 | 3235 | 17338 | 867 | 289 | YPL088W | 714 | 1.3(10)-70 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG3939 | 26641500_f2_1 | 3236 | 17339 | 1074 | 358 | YPL088W | 821 | 6.0(10)-82 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG4675 | 14449027_c1_5 | 3237 | 17340 | 666 | 222 | YPL088W | 483 | 3.8(10)-46 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG4675 | 9804525_c2_6 | 3238 | 17341 | 1101 | 367 | YPL088W | 812 | 5.4(10)-81 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |
| CONTIG4704 | 23907186_f2_2 | 3239 | 17342 | 1062 | 354 | YPL088W | 825 | 2.2(10)-82 | Saccharomyces cerevisiae | [ui:ypl088w] [pn:similarity to aryl-alcohol dehydrogenases] [gtcfc:1.1.2.2] [keggfc:14.2] [sgdfc:1.5.1:2.6.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5081 | 100927_f3_5 | 3240 | 17343 | 1101 | 367 | YPL088W | 927 | 3.5(10)-93 | Saccharomyces cerevisiae | [ui:ypl088w] [pn:similarity to aryl-alcohol dehydrogenases] [gtcfc:1.1:2.2] [keggfc:14.2] [sgdfc:1.5.1:2.6.0] [db:gtc-saccharomyces cerevisiae] |
| CONTIG5285 | 35199055_c3_14 | 3241 | 17344 | 297 | 99 | YPL088W | 189 | 1.3(10)-14 | Saccharomyces cerevisiae | [ui:ypl088w] [pn:similarity to aryl-alcohol dehydrogenases] [gtcfc:1.1:2.2] [keggfc:14.2] [sgdfc:1.5.1:2.6.0] [db:gtc-saccharomyces cerevisiae] |
| CONTIG5285 | 4806253_c1_8 | 3242 | 17345 | 738 | 246 | YPL088W | 572 | 1.5(10)-55 | Saccharomyces cerevisiae | [ui:ypl088w] [pn:similarity to aryl-alcohol dehydrogenases] [gtcfc:1.1:2.2] [keggfc:14.2] [sgdfc:1.5.1:2.6.0] [db:gtc-saccharomyces cerevisiae] |
| CONTIG2214 | 20348424_c1_3 | 3243 | 17346 | 801 | 267 | YPL088W | 650 | 7.9(10)-64 | Saccharomyces cerevisiae | [ui:ypl088w] [pn:similarity to aryl-alcohol dehydrogenases] [gtcfc:1.1:2.2] [keggfc:14.2] [sgdfc:1.5.1:2.6.0] [db:gtc-saccharomyces cerevisiae] |
| CONTIG5702 | 14142011_f2_6 | 3244 | 17347 | 3306 | 1102 | YPR026W | 1514 | 8.1(10)-168 | Saccharomyces cerevisiae | [ui:ypr026w] [pn:acid trehalase, vacuolar:ath1 protein] [gn:ath1:yp9367] [gtcfc:1.1:7.1:7.2:13.2] [keggfc:14.2] [sgdfc:1.5.1:2.7.0:11.1.0] [db:gtc-saccharomyces cerevisiae] |
| CONTIG4820 | 23912551_f2_2 | 3245 | 17348 | 2046 | 682 | YPR074C | 2244 | 9.5(10)-233 | Saccharomyces cerevisiae | [ui:ypr074c] [pn:transketolase 1:tk1] [gn:tkl1:yp9499] [gtcfc:1.1.1.5.1.2.3.0:9.2.0] [db:gtc-saccharomyces cerevisiae] [ec:2.2.1.1] [keggfc:1.3:2.3] [sgdfc:1.1.1.5.1.2.3.0:9.2.0] [db:gtc-saccharomyces cerevisiae] |
| CONTIG1006 | 26572091_f2_1 | 3246 | 17349 | 954 | 318 | YPR159W | 758 | 2.7(10)-75 | Saccharomyces cerevisiae | [ui:ypr159w] [pn:glucan synthase subunit :beta-glucan synthesis-associated protein:killer toxin-resistance protein 6] [gn:kre6] [gtcfc:1.1:12.16:12.8] [keggfc:14.2] [sgdfc:1.5.1:3.1.0:9.4.0] [db:gtc-saccharomyces cerevisiae] |
| CONTIG330 | 29492067_f1_1 | 3247 | 17350 | 360 | 120 | YPR159W | 384 | 7.2(10)-35 | Saccharomyces cerevisiae | [ui:ypr159w] [pn:glucan synthase subunit :beta-glucan synthesis-associated protein:killer toxin-resistance protein 6] [gn:kre6] [gtcfc:1.1:12.16:12.8] [keggfc:14.2] [sgdfc:1.5.1:3.1.0:9.4.0] [db:gtc-saccharomyces cerevisiae] |
| CONTIG444 | 34611628_c2_2 | 3248 | 17351 | 291 | 97 | YPR159W | 377 | 4.2(10)-34 | Saccharomyces cerevisiae | [ui:ypr159w] [pn:glucan synthase subunit :beta-glucan synthesis-associated protein:killer toxin-resistance protein 6] [gn:kre6] [gtcfc:1.1:12.16:12.8] [keggfc:14.2] [sgdfc:1.5.1:3.1.0:9.4.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5086 | 3940890_c2_5 | 3249 | 17352 | 1878 | 626 | YPR159W | 1080 | 2.1(10)-109 | Saccharomyces cerevisiae | [ui:ypr159w] [pn:glucan synthase subunit :beta-glucan synthesis-associated protein:killer toxin-resistance protein 6] [gn:kre6] [gtcfc:1.1:12.16:12.8] [keggfc:14.2] [sgdfc:1.5.1:3.1.0:9.4.0] [db-gtc-saccharomyces cerevisiae] |
| CONTIG5456 | 4878288_c1_6 | 3250 | 17353 | 2232 | 744 | YPR159W | 1905 | 8.0(10)-197 | Saccharomyces cerevisiae | [ui:ypr159w] [pn:glucan synthase subunit :beta-glucan synthesis-associated protein:killer toxin-resistance protein 6] [gn:kre6] [gtcfc:1.1:12.16:12.8] [keggfc:14.2] [sgdfc:1.5.1:3.1.0:9.4.0] [db-gtc-saccharomyces cerevisiae] |
| CONTIG2523 | 11723543_f3_2 | 3251 | 17354 | 1107 | 369 | YPR160W | 1151 | 6.4(10)-117 | Saccharomyces cerevisiae | [ui:ypr160w] [pn:glycogen phosphorylase] [gn:gph1:p9584] [gtcfc:1.1:7.1:7.2] [ec:2.4.1.1] [keggfc:7.1] [sgdfc:1.5.1:2.7.0:9.2.0] [db-gtc-saccharomyces cerevisiae] |
| CONTIG3133 | 85313_f2_1 | 3252 | 17355 | 1428 | 476 | YPR160W | 1727 | 5.9(10)-178 | Saccharomyces cerevisiae | [ui:ypr160w] [pn:glycogen phosphorylase] [gn:gph1:p9584] [gtcfc:1.1:7.1:7.2] [ec:2.4.1.1] [keggfc:7.1] [sgdfc:1.5.1:2.7.0:9.2.0] [db-gtc-saccharomyces cerevisiae] |
| CONTIG2300 | 9798291_f1_1 | 3253 | 17356 | 201 | 67 | YPR184W | 98 | 0.001 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |
| CONTIG2300 | 22462507_f1_2 | 3254 | 17357 | 1263 | 421 | YPR184W | 1492 | 4.7(10)-153 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |
| CONTIG2669 | 158443_c1_4 | 3255 | 17358 | 957 | 319 | YPR184W | 955 | 2.7(10)-95 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |
| CONTIG2669 | 2478427_c2_5 | 3256 | 17359 | 771 | 257 | YPR184W | 482 | 1.3(10)-44 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |
| CONTIG2907 | 22366535_c3_11 | 3257 | 17360 | 897 | 299 | YPR184W | 441 | 3.1(10)-40 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |
| CONTIG812 | 29933590_c3_2 | 3258 | 17361 | 534 | 178 | YPR184W | 329 | 2.7(10)-28 | Saccharomyces cerevisiae | [ui:ypr184w] [pn:similarity to glycogen debranching enzymes] [gtcfc:1.1:7.1:7.2] [sgdfc: 1.5.1:2.7.0] [db-gtc-saccharomyces cerevisiae] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5611 | 21675410_f3_5 | 3259 | 17362 | 2181 | 727 | YBR204C | 101 | 0.04 | Saccharomyces cerevisiae | 1.5.1.2.7.0] [db:gtc-saccharomyces cerevisiae] [ui:ybr204c] [pn:weak similarity to peroxisomal serine-active lipase:putative peroxisomal lipase in cdc47-ktr3 intergenic region] [gn:ybr1444] [gtcfc:1.11.3.2:12.6] [ec:3.1.1.-] [keggfc:1.11] |
| CONTIG1651 | 36207628_c3_4 | 3260 | 17363 | 261 | 87 | YJR107W | 106 | 1.8(10)-5 | Saccharomyces cerevisiae | [sgdfc:1.6.2.9.8.0] [db:gtc-saccharomyces cerevisiae] [ui:yjr107w] [pn:weak similarity to acyl-glycerol lipase:hypothetical lipase in sod1-cpa2 intergenic region] [gn:j1983] [gtcfc:1.11:3.2] [ec:3.1.1.-] [keggfc:1.11] [sgdfc:1.6.2] [db-gtc-saccharomyces cerevisiae] |
| CONTIG5765 | 24882762_f2_8 | 3261 | 17364 | 1092 | 364 | YJR107W | 476 | 2.2(10)-45 | Saccharomyces cerevisiae | [ui:yjr107w] [pn:weak similarity to acylglycerol lipase:hypothetical lipase in sod1-cpa2 intergenic region] [gn:j1983] [gtcfc:1.11:3.2] [ec:3.1.1.-] [keggfc:1.11] [sgdfc:1.6.2] [db-gtc-saccharomyces cerevisiae] |
| CONTIG2727 | 14569682_f2_1 | 3262 | 17365 | 1299 | 433 | YKL140W | 317 | 2.6(10)-58 | Saccharomyces cerevisiae | [ui:ykl140w] [pn:triacylglycerol lipase:triglyceride lipase-cholesterol esterase] [gn:tgl1:ykl5] [gtcfc:1.11:3.2] [ec:3.1.1.-] [keggfc:1.11] [sgdfc:1.6.2] [db-gtc-saccharomyces cerevisiae] |
| CONTIG5686 | 22444052_c2_21 | 3263 | 17366 | 1656 | 552 | YKL140W | 1029 | 2.7(10)-109 | Saccharomyces cerevisiae | [ui:ykl140w] [pn:triacylglycerol lipase:triglyceride lipase-cholesterol esterase] [gn:tgl1:ykl5] [gtcfc:1.11:3.2] [ec:3.1.1.-] [keggfc:1.11] [sgdfc:1.6.2] [db-gtc-saccharomyces cerevisiae] |
| CONTIG2760 | 23941075_c2_2 | 3264 | 17367 | 183 | 61 | YML126C | 125 | 3.2(10)-7 | Saccharomyces cerevisiae | [ui:yml126c] [pn:hydroxymethylglutaryl-coa synthase:hmg- coa synthase:3-hydroxy-3-methylglutaryl coenzyme a synthase] [gn:hmg:chmg-sym4987] [gtcfc:1.11:3.3:3.4:5.6:8.1:8.2] [ec:4.1.3.5] [keggfc:1.11:3.5:6] [sgdfc:1.6.1] [db-gtc-sacc 1.11:3.3.5.6] |
| CONTIG2760 | 2422938_c2_1 | 3265 | 17368 | 828 | 276 | YML126C | 1032 | 2.6(10)-104 | Saccharomyces cerevisiae | [ui:yml126c] [pn:hydroxymethylglutaryl-coa synthase:hmg- coa synthase:3-hydroxy-3-methylglutaryl coenzyme a synthase] [gn:hmg:chmg-sym4987] [gtcfc:1.11:3.3:3.4:5.6:8.1:8.2] [ec:4.1.3.5] [keggfc:1.11:3.3.5.6] [sgdfc:1.6.1] [db-gtc-sacc 1.11:3.3.5.6] |
| CONTIG3692 | 35204410_f3_3 | 3266 | 17369 | 324 | 108 | YML126C | 319 | 1.6(10)-28 | Saccharomyces cerevisiae | [ui:yml126c] [pn:hydroxymethylglutaryl-coa synthase:hmg- coa synthase:3-hydroxy-3-methylglutaryl |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1947 | 24646887_f1_1 | 3267 | 17370 | 1242 | 414 | YMR108W | 1544 | 1.3(10)-158 | Saccharomyces cerevisiae | coenzyme a synthase] [gn:hmgchmgsym4987] [gtcfc:1.11:3.3:3.4:5.6:8.1:8.2] [keggfc:1.11:3.3:5.6] [sgdfc:1.6.1] [db:gtc-sacc [ui:ymr108w] [pn:acetolactate synthase:acetolactate synthase precursor:acetohydroxyacid synthase:als:ahas] [gn:ilv2:smr1:ym9718] [gtcfc:1.11:1.12:2.8:5.7:6.6:9.5] [ec:4.1.3.18] [keggfc:1.11:1.12:5.7:9.5] [sgdfc:1.1.1:9.7.0] [db:gtc-s |
| CONTIG625 | 24297127_f1_1 | 3268 | 17371 | 801 | 267 | YMR108W | 725 | 8.9(10)-72 | Saccharomyces cerevisiae | [ui:ymr108w] [pn:acetolactate synthase:acetolactate synthase precursor:acetohydroxyacid synthase:als:ahas] [gn:ilv2:smr1:ym9718] [gtcfc:1.11:1.12:2.8:5.7:6.6:9.5] [ec:4.1.3.18] [keggfc:1.11:1.12:5.7:9.5] [sgdfc:1.1.1:9.7.0] [db:gtc-s |
| CONTIG5413 | 16413900_f3_12 | 3269 | 17372 | 390 | 130 | YPR051W | 114 | 5.0(10)-7 | Saccharomyces cerevisiae | [ui:ypr051w] [pn:n-acetyltransferase:1-a virus gag protein n-acetyltransferase] [gn:mak3:yp9499] [gtcfc:1.11:5.12:5.13:6.5:8.6.14:6.8:7.1:10.7] [ec:2.3.1.-] [keggfc:1.11:4.4:5.6: 5.85.12:5.13:6.7] [sgdfc:6.3.0:9.2.0] [db:gtc-sacchar |
| b1x11654.x | 2402080_f3_1 | 3270 | 17373 | 696 | 232 | YPR051W | 453 | 5.9(10)-43 | Saccharomyces cerevisiae | [ui:ypr051w] [pn:n-acetyltransferase:1-a virus gag protein n-acetyltransferase] [gn:mak3:yp9499] [gtcfc:1.11:5.12:5.13:6.5:8.6.14:6.8:7.1:10.7] [ec:2.3.1.-] [keggfc:1.11:4.4:5.6: 5.85.12:5.13:6.7] [sgdfc:6.3.0:9.2.0] [db:gtc-sacchar |
| CONTIG3642 | 22658550_c2_7 | 3271 | 17374 | 1590 | 530 | YJL200C | 1704 | 1.6(10)-175 | Saccharomyces cerevisiae | [ui:yjl200c] [pn:strong similarity to aconitate hydratase:putative aconitase in prp21-upb12 intergenic region] [gn:j0327] [gtcfc:1.2:1.9:2.5] [ec:4.2.1.3] [keggfc:1.2:1.9:2.4] [sgdfc:2.4.0] [db:gtc-saccharomyces cerevisiae |
| CONTIG1617 | 26757637_c3_7 | 3272 | 17375 | 336 | 112 | YPL262W | 195 | 8.5(10)-15 | Saccharomyces cerevisiae | [ui:ypl262w] [pn:fumarate hydratase:fumarate hydratase, mitochondrial precursor:fumarase] [gn:fum1] [gtcfc:1.2:2.5:2.8] [ec:4.2.1.2] [keggfc:1.2:2.4.0:9.2.0:9.7.0] [db:gtc-saccharomyces cerevisiae |
| CONTIG4281 | 36039137_c3_6 | 3273 | 17376 | 456 | 152 | YPL262W | 469 | 1.2(10)-44 | Saccharomyces cerevisiae | [ui:ypl262w] [pn:fumarate hydratase:fumarate hydratase, mitochondrial precursor:fumarase] [gn:fum1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5810 | 32119037_c1_26 | 3274 | 17377 | 873 | 291 | YPL262W | 1044 | 1.3(10)-105 | Saccharomyces cerevisiae | [gtcfc:1.2:2.5:2.8] [ec:4.2.1.2] [keggfc:1.2:2.4] [sgdfc:2.4.0:9.2.0:9.7.0] [db-gtc-saccharomyces cerevisiae] [ui:ypl262w] [pn:fumarate hydratase, mitochondrial precursor:fumarase] [gn:fum1] [gtcfc:1.2:2.5:2.8] [ec:4.2.1.2] [keggfc:1.2:2.4] [sgdfc:2.4.0:9.2.0:9.7.0] [db-gtc-saccharomyces cerevisiae] |
| b2x18261.y | 35236700_f2_2 | 3275 | 17378 | 597 | 199 | YPL262W | 775 | 4.5(10)-77 | Saccharomyces cerevisiae | [ui:ypl262w] [pn:fumarate hydratase, mitochondrial precursor:fumarase] [gn:fum1] [gtcfc:1.2:2.5:2.8] [ec:4.2.1.2] [keggfc:1.2:2.4] [sgdfc:2.4.0:9.2.0:9.7.0] [db-gtc-saccharomyces cerevisiae] |
| CONTIG4206 | 34256511_f2_2 | 3276 | 17379 | 906 | 302 | YLL041C | 1110 | 1.3(10)-112 | Saccharomyces cerevisiae | [ui:yll041c] [pn:succinate dehydrogenase iron-sulfur protein subunit:succinate dehydrogenase:ubiquinone iron-sulfur protein precursor:ip] [gn:sdh2:sdhb:sdh] [gtcfc:1.2:2.1:2.8:9.12] [ec:1.3.5.1] [keggfc:2.1] [sgdfc:2.4.0:9.7.0] [dbgt |
| CONTIG1106 | 9938400_f1_1 | 3277 | 17380 | 465 | 155 | YMR118C | 196 | 1.0(10)-15 | Saccharomyces cerevisiae | [ui:ymr118c] [pn:strong similarity to succinate dehydrogenase] [gtcfc:1.2] [keggfc:14.2] [sgdfc:2.4.0] [db:gtc-saccharomyces cerevisiae] |
| CONTIG2847 | 595252_c3_2 | 3278 | 17381 | 768 | 256 | YHL011C | 965 | 3.2(10)-97 | Saccharomyces cerevisiae | [ui:yhl011c] [pn:ribose-phosphate pyrophosphokinase:ribose-phosphate pyrophosphokinase 3-phosphoribosyl pyrophosphate synthetase 3] [gn:prps3:prs3] [gtcfc:1.3:4.1:4.2] [ec:2.7.6.1] [keggfc:1.3:4.1] [sgdfc:1.3.1:1.3.2] [db:gtc-saccharo |
| CONTIG5817 | 24005252_c3_60 | 3279 | 17382 | 999 | 333 | YHL011C | 1412 | 1.3(10)-144 | Saccharomyces cerevisiae | [ui:yhl011c] [pn:ribose-phosphate pyrophosphokinase:ribose-phosphate pyrophosphokinase 3-phosphoribosyl pyrophosphate synthetase 3] [gn:prps3:prs3] [gtcfc:1.3:4.1:4.2] [ec:2.7.6.1] [keggfc:1.3:4.1] [sgdfc:1.3.1:1.3.2] [db:gtc-saccharo phokinase 1: phosphoribosyl pyrophosphate synthase 1 |
| CONTIG4001 | 10156580_c1_11 | 3280 | 17383 | 1146 | 382 | YKL181W | 954 | 1.8(10)-127 | Saccharomyces cerevisiae | [ui:ykl181w] [pn:ribose-phosphate pyrophosphokinase:ribose-phosphate pyrophosphokinase 1: phosphoribosyl pyrophosphate synthase 1 [gn:prps1:prs1:prp1:pps1] [gtcfc:1.3:4.1:4.2:12.8] [keggfc:1.3.1:1.3.2:3.2.0] [db |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1091 | 1361015_c1_4 | 3281 | 17384 | 903 | 301 | YBL015W | 1146 | 2.2(10)-116 | Saccharomyces cerevisiae | [ui:ybl015w] [pn:acetyl-coa hydrolase:acetyl-coa deacylase:acetyl-coa acylase] [gn:ach1:ybl0304: ybl03] [gtcfc:1.8:10.2:12.15] [ec:3.1.2.1] [keggfc:1.8] [sgdfc:1.6.4:3.4:0:9.2.0] [db:gtc-saccharomyces cerevisiae] |
| CONTIG2621 | 1649027_f1_1 | 3282 | 17385 | 504 | 168 | YBL015W | 652 | 4.7(10)-64 | Saccharomyces cerevisiae | [ui:ybl015w] [pn:acetyl-coa hydrolase:acetyl-coa deacylase:acetyl-coa acylase] [gn:ach1:ybl0304: ybl03] [gtcfc:1.8:10.2:12.15] [ec:3.1.2.1] [keggfc:1.8] [sgdfc:1.6.4:3.4:0:9.2.0] [db:gtc-saccharomyces cerevisiae] |
| CONTIG2362 | 23600010_f3_2 | 3283 | 17386 | 996 | 332 | YML004C | 737 | 4.7(10)-73 | Saccharomyces cerevisiae | [ui:yml004c] [pn:lactoylglutathione lyase:methylglyoxalase:aldoketomutase:glyoxalase i] [gn:glo1:ym9571] [gtcfc:1.8:5.3] [ec:4.4.1.5] [keggfc:1.8] [sgdfc:1.1.4] [db:gtc-saccharomyces cerevisiae] |
| CONTIG4996 | 12925905_f1_1 | 3284 | 17387 | 1323 | 441 | YNL104C | 1622 | 7.9(10)-167 | Saccharomyces cerevisiae | [ui:ynl104c] [pn:2-isopropylmalate synthase:2-isopropylmalate synthase:alpha-isopropylmalate synthase: alpha-ipm synthetase] [gn:leu4:n2173] [gtcfc:1.8.2:8.5.7:6.6] [ec:4.1.3.12] [keggfc:1.8.5.7] [sgdfc: 1.1.1:9.2.0:9.7.0] [db:gtc-sac |
| CONTIG4996 | 26369676_f2_6 | 3285 | 17388 | 426 | 142 | YNL104C | 199 | 5.0(10)-15 | Saccharomyces cerevisiae | [ui:ynl104c] [pn:2-isopropylmalate synthase:2-isopropylmalate synthase:alpha-isopropylmalate synthase: alpha-ipm synthetase] [gn:leu4:n2173] [gtcfc:1.8.2:8.5.7:6.6] [ec:4.1.3.12] [keggfc:1.8.5.7] [sgdfc: 1.1.1:9.2.0:9.7.0] [db:gtc-sac |
| CONTIG5795 | 9878125_f2_11 | 3286 | 17389 | 1779 | 593 | YNL104C | 2107 | 3.2(10)-218 | Saccharomyces cerevisiae | [ui:ynl104c] [pn:2-isopropylmalate synthase:2-isopropylmalate synthase:alpha-isopropylmalate synthase: alpha-ipm synthetase] [gn:leu4:n2173] [gtcfc:1.8.2:8.5.7:6.6] [ec:4.1.3.12] [keggfc:1.8.5.7] [sgdfc: 1.1.1:9.2.0:9.7.0] [db:gtc-sac |
| CONTIG4925 | 4789010_f3_4 | 3287 | 17390 | 2079 | 693 | YNR033W | 560 | 2.7(10)-54 | Saccharomyces cerevisiae | [ui:ynr033w] [pn:para-aminobenzoate synthase:p-aminobenzoic acid synthase:paba synthase] [gn:abz1: n3286] [gtcfc:1.8:5.15:5.9:9.10:9.11:9.12] [ec:4.1.3.-] [keggfc:1.8:5.9.5.15:9.13] [sgdfc:1.7.1] [db: gtc-saccharomyces cerevisiae] |
| CONTIG674 | 12593901_f3_1 | 3288 | 17391 | 648 | 216 | YNR033W | 156 | 5.0(10)-15 | Saccharomyces cerevisiae | [ui:ynr033w] [pn:para-aminobenzoate synthase:p-aminobenzoic acid synthase:paba synthase] [gn:abz1: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4320 | 9820379_c2_8 | 3289 | 17392 | 441 | 147 | YNR033W | 361 | 3.0(10)-32 | Saccharomyces cerevisiae | [ui:ynr033w] [pn:para-aminobenzoate synthase:p-aminobenzoic acid synthase:paba synthase] [gn:abz1: n3286] [gtcfc:1.8.5.15:5.9:9.10:9.11:9.12] [ec:4.1.3.-] [keggfc:1.8.5.9.5.15:9.13] [sgdfc:1.7.1] [db:gtc-saccharomyces cerevisiae] |
| CONTIG5377 | 4894063_c2_10 | 3290 | 17393 | 1155 | 385 | YGL205W | 885 | 9.9(10)-89 | Saccharomyces cerevisiae | [ui:ygl205w] [pn:acyl-coa oxidase:acyl-coenzyme a oxidase] [gn:fox1:pox1] [gtcfc:1.8.3.2:12.6] [ec:1.3.3.6] [keggfc:14.1] [sgdfc:1.6.2:2.8.0:9.8.0] [db:gtc-saccharomyces cerevisiae] |
| CONTIG1030 | 7150251_f3_1 | 3291 | 17394 | 582 | 194 | YHR179W | 202 | 8.9(10)-16 | Saccharomyces cerevisiae | [ui:yhr179w] [pn:nadph dehydrogenase:old yellow enzyme, isoform 1:nadph dehydrogenase 2:old yellow enzyme 2] [gn:oye2] [gtcfc:1.8] [ec:1.6.99.1] [keggfc:14.1] [sgdfc:2.8.0] [db:gtc-saccharomyces cerevisiae] |
| CONTIG1952 | 6_f1_1 | 3292 | 17395 | 699 | 233 | YHR179W | 459 | 1.3(10)-43 | Saccharomyces cerevisiae | [ui:yhr179w] [pn:nadph dehydrogenase:old yellow enzyme, isoform 1:nadph dehydrogenase 2:old yellow enzyme 2] [gn:oye2] [gtcfc:1.8] [ec:1.6.99.1] [keggfc:14.1] [sgdfc:2.8.0] [db:gtc-saccharomyces cerevisiae] |
| CONTIG5235 | 22375926_f3_9 | 3293 | 17396 | 1260 | 420 | YIL160C | 945 | 4.2(10)-95 | Saccharomyces cerevisiae | [ui:yil160c] [pn:acetyl-coa c-acetyltransferase, peroxisomal:3-ketothiolase:acetyl-coa acyltransferase:peroxisomal 3-oxoacyl-coa thiolase] [gn:fox3:pox3:pot1] [gtcfc:1.8.3.1:3.2:3.5.5.13] |
| CONTIG592 | 24489218_f1_1 | 3294 | 17397 | 810 | 270 | YIL160C | 397 | 5.0(10)-37 | Saccharomyces cerevisiae | [ui:yil160c] [pn:acetyl-coa c-acetyltransferase, peroxisomal:3-ketothiolase:acetyl-coa acyltransferase:peroxisomal 3-oxoacyl-coa thiolase] [gn:fox3:pox3:pot1] [gtcfc:1.8.3.1:3.2:3.5.5.13] |
| CONTIG5551 | 23492192_f2_5 | 3295 | 17398 | 927 | 309 | YML035C | 145 | 1.6(10)-7 | Saccharomyces cerevisiae | [ui:yml035c] [pn:amp deaminase:myoadenylate deaminase] [gn:amd1:amd] [gtcfc:1.8:4.1] [ec:3.5.4.6] [sgdfc:1.3.1:2.8.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5551 | 19782502_f3_9 | 3296 | 17399 | 1833 | 611 | YML035C | 1997 | 1.3(10)-206 | Saccharomyces cerevisiae | [ui:yml035c] [pn:amp deaminase:myoadenylate deaminase] [gn:amd1:amd] [gtcfc:1.8.4.1] [ec:3.5.4.6] [keggfc:4.1] [sgdfc:1.3.1.2.8.0] [db:gtc-saccharomyces cerevisiae] |
| b9x10f21.y | 43438319_f3_1 | 3297 | 17400 | 189 | 63 | YMR170C | 184 | 1.5(10)-13 | Saccharomyces cerevisiae | [ui:ymr170c] [pn:aldehyde dehydrogenase 2:nad+, mitochondrial:aldehyde dehydrogenase:nadp+ 2] [gn:ald5:ald2:ym8520] [gtcfc:1.8.2.8.5.11:5.12.5.13] [ec:1.2.1.5] [keggfc:5.11:5.12.5.13] [sgdfc:2.8.0: 9.7.0] [db:gtc-saccharomyces cerevisi] |
| CONTIG1505 | 23862577_c3_5 | 3298 | 17401 | 879 | 293 | YMR267W | 719 | 3.9(10)-71 | Saccharomyces cerevisiae | [ui:ymr267w] [pn:inorganic pyrophosphatase, mitochondrial:inorganic pyrophosphatase, mitochondrial precursor:pyrophosphate phospho-hydrolas-e:ppase] [gn:ipp2:ppa2:ym8156] [gtcfc:1.8.2.1:2.8.13.10] [ec:3.6.1.1] [keggfc:2.1] [sgdfc:1.4.1] |
| CONTIG2769 | 21687625_f1_1 | 3299 | 17402 | 420 | 140 | YPL171C | 227 | 1.3(10)-18 | Saccharomyces cerevisiae | [ui:ypl171c] [pn:napdh dehydrogenase:old yellow enzyme, isoform 3:nadph dehydrogenase 3:old yellow enzyme 3] [gn:oye3:p2291] [gtcfc:1.8] [ec:1.6.99.1] [keggfc:14.1] [sgdfc:2.8.0] [db:gtc-saccharomyces cerevisiae] |
| CONTIG4510 | 14882132_c2_6 | 3300 | 17403 | 276 | 92 | YPL171C | 130 | 6.7(10)-8 | Saccharomyces cerevisiae | [ui:ypl171c] [pn:napdh dehydrogenase:old yellow enzyme, isoform 3:nadph dehydrogenase 3:old yellow enzyme 3] [gn:oye3:p2291] [gtcfc:1.8] [ec:1.6.99.1] [keggfc:14.1] [sgdfc:2.8.0] [db:gtc-saccharomyces cerevisiae] |
| CONTIG4694 | 25438582_f3_3 | 3301 | 17404 | 519 | 173 | YPL171C | 167 | 1.6(10)-22 | Saccharomyces cerevisiae | [ui:ypl171c] [pn:napdh dehydrogenase:old yellow enzyme, isoform 3:nadph dehydrogenase 3:old yellow enzyme 3] [gn:oye3:p2291] [gtcfc:1.8] [ec:1.6.99.1] [keggfc:14.1] [sgdfc:2.8.0] [db:gtc-saccharomyces cerevisiae] |
| CONTIG4702 | 22456326_f3_4 | 3302 | 17405 | 1197 | 399 | YPL171C | 706 | 9.1(10)-70 | Saccharomyces cerevisiae | [ui:ypl171c] [pn:napdh dehydrogenase:old yellow enzyme, isoform 3:nadph dehydrogenase 3:old yellow enzyme 3] [gn:oye3:p2291] [gtcfc:1.8] [ec:1.6.99.1] [keggfc:14.1] [sgdfc:2.8.0] [db:gtc-saccharomyces cerevisiae] |
| CONTIG567 | 25508462_c3_4 | 3303 | 17406 | 591 | 197 | YPL171C | 383 | 1.5(10)-35 | Saccharomyces cerevisiae | [ui:ypl171c] [pn:napdh dehydrogenase:old yellow enzyme, isoform 3:nadph dehydrogenase 3:old yellow |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4807 | 24318752_f1_1 | 3304 | 17407 | 285 | 95 | YGR204W | 404 | 1.1(10)-36 | Saccharomyces cerevisiae | enzyme 3] [gn:oye3:p2291] [gtcfc:1.8] [ec:1.6.99.1] [keggfc:14.1] [sgdfc:2.8.0] [db:gtc-saccharomyces cerevisiae] [ui:ygr204w] [pn:c1-tetrahydrofolate synthase:trifunctional enzyme,cytoplasmic:c-1-tetrahydrofolate synthase, cytoplasmic:methylenetetrahydrofolate dehydrogenase/methenyltetrahydrofolate cyclohydrolase/formyltetrahydrofolate synthe |
| CONTIG5544 | 4775775_c1_14 | 3305 | 17408 | 984 | 328 | YKR080W | 957 | 2.2(10)-96 | Saccharomyces cerevisiae | [ui:ykr080w] [pn:methylenetetrahydrofolate dehydrogenase:nad+] [gn:mtd1:ykr400] [gtcfc:10.7.1.9; 4.1.9.6] [keggfc:1.9.9.8] [sgdfc:1.3.1.9.2.0] [db:gtc-saccharomyces cerevisiae] |
| CONTIG1765 | 30738136_f2_1 | 3306 | 17409 | 249 | 83 | YBL099W | 197 | 6.5(10)-15 | Saccharomyces cerevisiae | [ui:ybl099w] [pn:f1f0-atpase complex, f1 alpha subunit:atp synthase alpha chain, mitochondrial precursor] [gn:atp1:ybl0827] [gtcfc:2.1:2.8:12.6] [ec:3.6.1.34] [keggfc:2.1] [sgdfc:1.8.2:2.5.0:7.8.0.8.2.0: 9.7.0] [db:gtc-saccharomyces ce |
| CONTIG2935 | 14548883_f3_5 | 3307 | 17410 | 225 | 75 | YBL099W | 165 | 1.8(10)-11 | Saccharomyces cerevisiae | [ui:ybl099w] [pn:f1f0-atpase complex, f1 alpha subunit:atp synthase alpha chain, mitochondrial precursor] [gn:atp1:ybl0827] [gtcfc:2.1:2.8:12.6] [ec:3.6.1.34] [keggfc:2.1] [sgdfc:1.8.2:2.5.0:7.8.0.8.2.0: 9.7.0] [db:gtc-saccharomyces ce |
| CONTIG2935 | 4069812_f1_2 | 3308 | 17411 | 201 | 67 | YBL099W | 163 | 3.1(10)-11 | Saccharomyces cerevisiae | [ui:ybl099w] [pn:f1f0-atpase complex, f1 alpha subunit:atp synthase alpha chain, mitochondrial precursor] [gn:atp1:ybl0827] [gtcfc:2.1:2.8:12.6] [ec:3.6.1.34] [keggfc:2.1] [sgdfc:1.8.2:2.5.0:7.8.0.8.2.0: 9.7.0] [db:gtc-saccharomyces ce |
| CONTIG3694 | 16411067_c2_6 | 3309 | 17412 | 654 | 218 | YBL099W | 862 | 2.7(10)-86 | Saccharomyces cerevisiae | [ui:ybl099w] [pn:f1f0-atpase complex, f1 alpha subunit:atp synthase alpha chain, mitochondrial precursor] [gn:atp1:ybl0827] [gtcfc:2.1:2.8:12.6] [ec:3.6.1.34] [keggfc:2.1] [sgdfc:1.8.2:2.5.0:7.8.0.8.2.0: 9.7.0] [db:gtc-saccharomyces ce |
| CONTIG5727 | 32432775_c2_22 | 3310 | 17413 | 1464 | 488 | YBL045C | 754 | 7.5(10)-75 | Saccharomyces cerevisiae | [ui:ybl045c] [pn:ubiquinol-cytochrome-c reductase 44k core protein:ubiquinol-cytochrome-c reductase complex core protein i precursor] [gtcfc:1.8] [gn:qer1:cor1:ybl0403] [keggfc:2.1] [ec:1.10.2.2] [sgdfc:2.5.0.9.7.0] [db:gtc-saccha |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3623 | 20319502_f1_1 | 3311 | 17414 | 240 | 80 | YBR011C | 284 | 4.7(10)-25 | Saccharomyces cerevisiae | [ui:ybr011c] [pn:inorganic pyrophosphatase, cytoplasmic:inorganic pyrophosphatase:pyrophosphate phospho-hydrolase] [gn:ipp1:ppa1:ppa:ybr0202] [gtcfc:2.1:13.10] [ec:3.6.1.1] [keggfc:2.1] [sgdfc:1.4.1:9.2.0] [db:gtc-saccharomyces] |
| CONTIG3623 | 15742305_f2_3 | 3312 | 17415 | 624 | 208 | YBR011C | 638 | 1.5(10)-62 | Saccharomyces cerevisiae | [ui:ybr011c] [pn:inorganic pyrophosphatase, cytoplasmic:inorganic pyrophosphatase:pyrophosphate phospho-hydrolase] [gn:ipp1:ppa1:ppa:ybr0202] [gtcfc:2.1:13.10] [ec:3.6.1.1] [keggfc:2.1] [sgdfc:1.4.1:9.2.0] [db:gtc-saccharomyces] |
| CONTIG2846 | 33719567_c1_4 | 3313 | 17416 | 552 | 184 | YBR039W | 533 | 2.0(10)-51 | Saccharomyces cerevisiae | [ui:ybr039w] [pn:f1f0-atpase complex, f1 gamma subunit:atp synthase gamma chain, mitochondrial precursor] [gn:atp3:ybr0408] [gtcfc:2.1:2.8:12.6] [ec:3.6.1.34] [keggfc:2.1] [sdgfc:1.8.2:2.5.0:7.8.0:8.2.0:9.7.0] [db:gtc-saccharomyces ce] |
| CONTIG4062 | 89787_c2_7 | 3314 | 17417 | 846 | 282 | YBR127C | 1250 | 2.1(10)-127 | Saccharomyces cerevisiae | [ui:ybr127c] [pn:h+-atpase v1 domain 60 kd subunit, vacuolar:vacuolar atp synthase subunit b: v-atpase 57 kd subunit] [gn:fma2:vat2:ybr1002] [gtcfc:2.1:12.13:12.16:12.5:12.6] [ec:3.6.1.34] [keggfc:2.1] |
| CONTIG4062 | 4726061_c1_6 | 3315 | 17418 | 747 | 249 | YBR127C | 1092 | 1.1(10)-110 | Saccharomyces cerevisiae | [ui:ybr127c] [pn:h+-atpase v1 domain 60 kd subunit, vacuolar:vacuolar atp synthase subunit b: v-atpase 57 kd subunit] [gn:fma2:vat2:ybr1002] [gtcfc:2.1:12.13:12.16:12.5:12.6] [ec:3.6.1.34] [keggfc:2.1] |
| CONTIG269 | 24096875_f1_1 | 3316 | 17419 | 477 | 159 | YDL185W | 551 | 2.3(10)-52 | Saccharomyces cerevisiae | [sgdfc:1.8.2:7.2.2:7.8.0:8.5.0:9.] [ui:ydl185w] [pn:h+-atpase v1 domain 69 kd catalytic subunit, vacuolar:vacuolar atp synthase catalytic subunit a:contains:vmaI-derived endonuclease:vdc:pi-sce i endonuclease] [gn:vmaI:tfp1:cls8:d1286:vde] |
| CONTIG5373 | 10643761_c3_11 | 3317 | 17420 | 504 | 168 | YDL185W | 750 | 3.2(10)-74 | Saccharomyces cerevisiae | [ui:ydl185w] [pn:h+-atpase v1 domain 69 kd catalytic subunit, vacuolar:vacuolar atp synthase catalytic subunit a:contains:vmaI-derived endonuclease:vdc:pi-sce i endonuclease] [gn:vmaI:tfp1:cls8:d1286:vde] |

TABLE 2-continued

| Contig | Orf | ntID | aaID | nt Length | aa Length | Blast Score | Blast Probability | Subject Name | Subject Taxonomy | Subject Definition |
|---|---|---|---|---|---|---|---|---|---|---|
| CONTIG5373 | 4461_c3_10 | 3318 | 17421 | 1368 | 456 | 1270 | 3.5(10)-215 | YDL185W | Saccharomyces cerevisiae | [ui:ydl185w] [pn:h+-atpase v1 domain 69 kd catalytic subunit, vacuolar:vacuolar atp synthase catalytic subunit a:contains:vmal-derived endonuclease:vdcpi-sce i endonuclease] [gn:vmal:tfp1:cls8:d1286:vde] [gtcfc:2.1:12.13:12.16:12.5:12] |
| CONTIG5447 | 1000338_f2_5 | 3319 | 17422 | 627 | 209 | 372 | 2.2(10)-34 | YDL004W | Saccharomyces cerevisiae | [ui:yd1004w] [pn:f1f0-atpase complex, f1 delta subunit:atp synthase delta chain, mitochondrial precursor] [gn:atp16:atp4:atp14:yd18119] [gtcfc:2.1:2.8:12.6] [ec:3.6.1.34] [keggfc:2.1] [sgdfc: 1.8.2:2.5.0:7.8.0:8.2.0:9.7.0] [db:gtc-sacch] |
| CONTIG5720 | 15039087_f3_15 | 3320 | 17423 | 687 | 229 | 492 | 4.4(10)-47 | YDR298C | Saccharomyces cerevisiae | [ui:ydr298c] [pn:f1f0-atpase complex, oscp subunit:atp synthase oligomycin sensitivity conferral protein precursor, mitochondrial:oscp:atp synthase chain 5] [gn:atp5:ascp:d9740] [gtcfc:2.1.2.8:12.6] [ec:3.6.1.34] [keggfc:2.1] [sgdfc:1] |
| CONTIG1452 | 408442_f1_2 | 3321 | 17424 | 387 | 129 | 271 | 1.1(10)-23 | YDR529C | Saccharomyces cerevisiae | [ui:ydr529c] [pn:ubiquinol cytochrome-c reductase subunit 7:ubiquinol-cytochrom c reductase complex 14 kd protein:complex iii subunit vii] [gn:qcr7:ero1:ucr7:d9719] [gtcfc:2.1:2.8] [ec:1.10.2.2] [keggfc:2.1] [sgdfc:2.5:0:9.7.0] [dbg] |
| CONTIG1518 | 10969056_f1_2 | 3322 | 17425 | 576 | 192 | 683 | 2.5(10)-67 | YEL051W | Saccharomyces cerevisiae | [ui:yel051w] [pn:h+atpsynthase v1 domain 32 kd subunit, vacuolar:vacuolar atp synthase subunit d:v-atpase d subunit] [gn:vma8:sygp-orf11] [gtcfc:2.1:12.13:12.16:12.5:12.6] [ec:3.6.1.34] [keggfc:2.1] [sgdfc:1.8.2:7.2.2:7.8.0:8.5.0:9.1] |
| CONTIG347 | 969003_c2_3 | 3323 | 17426 | 315 | 105 | 182 | 3.1(10)-14 | YEL051W | Saccharomyces cerevisiae | [ui:yel051w] [pn:h+atpsynthase v1 domain 32 kd subunit, vacuolar:vacuolar atp synthase subunit d:v-atpase d subunit] [gn:vma8:sygp-orf11] [gtcfc:2.1:12.13:12.16:12.5:12.6] [ec:3.6.1.34] [keggfc:2.1] [sgdfc:1.8.2:7.2.2:7.8.0:8.5.0:9.1] |
| CONTIG5740 | 10053126_f3_9 | 3324 | 17427 | 600 | 200 | 742 | 1.3(10)-73 | YEL024W | Saccharomyces cerevisiae | [ui:yel024w] [pn:ubiquinol--cytochrome-c reductase iron-sulfur protein precursor:u biquinol-cytochrome c reductase iron-sulfur subunit precursor:rieske iron-sulfur protein:risp1] [gn:rip1] [gtcfc:2.1.2.8] [keggfc:2.1] [ec: 1.10.2.2] [sgd] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4983 | 2637543l_c1_10 | 3325 | 17428 | 351 | 117 | YFR033C | 193 | 2.1(10)-15 | Saccharomyces cerevisiae | [ui:yfr033c] [pn:ubiquinol--cytochrome-c reductase 17k protein:ubiquinol-cytochrome c reductase complex 17 kd protein:mitochondrial hinge protein:complex iii polypeptide vi] [gn:qcr6ucr6] [ec:1.10.2.2] [keggfc:2.1] [s] [gtcfc:2.1.2.8] |
| CONTIG3417 | 3429840_c2_4 | 3326 | 17429 | 504 | 168 | YGL191W | 289 | 1.3(10)-25 | Saccharomyces cerevisiae | [ui:ygl191w] [pn:cytochrome-c oxidase chain via:cytochrome c oxidase polypeptide via precursor] [gn:cos13;g1341] [gtcfc:2.1.2.8] [ec:1.9.3.1] [keggfc:2.1] [sgdfc:2.5.0:9.7.0] [db:gtc-saccharomyces cerevisiae] |
| CONTIG5435 | 1048127_f1_1 | 3327 | 17430 | 492 | 164 | YGL187C | 371 | 2.8(10)-34 | Saccharomyces cerevisiae | [ui:ygl187c] [pn:cytochrome-c oxidase chain iv:cytochrome c oxidase polypeptide iv precursor] [gn:cox4;g1362] [gtcfc:2.1.2.8] [ec:1.9.3.1] [keggfc:2.1] [sgdfc:2.5.0:9.7.0] [db: gtc-saccharomyces cerevisiae] |
| CONTIG2979 | 26267512_c3_12 | 3328 | 17431 | 495 | 165 | YGR020C | 417 | 3.8(10)-39 | Saccharomyces cerevisiae | [ui:ygr020c] [pn:h+-atpase v1 domain 14 kda subunit, vacuolar:vacuolar atp synthase 14 kd subunit:v-atpase f subunit] [gn:vma7] [gtcfc:2.1.12.13;12.16;12.5.12.6] [ec:3.6.1.34] [keggfc:2.1] |
| CONTIG3241 | 11223961_c3_7 | 3329 | 17432 | 222 | 74 | YGR020C | 251 | 1.5(10)-21 | Saccharomyces cerevisiae | [sgdfc:1.8.2;7.2.2;7.8.0.8.5.0;9.10.0] [db:gt] [ui:ygr020c] [pn:h+-atpase v1 domain 14 kda subunit, vacuolar:vacuolar atp synthase 14 kd subunit: v-atpase f subunit] [gn:vma7] [gtcfc:2.1.12.13;12.16;12.5.12.6] [ec:3.6.1.34] [keggfc:2.1] [sgdfc: 1.8.2;7.2.2;7.8.0.8.5.0;9.10.0] [db:gt] |
| CONTIG3488 | 9807927_f3_3 | 3330 | 17433 | 240 | 80 | YGR183C | 111 | 1.0(10)-6 | Saccharomyces cerevisiae | [ui:ygr183c] [pn:ubiquinol cytochrome c reductase subunit 9:ubiquinol-cytochrome c reductase complex 7.3 kd protein:complex iii polypeptide ix] [gn:qer9;ucr9] [gtcfc:2.1.2.8] [ec:1.10.2.2] [keggfc:2.1] |
| CONTIG754 | 14570318_c2_2 | 3331 | 17434 | 321 | 107 | YHR051W | 328 | 1.0(10)-29 | Saccharomyces cerevisiae | [ui:yhr051w] [pn:cytochrome c oxidase subunit vi:cytochrome c oxidase polypeptide vi precursor] [gn:cox6] [gtcfc:2.1.2.8] [ec:1.9.3.1] [keggfc:2.1] [sgdfc:2.5.0:9.7.0] [db:gtc-sacc] |
| CONTIG5151 | 2128802_f2_3 | 3332 | 17435 | 345 | 115 | YJL166W | 331 | 5.0(10)-30 | Saccharomyces cerevisiae | [ui:yjl166w] [pn:ubiquinol-cytochrome c reductase chain viii:ubiquinol-cytochrome c reductase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | complex ubiquinone-binding protein qp-c:ubiquinol-cytochrome c reductase complex 11 kd protein: complex iii subunit viii [gn:qcr8;j0526] [gt] |
| CONTIG5804 | 4725785_f2_22 | 3333 | 17436 | 1596 | 532 | YJR121W | 2122 | 8.1(10)-220 | Saccharomyces cerevisiae | [ui:yjr121w] [pn:f1f0-atpase complex, f1 beta subunit:atp synthase beta chain, mitochondrial precursor] [gn:atp2;j2041] [gtcfc:2.1;2.8;12.6] [ec:3.6.1.34] [keggfc:2.1] [sgdfc:1.8;2.2;5.0;7.8;0.8;2.0;9.7.0] [db:gtc-saccharomyces cerevi] |
| CONTIG3015 | 10680437_f2_2 | 3334 | 17437 | 369 | 123 | YKL192C | 151 | 5.9(10)-11 | Saccharomyces cerevisiae | [ui:ykl192c] [pn:strong similarity to n. crassa s. pombe and a. thaliana acyl-carrier proteins:acyl carrier protein, mitochondrial precursor:acp:nadh- ubiquinone oxidoreductase 9.6 kd subunit] |
| CONTIG5506 | 23447192_c1_9 | 3335 | 17438 | 336 | 112 | YKL192C | 172 | 3.5(10)-13 | Saccharomyces cerevisiae | [gtcfc:2.1;2.8;3.4;8.1;8.2;9.12] [keggfc:2.1] [ui:ykl192c] [pn:strong similarity to n. crassa s. pombe and a. thaliana acyl-carrier proteins:acyl carrier protein, mitochondrial precursor:acp:nadh- ubiquinone oxidoreductase 9.6 kd subunit] |
| CONTIG3620 | 33437811_f3_1 | 3336 | 17439 | 948 | 316 | YKL080W | 733 | 1.3(10)-72 | Saccharomyces cerevisiae | [gtcfc:2.1;2.8;3.4;8.1;8.2;9.12] [keggfc:2.1] [ui:ykl080w] [pn:h+-atpase v1 domain 42 kd subunit, vacuolar:vacuolar atp synthase subunit cv-atpase c subunit:v-atpase 42 kd subunit] [gn:vma5;vat3;vat;cykl410] [gtcfc:2.1;12.13;12.16;12.5;12.6] [ec:3.6.1.34] [keg-gfc:2.1] [sgdfc:1.] |
| CONTIG4408 | 26182837_f3_3 | 3337 | 17440 | 645 | 215 | YKL016C | 441 | 1.1(10)-41 | Saccharomyces cerevisiae | [ui:ykl016c] [pn:f1f0-atpase complex, fo d subunit:atp synthase d chain, mitochondrial] [gn:atp7] [gtcfc:2.1;2.8;12.6] [ec:3.6.1.34] [keggfc:2.1] [sgdfc:1.8.2;2.5.0;7.8.0;8.2.0;9.7.0] [db:gtc-saccharomyces cerevisiae] |
| CONTIG3201 | 20391932_c2_8 | 3338 | 17441 | 267 | 89 | YLR038C | 294 | 4.2(10)-26 | Saccharomyces cerevisiae | [ui:ylr038c] [pn:cytochrome-c oxidase, subunit vib:cytochrome c oxidase polypeptide vib:aed] [gn:cox12] [gtcfc:2.1.2.8;12.16] [ec:1.9.3.1] [keggfc:2.1] [sgdfc:2.5.0;6.4.0;9.7.0] [db:gtc-saccharomyces cerevisiae] |
| CONTIG5669 | 1032635_c2_26 | 3339 | 17442 | 315 | 105 | YLR395C | 112 | 8.0(10)-7 | Saccharomyces cerevisiae | [ui:ylr395c] [pn:cytochrome-c oxidase chain viii:cytochrome c oxidase polypeptide viii |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5606 | 26047716_f1_1 | 3340 | 17443 | 1170 | 390 | YLR447C | 1082 | 1.3(10)-109 | Saccharomyces cerevisiae | precursor] [gn:cox8:18084] [gtcfc:2.1.2.8] [ec:1.9.3.1] [keggfc:2.1] [sgdfc:2.5.0:9.7.0] [db:gtc-saccharomyces cerevisiae] [ui:ylr447c] [pn:h+atpase v0 domain 36 kd subunit, vacuolar:vacuolar atp synthase subunit ac39:v-atpase ac39 subunit:v-atpase subunit m39] [gn:vma6:i9924] [gtcfc:2.1:12.13:12.16:12.5:12.6] [ec:3.6.1.34] [keggfc:2.1] [sgdfc:1.8.2:6.4.] |
| CONTIG5103 | 4859512_f1_1 | 3341 | 17444 | 1956 | 652 | YML120C | 997 | 1.3(10)-100 | Saccharomyces cerevisiae | [ui:yml120c] [pn:nadh-ubiquinone-6 oxidoreductase:rotenone-insensitive nadh-ubiquinone oxidoreductase precursor:internal nadh dehydrogenase] [gn:ndi1:ym7056] [ec:1.6.5.3] [keggfc:2.1.2.8:9.12] |
| CONTIG5422 | 14897143_f3_9 | 3342 | 17445 | 591 | 197 | YMR054W | 500 | 3.8(10)-47 | Saccharomyces cerevisiae | [sgdfc:1.7.2:9.7.0] [db:] [ui:ymr054w] [pn:h+atpase v0 domain 102 kd subunit, vacuolar:vacuolar atp synthase 101 kd subunit:v-atpase subunit ac115] [gn:stv1:ym9796] [gtcfc:2.1.12.13:12.5:12.6] [ec:3.6.1.34] [keggfc:2.1] [sgdfc:1.8.2:7.2.2:7.8.0:8.5.0] [db:gtc |
| CONTIG218 | 24485885_f2_1 | 3343 | 17446 | 333 | 111 | YMR256C | 120 | 1.1(10)-7 | Saccharomyces cerevisiae | [ui:ymr256c] [pn:cytochrome-c oxidase, subunit vii:cytochrome c oxidase polypeptide vii] [gn: cox7:ym7256w:ym9920] [gtcfc:2.1.2.8:12.16] [ec:1.9.3.1] [keggfc:2.1] [sgdfc:2.5.0:6.4.0:9.7.0] [db:gtc-saccharomyces cerevisiae] |
| CONTIG32 | 34586578_c2_5 | 3344 | 17447 | 315 | 105 | YMR256C | 151 | 5.9(10)-11 | Saccharomyces cerevisiae | [ui:ymr256c] [pn:cytochrome-c oxidase, subunit vii:cytochrome c oxidase polypeptide vii] [gn: cox7:ym7256w:ym9920] [gtcfc:2.1.2.8:12.16] [ec:1.9.3.1] [keggfc:2.1] [sgdfc:2.5.0:6.4.0:9.7.0] [db:gtc-saccharomyces cerevisiae] |
| CONTIG3740 | 2441405_f1_2 | 3345 | 17448 | 528 | 176 | YNL052W | 332 | 3.8(10)-30 | Saccharomyces cerevisiae | [ui:ynl052w] [pn:cytochrome-c oxidase chain v.a precursor:cytochrome c oxidase polypeptide va precursor] [gn:cos5a:n2474:ynl2474w] [gtcfc:2.1.2.8] [ec:1.9.3.1] [keggfc:2.1] [sgdfc:2.5.0:9.7.0] |
| CONTIG3408 | 10813307_c3_11 | 3346 | 17449 | 1080 | 360 | YOR270C | 331 | 3.3(10)-41 | Saccharomyces cerevisiae | [ui:yor270c] [pn:h+atpase v0 domain 95k subunit, vacuolar:vacuolar atp synthase 95.5 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3408 | 9783405_c1_9 | 3347 | 17450 | 537 | 179 | YOR270C | 220 | 4.7(10)-17 | Saccharomyces cerevisiae | subunit] [gn:vph1] [gtcfc:2.1:10.7:11.1:12.13:12.16:12.5:12.6] [ec:3.6.1.34] [keggfc:2.1] [sgdfc: 1.8.2:6.2.0:6.4.0:7.2.2:7.8.0:8.5.0:9.10.0] [db:] [ui:yor270c] [pn:h+atpase v0 domain 95k subunit, vacuolar:vacuolar atp synthase 95.5 kd |
| CONTIG2778 | 24644577_f3_3 | 3348 | 17451 | 1161 | 387 | YOR270C | 1323 | 3.7(10)-135 | Saccharomyces cerevisiae | subunit] [gn:vph1] [gtcfc:2.1:10.7:11.1:12.13:12.16:12.5:12.6] [ec:3.6.1.34] [keggfc:2.1] [sgdfc: 1.8.2:6.2.0:6.4.0:7.2.2:7.8.0:8.5.0:9.10.0] [db:] [ui:yor270c] [pn:h+atpase v0 domain 95k subunit, vacuolar:vacuolar atp synthase 95.5 kd |
| CONTIG4314 | 10163206_c2_6 | 3349 | 17452 | 1275 | 425 | YOR270C | 916 | 5.0(10)-92 | Saccharomyces cerevisiae | subunit] [gn:vph1] [gtcfc:2.1:10.7:11.1:12.13:12.16:12.5:12.6] [ec:3.6.1.34] [keggfc:2.1] [sgdfc: 1.8.2:6.2.0:6.4.0:7.2.2:7.8.0:8.5.0:9.10.0] [db:] [ui:yor270c] [pn:h+atpase v0 domain 95k subunit, vacuolar:vacuolar atp synthase 95.5 kd |
| CONTIG5422 | 1387780_f1_1 | 3350 | 17453 | 561 | 187 | YOR270C | 554 | 3.1(10)-53 | Saccharomyces cerevisiae | subunit] [gn:vph1] [gtcfc:2.1:10.7:11.1:12.13:12.16:12.5:12.6] [ec:3.6.1.34] [keggfc:2.1] [sgdfc: 1.8.2:6.2.0:6.4.0:7.2.2:7.8.0:8.5.0:9.10.0] [db:] [ui:yor332w] [pn:h+atpase v1 domain 27 kd subunit, vacuolar:vacuolar atp synthase |
| CONTIG4036 | 24695253_c2_6 | 3351 | 17454 | 660 | 220 | YOR332W | 489 | 9.0(10)-47 | Saccharomyces cerevisiae | ev-atpase e subunit:v-atpase 27 kd subunit] [gn:vma4:vat5] [gtcfc:2.1:12.13:12.16:12.5:12.6] [keggfc:2.1] [ec: 3.6.1.34] [sgdfc:1.8.2:6.4.0:7.2] |
| CONTIG5236 | 34664087_f3_7 | 3352 | 17455 | 780 | 260 | YPL078C | 621 | 9.3(10)-61 | Saccharomyces cerevisiae | [ui:ypl078c] [pn:f1f0-atpase complex, f1 delta subunit] [gn:atp4] [gtcfc:2.1:2.5:0:7.8.0:8.2.0:9.7.0] [db:gtc-[ec:3.6.1.34] [keggfc:2.1] [sgdfc:1.8.2:2.5.0:7.8.0:8.2.0:9.7.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4312 | 22297800_c3_7 | 3353 | 17456 | 1407 | 469 | YPR036W | 350 | 4.9(10)-32 | Saccharomyces cerevisiae | [ui:ypr036w] [pn:h+-atpase v1 domain 54 kd subunit, vacuolar vacuolar atp synthase 54 kd subunit v- atpase 54 kd subunit] [gn:vma13:cls11:ypr3085] [gtcfc:2.1:12.13:12.16:12.5:12.6] [ec:3.6.1.34] [keggfc:2.1] |
| CONTIG3838 | 10659407_c2_2 | 3354 | 17457 | 1149 | 383 | YPR191W | 578 | 3.3(10)-56 | Saccharomyces cerevisiae | [sgdfc:1.8.2:7.2.2:7.8.0.8.] [ui:ypr191w] [pn:ubiquinol-cytochrome-c reductase 40 kd chain ii:ubiquinol-cyto-chrome c reductase complex core protein 2 precursor] [gn:qcr2:cor2:ucr2:p9677] [gtcfc:2.1.2.8:12.16] [ec:1.10.2.2] [keggfc:2.1] |
| CONTIG4568 | 212950_c2_7 | 3355 | 17458 | 369 | 123 | YBR263W | 346 | 3.7(10)-31 | Saccharomyces cerevisiae | [sgdfc:2.5.0:6.4.0.9.7.0] [d] [ui:ybr263w] [pn:serine hydroxymethyl-transferase precursor, mitochondrial:serine hydroxymethyltransferase, mitochondrial precursor:serine methylase:glycine hydroxymethyltransferase:shm1] [gn:shm1:shmt1:ybr1732] [gtcfc:2.2.2.8:3.4.4.1:5] |
| CONTIG5207 | 3395261_f1_2 | 3356 | 17459 | 840 | 280 | YBR263W | 809 | 1.1(10)-80 | Saccharomyces cerevisiae | [ui:ybr263w] [pn:serine hydroxymethyl-transferase precursor, mitochondrial:serine hydroxymethyltransferase, mitochondrial precursor:serine methylase:glycine hydroxymethyltransferase:shm1] [gn:shm1:shmt1:ybr1732] [gtcfc:2.2.2.8:3.4.4.1:5] |
| CONTIG1516 | 10972807_f2_2 | 3357 | 17460 | 621 | 207 | YDL198C | 828 | 1.1(10)-82 | Saccharomyces cerevisiae | [ui:ydl198c] [pn:member of the mitochon-drial carrier family:mcf:putative mitochon-drial carrier protein yhm1/shm1] [gn:yhm1:shm1:d1214] [gtcfc:2.2.2:8:5.3:5.9:6.5:9.3:9.6:12.2] [ec:2.1.2.1] [keggfc:2.2:5.3:5.9:6.5:9.3:9.8] [sgdfc:7.3.0] |
| CONTIG2782 | 22069376_f3_2 | 3358 | 17461 | 291 | 97 | YDL198C | 283 | 6.0(10)-25 | Saccharomyces cerevisiae | [ui:ydl198c] [pn:member of the mitochon-drial carrier family:mcf:putative mitochon-drial carrier protein yhm1/shm1] [gn:yhm1:shm1:d1214] [gtcfc:2.2.2:8:5.3:5.9:6.5:9.3:9.6:12.2] [ec:2.1.2.1] [keggfc:2.2:5.3:5.9:6.5:9.3:9.8] [sgdfc:7.3.0] |
| CONTIG5380 | 35167181_c1_13 | 3359 | 17462 | 627 | 209 | YKR256C | 541 | 2.7(10)-52 | Saccharomyces cerevisiae | [ui:ydr256c] [pn:catalase a, peroxisomal-:catalase a] [gn:cta1:yd9320a] [gtcfc:2.2.5.14:12.12:12.6] [ec:1.11.1.6] [keggfc:2.2:5.14] [sgdfc:9.8.0:11.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5380 | 4063813_c3_16 | 3360 | 17463 | 963 | 321 | YDR256C | 1180 | 5.4(10)-120 | Saccharomyces cerevisiae | [ui:ydr256c] [pn:catalase a, peroxisomal :catalase a] [gn:cta1:yd9320a] [gtcfc:2.2.5.14:12:12.12.6] [ec:1.11.1.6] [keggfc:2.2.5.14] [sgdfc:9.8.0:11.3.0] [db:gtc-saccharomyces cerevisiae] |
| CONTIG3794 | 11875936_f2_1 | 3361 | 17464 | 1431 | 477 | YLR058C | 2016 | 1.3(10)-208 | Saccharomyces cerevisiae | [ui:ylr058c] [pn:serine hydroxymethyltransferase, cytoplasmic:serine hydroxymethyl-transferase, cytosolic: serine methylase:glycine hydroxymethyl-transferase:shmt1] [gn:shm2:shmt2:j2156] [gtcfc:2.2.3.4.4.1.5.3: 5.9:6.5:8.1:8.2:9.3:9.6] [ec] |
| CONTIG817 | 600125_f3_2 | 3362 | 17465 | 594 | 198 | YHL008C | 521 | 3.7(10)-50 | Saccharomyces cerevisiae | [ui:yhl008c] [pn:similarity to m. formicicum formate dehydrogenase:hypothetical 70.0 kd protein in prps4-ste20 intergenic region] [gtcfc:2.2] [keggfc:14.2] [sgdfc:2.6.0] [db-gtc-saccharomyces cerevisiae] |
| CONTIG4187 | 35196900_f2_3 | 3363 | 17466 | 1260 | 420 | YHR039C | 1394 | 1.1(10)-142 | Saccharomyces cerevisiae | [ui:yhr039c] [pn:similarity to aldehyde dehydrogenases:hypothetical aldehyde-dehydrogenase like protein in put2-srb2 intergenic region] [gtcfc:2.2] [keggfc:14.2] [sgdfc:2.6.0] [db-gtc-saccharomyces cerevisiae] |
| CONTIG4700 | 12692528_f3_6 | 3364 | 17467 | 1248 | 416 | YMR285C | 840 | 5.7(10)-84 | Saccharomyces cerevisiae | [ui:ymr285c] [pn:similarity to ccr4p] [gtcfc:2.2] [keggfc:14.2] [sgdfc:2.6.0] [db-gtc-saccharomyces cerevisiae |
| CONTIG2216 | 26176250_c2_3 | 3365 | 17468 | 564 | 188 | YOR388C | 556 | 7.2(10)-54 | Saccharomyces cerevisiae | [ui:yor388c] [pn:strong similarity to h. polymorpha formate dehydrogenase] [gtcfc:2.2] [sgdfc: 14.2] [sgdfc:2.6.0] [db:gtc-saccharomyces cerevisiae] |
| CONTIG2216 | 12692127_c3_5 | 3366 | 17469 | 432 | 144 | YOR388C | 439 | 1.8(10)-41 | Saccharomyces cerevisiae | [ui:yor388c] [pn:strong similarity to h. polymorpha formate dehydrogenase] [gtcfc:2.2] [sgdfc: 14.2] [sgdfc:2.6.0] [db:gtc-saccharomyces cerevisiae] |
| CONTIG2613 | 12692127_f1_1 | 3367 | 17470 | 351 | 117 | YOR388C | 226 | 1.3(10)-18 | Saccharomyces cerevisiae | [ui:yor388c] [pn:strong similarity to h. polymorpha formate dehydrogenase] [gtcfc:2.2] [sgdfc: 14.2] [sgdfc:2.6.0] [db:gtc-saccharomyces cerevisiae] |
| CONTIG2613 | 3147050_f2_4 | 3368 | 17471 | 249 | 83 | YOR388C | 218 | 1.1(10)-17 | Saccharomyces cerevisiae | [ui:yor388c] [pn:strong similarity to h. polymorpha formate dehydrogenase] [keggfc: 14.2] [sgdfc:2.6.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2613 | 26176250_f1_2 | 3369 | 17472 | 306 | 102 | YOR388C | 295 | 3.2(10)-26 | Saccharomyces cerevisiae | [ui:yor388c] [pn:strong similarity to h. polymorpha formate dehydrogenase] [gt:cfc:2.2] [keggfc: 14.2] [sgdfc:2.6.0] [db:gtc-saccharomyces cerevisiae] |
| CONTIG4206 | 24335941_f2_4 | 3370 | 17473 | 555 | 185 | YOR388C | 544 | 1.3(10)-52 | Saccharomyces cerevisiae | [ui:yor388c] [pn:strong similarity to h. polymorpha formate dehydrogenase] [gt:cfc:2.2] [keggfc: 14.2] [sgdfc:2.6.0] [db:gtc-saccharomyces cerevisiae] |
| CONTIG4790 | 36203812_c1_7 | 3371 | 17474 | 399 | 133 | YOR388C | 451 | 9.5(10)-43 | Saccharomyces cerevisiae | [ui:yor388c] [pn:strong similarity to h. polymorpha formate dehydrogenase] [gt:cfc:2.2] [keggfc: 14.2] [sgdfc:2.6.0] [db:gtc-saccharomyces cerevisiae] |
| CONTIG5272 | 22437686_f3_8 | 3372 | 17475 | 1182 | 394 | YOR388C | 1375 | 1.2(10)-140 | Saccharomyces cerevisiae | [ui:yor388c] [pn:strong similarity to h. polymorpha formate dehydrogenase] [gt:cfc:2.2] [keggfc: 14.2] [sgdfc:2.6.0] [db:gtc-saccharomyces cerevisiae] |
| CONTIG1771 | 3175836_f3_1 | 3373 | 17476 | 348 | 116 | YLR027C | 369 | 4.7(10)-34 | Saccharomyces cerevisiae | [ui:ylr027c] [pn:aspartate aminotransferase, cytosolic:aspartate aminotransferase, cytoplasmic:transaminase a] [gn:aat2] [gt:cfc:2.4.2.6:5.1:5.10:5.15:5.2:5.5:6.6] [ec:2.6.1.1] [keggfc:2.3:5.1:5.2:5.5:5.10: 5.15] [sgdfc:1.1.1.2.1:9.2.] |
| CONTIG2010 | 188900_f1_1 | 3374 | 17477 | 912 | 304 | YLR027C | 546 | 8.3(10)-53 | Saccharomyces cerevisiae | [ui:ylr027c] [pn:aspartate aminotransferase, cytosolic:aspartate aminotransferase, cytoplasmic:transaminase a] [gn:aat2] [gt:cfc:2.4.2.6:5.1:5.10:5.15:5.2:5.5:6.6] [ec:2.6.1.1] [keggfc:2.3:5.1:5.2:5.5:5.10: 5.15] [sgdfc:1.1.1.2.1:9.2.] |
| CONTIG3958 | 24225880_f1_2 | 3375 | 17478 | 867 | 289 | YLR027C | 869 | 4.9(10)-87 | Saccharomyces cerevisiae | [ui:ylr027c] [pn:aspartate aminotransferase, cytosolic:aspartate aminotransferase, cytoplasmic:transaminase a] [gn:aat2] [gt:cfc:2.4.2.6:5.1:5.10:5.15:5.2:5.5:6.6] [ec:2.6.1.1] [keggfc:2.3:5.1:5.2:5.5:5.10: 5.15] [sgdfc:1.1.1.2.1:9.2.] |
| CONTIG5189 | 33312513_c1_15 | 3376 | 17479 | 567 | 189 | YLR027C | 334 | 2.3(10)-30 | Saccharomyces cerevisiae | [ui:ylr027c] [pn:aspartate aminotransferase, cytosolic:aspartate aminotransferase, cytoplasmic:transaminase a] [gn:aat2] [gt:cfc:2.4.2.6:5.1:5.10:5.15:5.2:5.5:6.6] [ec:2.6.1.1] [keggfc:2.3:5.1:5.2:5.5:5.10: 5.15] [sgdfc:1.1.1.2.1:9.2.] |
| CONTIG5189 | 19729707_c3_25 | 3377 | 17480 | 726 | 242 | YLR027C | 385 | 9.5(10)-36 | Saccharomyces cerevisiae | [ui:ylr027c] [pn:aspartate aminotransferase, cytosolic:aspartate aminotransferase, cytoplasmic:transaminase a] [gn:aat2] [gt:cfc:2.4.2.6:5.1:5.10:5.15:5.2:5.5:6.6] [ec:2.6.1.1] [keggfc:2.3:5.1:5.2:5.5:5.10: 5.15] [sgdfc:1.1.1.2.1:9.2.] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | a1 [gn:aat2] [gtcfc:2.4.2.6:5.1:5.10:5.15:5.15:5.2:5.5:6.6] [ec:2.6.1.1] [keggfc:2.3:5.1:5.2:5.5:5.10: 5.15] [sgdfc:1.1.1:1.2.1:9.2.] |
| CONTIG4997 | 22531562_f2_2 | 3378 | 17481 | 1581 | 527 | YLR089C | 1449 | 1.7(10)-148 | Saccharomyces cerevisiae | [ui:ylr089c] [pn:strong similarity to alanine transaminases:putative alanine aminotransferase, mitochondrial precursor:glutamic–pyruvic transaminase:gpt:glutamic—alanine transaminase] [gn:i9449] [gtcfc:2.4.2.6:5.1:5.2:6.6] [ec:2.6.] |
| CONTIG5070 | 1179712_c1_6 | 3379 | 17482 | 531 | 177 | YAL062W | 563 | 1.3(10)-54 | Saccharomyces cerevisiae | [ui:yal062w] [pn:nadp-glutamate dehydrogenase:nadp-specific glutamate dehydrogenase 2:nadp-gdh 2] [gn:gdh3:fun51] [gtcfc:2.6:5.1:5.3] [ec:1.4.1.4] [keggfc:2.5:5.1] [sgdfc:1.1.4:1.2.1] [db: gtc-saccharomyces cerevisiae] |
| CONTIG5070 | 20348302_c3_12 | 3380 | 17483 | 897 | 299 | YAL062W | 1109 | 1.8(10)-112 | Saccharomyces cerevisiae | [ui:yal062w] [pn:nadp-glutamate dehydrogenase:nadp-specific glutamate dehydrogenase 2:nadp-gdh 2] [gn:gdh3:fun51] [gtcfc:2.6:5.1:5.3] [ec:1.4.1.4] [keggfc:2.5:5.1] [sgdfc:1.1.4:1.2.1] [db: gtc-saccharomyces cerevisiae] |
| CONTIG830 | 11992200_f1_1 | 3381 | 17484 | 369 | 123 | YAL012W | 275 | 4.2(10)-24 | Saccharomyces cerevisiae | [ui:yal012w] [pn:cystathionine gamma-lyase:gamma-cystathionase] [gn:cys3:cyi1:str1:fun35] [gtcfc: 2.6:5.4:5.5:4.5.5:6.4:6.6] [ec:4.4.1.1] [keggfc:2.5:5.4:5.5:4.5.5:6.4] [sgdfc:1.1.1:9.2.0] [db-gtc-saccharomyces cerevisiae] |
| CONTIG5658 | 13678188_f3_12 | 3382 | 17485 | 2760 | 920 | YDL215C | 1953 | 8.3(10)-225 | Saccharomyces cerevisiae | [ui:ydl215c] [pn:nad-specific glutamate dehydrogenase:nad-gdh] [gn:gdh2:d0892] [gtcfc:2.6:5.1: 5.3] [ec:1.4.1.2] [keggfc:2.5:5.1] [sgdfc:1.1.4:1.2.1:9.2.0] [db:gtc-saccharomyces cerevisiae] |
| b1x15140.x | 24015908_c3_1 | 3383 | 17486 | 294 | 98 | YDL215C | 222 | 4.2(10)-17 | Saccharomyces cerevisiae | [ui:ydl215c] [pn:nad-specific glutamate dehydrogenase:nad-gdh] [gn:gdh2:d0892] [gtcfc:2.6:5.1: 5.3] [ec:1.4.1.2] [keggfc:2.5:5.1] [sgdfc:1.1.4:1.2.1:9.2.0] [db:gtc-saccharomyces cerevisiae] |
| CONTIG3341 | 78142_c1_4 | 3384 | 17487 | 762 | 254 | YDR019C | 523 | 2.2(10)-50 | Saccharomyces cerevisiae | [ui:ydr019c] [pn:glycine decarboxylase t subunit:aminomethyltransferase precursor:glycine cleavage |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG346 | 4687750_f3_1 | 3385 | 17488 | 300 | 100 | YDR019C | 252 | 2.0(10)-21 | Saccharomyces cerevisiae | system t protein] [gn:gcv1:yd9335] [gtcfc:2.6:2.8:5.3:9.6] [ec:2.1.2.10] [db:gtc-saccharomyces gfc:2.5:5.3:9.8] [sgdfc:1.1.4:9.7.0] [ui:ydr019c] [pn:glycine decarboxylase t subunit:aminomethyltransferase precursor:glycine cleavage |
| CONTIG4640 | 4019436_f2_5 | 3386 | 17489 | 540 | 180 | YDR321W | 207 | 2.1(10)-16 | Saccharomyces cerevisiae | system t protein] [gn:gcv1:yd9335] [gtcfc:2.6:2.8:5.3:9.6] [ec:2.1.2.10] [keg-gfc:2.5:5.3:9.8] [sgdfc:1.1.4:9.7.0] [db:gtc-saccharomyces cerevisiae] [ui:ydr321w] [pn:asparaginase1-asparagi-nase i:1-asparagine amidohydrolase i:asp i] [gn:aspl:d9798] [gtcfc:2.6:5.2:5.3:6.5] [ec:3.5.1.1] [keg-gfc:2.5:5.2:6.5] [sgdfc:1.1.4:9.2.0] [db:gtc-saccharomyces cerevisiae] |
| CONTIG4492 | 32612890_c1_4 | 3387 | 17490 | 543 | 181 | YGR124W | 772 | 9.3(10)-77 | Saccharomyces cerevisiae | [ui:ygr124w] [pn:asparagine synthetase:g-lutamine-hydrolyzing 2:glutamine-depen-dent asparagine synthetase 2] [gn:asn2:g6358] [gtcfc:2.6:5.2:6.6] [ec:6.3.5.4] [keg-gfc:2.5:5.2] [sgdfc:1.1.1] [db:gtc-saccharomyces cerevisiae] |
| CONTIG4397 | 31447508_c2_3 | 3388 | 17491 | 684 | 228 | YLR155C | 329 | 6.0(10)-40 | Saccharomyces cerevisiae | [ui:ylr155c] [pn:l-asparaginase ii:1-asparagi-nase ii precursor:l-asparagine amidohydro-lase ii:asp ii] [gn:asp3a:asp3b:asp3c:asp3d:asp3:l9632] [gtcfc:2.6:5.2:5.3:6.5:11.1] [ec:3.5.1.1] [keggfc:2.5.5.2.6.5] [sgdfc:1.1.4:9.1.0] [db:gtc-s |
| CONTIG4327 | 22443936_c1_4 | 3389 | 17492 | 1152 | 384 | YPR035W | 1614 | 5.5(10)-166 | Saccharomyces cerevisiae | [ui:ypr035w] [pn:glutamine synthetase:g-lutamate-ammonia ligase] [gn:gln1:yp3085] [gtcfc:2.6:5.1: 6.6:11.4] [ec:6.3.1.2] [keggfc:5:5.17.3] [sgdfc:1.1.1:1.2.1:9.2.0] [dg:gtc-saccharo-myces cerevisiae] |
| CONTIG3616 | 4068777_f3_2 | 3390 | 17493 | 1215 | 405 | YPR145W | 1214 | 1.3(10)-123 | Saccharomyces cerevisiae | [ui:ypr145w] [pn:asparagine synthetase:g-lutamine-hydrolyzing 1:glutamine-depen-dent asparagine synthetase 1] [gn:asn1:p9659] [gtcfc:2.6:5.2:6.6] [ec:6.3.5.4] [keg-gfc:2.5:5.2] [sgdfc:1.1.1] [db:gtc-saccharomyces cerevisiae] |
| CONTIG5302 | 23937950_f3_5 | 3391 | 17494 | 3255 | 1085 | YBR208C | 3906 | 0 | Saccharomyces cerevisiae | [ui:ybr208c] [pn:urea amidolyase] [gn:dur1,2] [gtcfc:2.6.4.1:5.3] [keggfc:14.2] [sgdfc:1.1.4: 1.2.1.1.3.1] [db:gtc-saccharomyces cerevi-siae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5355 | 13672637_f2_2 | 3392 | 17495 | 2004 | 668 | YBR208C | 1998 | 1.1(10)-206 | Saccharomyces cerevisiae | [ui:ybr208c] [pn:urea amidolyase] [gn:dur1;2] [gtcfc:2.6:4.1:5.3] [keggfc:14.2] [sgdfc:1.1.4:1.2.1.1.3.1] [db:gtc-saccharomyces cerevisiae] |
| b1x16771.x | 26845062_f3_1 | 3393 | 17496 | 378 | 126 | YBR208C | 366 | 3.8(10)-32 | Saccharomyces cerevisiae | [ui:ybr208c] [pn:urea amidolyase] [gn:dur1;2] [gtcfc:2.6:4.1:5.3] [keggfc:14.2] [sgdfc:1.1.4:1.2.1.1.3.1] [db:gtc-saccharomyces cerevisiae] |
| CONTIG1182 | 7041075_c1_4 | 3394 | 17497 | 1362 | 454 | YDL171C | 1415 | 4.5(10)-144 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG1182 | 11761568_c3_8 | 3395 | 17498 | 306 | 102 | YDL171C | 150 | 4.4(10)-9 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG2377 | 4867692_f1_1 | 3396 | 17499 | 1011 | 337 | YDL171C | 1153 | 6.9(10)-116 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG5054 | 2236567_c3_12 | 3397 | 17500 | 414 | 138 | YDL171C | 412 | 6.2(10)-37 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG5716 | 6250_c1_20 | 3398 | 17501 | 1590 | 530 | YDL171C | 1525 | 3.3(10)-156 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG813 | 32610800_f3_2 | 3399 | 17502 | 456 | 152 | YDL171C | 454 | 2.1(10)-41 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| b9x13v34.x | 4149010_f1_1 | 3400 | 17503 | 483 | 161 | YDL171C | 660 | 2.6(10)-63 | Saccharomyces cerevisiae | [ui:ydl171c] [pn:glutamate synthase:napdph:gogat] [gn:glt1] [gtcfc:2.6:6.6] [keggfc:14.2] [sgdfc:1.1.1.2.1] [db:gtc-saccharomyces cerevisiae] |
| CONTIG3324 | 4689200_c3_6 | 3401 | 17504 | 1089 | 363 | YDR242W | 347 | 2.3(10)-41 | Saccharomyces cerevisiae | [ui:ydr242w] [pn:amidase:probable amidase] [gn:amd2:amdy1:amdy:yd8419] [gtcfc:2.6:5.10:5.13:5.14:6.5] [ec:3.5.1.4] [keggfc:5.10:5.13:5.14:6.5] [sgdfc:1.2.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4963 | 19703576_c3_9 | 3402 | 17505 | 1311 | 437 | YDR242W | 381 | 2.5(10)-35 | Saccharomyces cerevisiae | [ui:ydr242w] [pn:amidase:probable amidase] [gn:amd2:amdy1:amdy:yd8419] [gtcfc:2.6.5.10:5.13:5.14:6.5] [ec:3.5.1.4] [keggfc:5.10:5.13:5.14:6.5] [sgdfc:1.2.1] [db:gtc-saccharomyces cerevisiae] |
| CONTIG5006 | 9787676_c1_7 | 3403 | 17506 | 471 | 157 | YDR242W | 177 | 9.6(10)-13 | Saccharomyces cerevisiae | [ui:ydr242w] [pn:amidase:probable amidase] [gn:amd2:amdy1:amdy:yd8419] [gtcfc:2.6.5.10:5.13:5.14:6.5] [ec:3.5.1.4] [keggfc:5.10:5.13:5.14:6.5] [sgdfc:1.2.1] [db:gtc-saccharomyces cerevisiae] |
| CONTIG5529 | 10975912_c1_12 | 3404 | 17507 | 1728 | 576 | YDR242W | 577 | 4.2(10)-56 | Saccharomyces cerevisiae | [ui:ydr242w] [pn:amidase:probable amidase] [gn:amd2:amdy1:amdy:yd8419] [gtcfc:2.6.5.10:5.13:5.14:6.5] [ec:3.5.1.4] [keggfc:5.10:5.13:5.14:6.5] [sgdfc:1.2.1] [db:gtc-saccharomyces cerevisiae] |
| CONTIG4622 | 22322182_f1_1 | 3405 | 17508 | 966 | 322 | YDR353W | 1330 | 6.9(10)-136 | Saccharomyces cerevisiae | [ui:ydr353w] [pn:nadph:thioredoxin reductase] [gn:d9476] [gtcfc:2.6.4.2] [ec:1.6.4.5] [keggfc:4.2] [sgdfc:1.2.1.1.3.3] [db:gtc-saccharomyces cerevisiae] |
| CONTIG4293 | 11797312_c1_4 | 3406 | 17509 | 651 | 217 | YFL030W | 493 | 3.3(10)-47 | Saccharomyces cerevisiae | [ui:yfl030w] [pn:similarity to several transaminases:hypothetical 41.9 kd protein in hac1-cak1 intergenic region] [gtcfc:2.6.5.3:6.6] [keggfc:14.2] [sgdfc:1.1.1.1.1.4:1.2.1] [db:gtc-saccharomyces cerevisiae] |
| CONTIG4293 | 12273376_c2_6 | 3407 | 17510 | 477 | 159 | YFL030W | 322 | 4.5(10)-29 | Saccharomyces cerevisiae | [ui:yfl030w] [pn:similarity to several transaminases:hypothetical 41.9 kd protein in hac1-cak1 intergenic region] [gtcfc:2.6.5.3:6.6] [keggfc:14.2] [sgdfc:1.1.1.1.1.4:1.2.1] [db:gtc-saccharomyces cerevisiae] |
| CONTIG3519 | 15662687_c3_6 | 3408 | 17511 | 1758 | 586 | YFR030W | 1405 | 7.7(10)-144 | Saccharomyces cerevisiae | [ui:yfr030w] [pn:assimilatory sulfite reductase flavin-binding subunit:sulfite reductase:nadph flavoprotein component] [gn:met10] [gtcfc:2.6.2.7:6.4:6.6] [ec:1.8.1.2] [keggfc:2.6.4] [sgdfc:1.1.1:1.2.1] [db:gtc-saccharomyces cerevisiae] |
| b9x10v94.y | 24612758_f1_1 | 3409 | 17512 | 579 | 193 | YFR030W | 208 | 1.2(10)-15 | Saccharomyces cerevisiae | [ui:yfr030w] [pn:assimilatory sulfite reductase flavin-binding subunit:sulfite reductase:nadph flavoprotein component] [gn:met10] [gtcfc:2.6.2.7:6.4:6.6] [ec:1.8.1.2] [keggfc:2.6.4] [sgdfc:1.1.1:1.2.1] [db:gtc-saccharomyces cerevisiae] |
| CONTIG3769 | 24417200_c1_4 | 3410 | 17513 | 807 | 269 | YHR176W | 166 | 2.8(10)-10 | Saccharomyces cerevisiae | [ui:yhr176w] [pn:flavin-containing monooxygenase:hypothetical 42.4 kd protein in eno2-stb5 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4300 | 24337807_f2_4 | 3411 | 17514 | 846 | 282 | YHR176W | 299 | 2.7(10)-36 | Saccharomyces cerevisiae | region] [gn:fmo] [gtcfc:2.6] [keggfc:14.2] [sgdfc:12.1] [dbgtc-saccharomyces cerevisiae] [ui:yhr176w] [pn:flavin-containing monooxygenase:hypothetical 42.4 kd protein in eno2-stb5 intergenic region] [gn:fmo] [gtcfc:2.6] [keggfc:14.2] [sgdfc:12.1] [dbgtc-saccharomyces cerevisiae] |
| CONTIG4916 | 2742805_f2_3 | 3412 | 17515 | 360 | 120 | YIL051C | 341 | 4.4(10)-31 | Saccharomyces cerevisiae | [ui:yil051c] [pn:strong similarity to azotobacter nitrogen fixation vnfa protein:hypothetical 15.9 kd protein in gpp1-syg1 intergenic region] [gtcfc:2.6] [keggfc:14.2] [sgdfc:12.1] [dbgtc-saccharomyces cerevisiae] |
| CONTIG2229 | 10156875_f3_3 | 3413 | 17516 | 555 | 185 | YIR027C | 553 | 1.5(10)-53 | Saccharomyces cerevisiae | [ui:yir027c] [pn:allantoinase] [gn:dal1] [gtcfc:2.6:4.1] [ec:3.5.2.5] [keggfc:4.1] [sgdfc:12.1:1.3.1] [dbgtc-saccharomyces cerevisiae] |
| CONTIG2058 | 13004559_c1_6 | 3414 | 17517 | 1224 | 408 | YIR027C | 696 | 1.1(10)-68 | Saccharomyces cerevisiae | [ui:yir027c] [pn:allantoinase] [gn:dal1] [gtcfc:2.6:4.1] [ec:3.5.2.5] [keggfc:4.1] [sgdfc:12.1:1.3.1] [dbgtc-saccharomyces cerevisiae] |
| CONTIG5524 | 23443807_f1_2 | 3415 | 17518 | 561 | 187 | YIR029W | 519 | 6.0(10)-50 | Saccharomyces cerevisiae | [ui:yir029w] [pn:allantoinase:allantoiease] [gn:dal2:alc1] [gtcfc:2.6:4.1] [ec:3.5.3.4] [keggfc:4.1] [sgdfc:12.1:1.3.1] [dbgtc-saccharomyces cerevisiae] |
| CONTIG5774 | 32319550_c1_19 | 3416 | 17519 | 372 | 124 | YIR029W | 391 | 2.2(10)-36 | Saccharomyces cerevisiae | [ui:yir029w] [pn:allantoinase:allantoiease] [gn:dal2:alc1] [gtcfc:2.6:4.1] [ec:3.5.3.4] [keggfc:4.1] [sgdfc:12.1:1.3.1] [dbgtc-saccharomyces cerevisiae] |
| CONTIG1724 | 837807_f3_2 | 3417 | 17520 | 645 | 215 | YIR032C | 391 | 2.2(10)-36 | Saccharomyces cerevisiae | [ui:yir032c] [pn:ureidoglycolate hydrolase] [gn:dal3] [gtcfc:12.1.1.3.1] [ec:3.5.3.19] [keggfc:4.1] |
| CONTIG5473 | 21517150_f2_1 | 3418 | 17521 | 1851 | 617 | YJL172W | 1041 | 2.8(10)-105 | Saccharomyces cerevisiae | [ui:yjl172w] [pn:gly-x carboxypeptidase yscs precursor:carboxypeptidase s precursor:yscs:gly-x carboxypeptidase] [gn:cps1:cps:j0510] [gtcfc:2.6:10.11:12.16] [ec:3.4.17.4] [keggfc:1.2.1:6.5.2:9.10.0] [dbgtc-saccharomyces cerevisiae] |
| CONTIG963 | 906308_c1_2 | 3419 | 17522 | 687 | 229 | YJL172W | 565 | 8.0(10)-55 | Saccharomyces cerevisiae | [ui:yjl172w] [pn:gly-x carboxypeptidase yscs precursor:carboxypeptidase s precursor:yscs:gly-x carboxypeptidase] [gn:cps1:cps:j0510] [gtcfc:2.6:10.11:12.16] [ec:3.4.17.4] [keggfc:14.1] [sgdfc: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x19275.y | 21673502_c2_2 | 3420 | 17523 | 399 | 133 | YJL172W | 224 | 8.9(10)-18 | Saccharomyces cerevisiae | 1.2.1.6.5.2:9.10.0] [db:gtc-saccharomyces] [ui:yjl172w] [pn:gly-x carboxypeptidase yscs precursor:carboxypeptidase s precursor:yscs:gly-x carboxypeptidase] [gn:cps1:cps:j0510] [gtcfc:2.6:10.11:12.16] [ec:3.4.17.4] [keggfc:14.1] [sgdfc:1.2.1.6.5.2:9.10.0] |
| CONTIG5819 | 22396887_c3_58 | 3421 | 17524 | 1476 | 492 | YJL060W | 1178 | 8.8(10)-120 | Saccharomyces cerevisiae | [db:gtc-saccharomyces] [ui:yjl060w] [pn:similarity to kynurenine aminotransferase and glutamine-phenylpyruvate transaminase:hypothetical aminotransferase yjl060w] [gn:j1138] [gtcfc:2.6.5.115.8] [ec:2.6.1.-] [keggfc:5.8:5.11] [sgdfc:1.2.1] |
| CONTIG5718 | 14869017_f1_4 | 3422 | 17525 | 849 | 283 | YJL035C | 420 | 1.8(10)-39 | Saccharomyces cerevisiae | [db:gtc-saccharo] [ui:yjl035c] [pn:weak similarity to p. gingivalis pgaa and b. japonicum nitrogen fixation protein: hypothetical 28.3 kd protein in nsp1-kar2 intergenic region] [gn:j1246] [gtcfc:2.6] [keggfc:14.2] [sgdfc:1.2.1] |
| CONTIG4318 | 12191427_f3_3 | 3423 | 17526 | 1602 | 534 | YJR010W | 1500 | 6.7(10)-154 | Saccharomyces cerevisiae | [db:gtc-saccharomyces cere] [ui:yjr010w] [pn:sulfate adenylyltransferase:atp-sulfurylase] [gn:met3:j1436] [gtcfc:2.6:2.7:4.1:6.4:6.6] [ec:2.7.7.4] [keggfc:2.6:4:1:6.4] [sgdfc:1.1.1:1.2.1] [db:gtc-saccharomyces cerevisiae] |
| CONTIG5375 | 24308175_f1_1 | 3424 | 17527 | 888 | 296 | YJR137C | 284 | 1.5(10)-23 | Saccharomyces cerevisiae | [ui:yjr137c] [pn:similarity to sulfite reductases:hypothetical 161.2 kd protein in nmd5-hom6 intergenic region] [gn:j2126] [gtcfc:2.6] [keggfc:14.2] [sgdfc:1.2.1] [db:gtc-saccharomyces cerevisiae] |
| CONTIG5375 | 1407812_f1_2 | 3425 | 17528 | 183 | 61 | YJR137C | 153 | 1.3(10)-9 | Saccharomyces cerevisiae | [ui:yjr137c] [pn:similarity to sulfite reductases:hypothetical 161.2 kd protein in nmd5-hom6 intergenic region] [gn:j2126] [gtcfc:2.6] [keggfc:14.2] [sgdfc:1.2.1] [db:gtc-saccharomyces cerevisiae] |
| CONTIG5375 | 33600282_f3_4 | 3426 | 17529 | 2760 | 920 | YJR137C | 3116 | 0 | Saccharomyces cerevisiae | [ui:yjr137c] [pn:similarity to sulfite reductases:hypothetical 161.2 kd protein in nmd5-hom6 intergenic region] [gn:j2126] [gtcfc:2.6] [keggfc:14.2] [sgdfc:1.2.1] [db:gtc-saccharomyces cerevisiae] |
| b3x16012.y | 5208317_f2_2 | 3427 | 17530 | 741 | 247 | YJR137C | 223 | 4.7(10)-17 | Saccharomyces cerevisiae | [ui:yjr137c] [pn:similarity to sulfite reductases:hypothetical 161.2 kd protein in nmd5-hom6 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5741 | 2229502_f1_2 | 3428 | 17531 | 1428 | 476 | YJR149W | 276 | 2.2(10)-42 | Saccharomyces cerevisiae | region] [gn:j2126] [gtcfc:2.6] [keggfc:14.2] [sgdfc:1.2.1] [db:gtc-saccharomyces cerevisiae] [ui:yjr149w] [pn:similarity to 2-nitropropane dioxygenase:hypothetical 45.1 kd protein in rps7b-dal5 intergenic region] [gn:j2213] [gtcfc:2.6] [keggfc:14.2] [sgdfc:1.2.1] [db:gtc-saccharomyces cerevisiae] |
| CONTIG5301 | 11751562_c2_16 | 3429 | 17532 | 774 | 258 | YKL040C | 374 | 1.3(10)-34 | Saccharomyces cerevisiae | [ui:ykl040c] [pn:weak similarity to nitrogen fixation protein nifu:hypothetical 29.2 kd protein in phd1-ptm1 intergenic region] [gn:ykl253] [gtcfc:2.6] [keggfc:14.2] [sgdfc:1.2.1] [db:gtc-saccharomyces cerevisiae] |
| CONTIG5774 | 25968927_c3_31 | 3430 | 17533 | 801 | 267 | YKL040C | 426 | 4.2(10)-40 | Saccharomyces cerevisiae | [ui:ykl040c] [pn:weak similarity to nitrogen fixation protein nifu:hypothetical 29.2 kd protein in phd1-ptm1 intergenic region] [gn:ykl253] [gtcfc:2.6] [keggfc:14.2] [sgdfc:1.2.1] [db:gtc-saccharomyces cerevisiae] |
| CONTIG3426 | 30276880_f1_1 | 3431 | 17534 | 1425 | 475 | YLR438W | 1349 | 6.7(10)-138 | Saccharomyces cerevisiae | [ui:ylr438w] [pn:ornithine aminotransferase:ornithine--oxo-acid aminotransferase] [gn:car2,cargb:j9753] [gtcfc:2.65.10:5.16:6.6] [sgdfc:1.1.1.2.1:9.2.0] [db:gtc-saccharomyces cerevisiae] |
| CONTIG5637 | 117132_f2_6 | 3432 | 17535 | 1368 | 456 | YMR293C | 888 | 4.7(10)-89 | Saccharomyces cerevisiae | [ui:ymr293c] [pn:similarity to amidases] [gtcfc:2.6] [keggfc:14.2] [sgdfc:1.2.1] [db:gtc-saccharomyces cerevisiae] |
| CONTIG4315 | 34179052_c3_13 | 3433 | 17536 | 1404 | 468 | YOL058W | 1478 | 1.3(10)-151 | Saccharomyces cerevisiae | [ui:yol058w] [pn:argininosuccinate synthetase:arginino-succinate synthase:citrulline-aspartate ligase] [gn:arg1:ol228] [gtcfc:2.6:5.10:5.16:5.26.6] [ec:6.3.4.5] [keggfc:5.2:5.10:5.16] [sgdfc:1.1.1:1.2.1:9.2.0] [db:gtc-saccharomyces cerevisiae] |
| CONTIG2025 | 22454387_c3_5 | 3434 | 17537 | 621 | 207 | YOR251C | 217 | 6.0(10)-18 | Saccharomyces cerevisiae | [ui:yor251c] [pn:similarity to thiosulfate sulfurtransferases] [gtcfc:2.6.12] [keggfc:14.2] [sgdfc:1.2.1:11.3.0] [db:gtc-saccharomyces cerevisiae] |
| CONTIG2025 | 23863407_c2_4 | 3435 | 17538 | 444 | 148 | YOR251C | 295 | 3.2(10)-26 | Saccharomyces cerevisiae | [ui:yor251c] [pn:similarity to thiosulfate sulfurtransferases] [gtcfc:2.6.12] [keggfc:14.2] [sgdfc:1.2.1:11.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5155 | 4723257_c3_18 | 3436 | 17539 | 573 | 191 | YPL135W | 519 | 6.0(10)-50 | Saccharomyces cerevisiae | [ui:ypl135w] [pn:strong similarity to nitrogen fixation protein:nifu] [gtcfc:2.6] [keggfc:14.2] [sgdfc:1.2.1] [db:gtc-saccharomyces cerevisiae] |
| b2x16881.y | 24509683_f1_1 | 3437 | 17540 | 486 | 162 | YPR167C | 413 | 1.0(10)-38 | Saccharomyces cerevisiae | [ui:ypr167c] [pn:3"-phosphoadenylylsulfate reductase;phosphoadenosine phosphosulfate reductase;paps reductase, thioredoxin dependent;padops reductase:3"-phosphoadenylylsulfate reductase] [gn:met16:p9325] [gtcfc:2.6.6.6] [keggfc:14.1] |
| CONTIG3727 | 24707213_f1_2 | 3438 | 17541 | 930 | 310 | YBR213W | 301 | 7.5(10)-27 | Saccharomyces cerevisiae | [ui:ybr213w] [pn:involved in the expression of paps reductase and sulfite reductase:met8 protein] [gn:met8:ybr14l61] [gtcfc:2.6.2.7:10.2] [keggfc:14.2] [sgdfc:1.2.2] [db:gtc-saccharomyces cerevisiae] |
| CONTIG4963 | 34251587_c1_7 | 3439 | 17542 | 708 | 236 | YCR028C | 538 | 5.7(10)-52 | Saccharomyces cerevisiae | [ui:ycr028c] [pn:similarity to allantoate permease transporter;hypothetical 58.3 kd protein in pmp1-rim1 intergenic region] [gn:fen2:ycr28c] [gtcfc:2.6.2.7:10.2:12.13:12.6] [keggfc:14.2] [sgdfc:1.1.2: 1.2.2:15.2:1.6.4:7.7.0:17.0.0] [d] |
| CONTIG1158 | 30578905_f2_1 | 3440 | 17543 | 870 | 290 | YDL170W | 103 | 1.3(10)-8 | Saccharomyces cerevisiae | [ui:ydl170w] [pn:transcriptional activator for gaba catabolic genes:transcriptional activator protein] [gn:uga3] [gtcfc:2.6.2.7:10.1:10.2] [keggfc:14.2] [sgdfc:1.2.2:4.8.2:9.5.0] [dh:gtc-saccharomyces cerevisiae] |
| CONTIG3236 | 10370833_f2_2 | 3441 | 17544 | 1344 | 448 | YDL170W | 162 | 4.0(10)-12 | Saccharomyces cerevisiae | [ui:ydl170w] [pn:transcriptional activator for gaba catabolic genes:transcriptional activator protein] [gn:uga3] [gtcfc:2.6.2.7:10.1:10.2] [keggfc:14.2] [sgdfc:1.2.2:4.8.2:9.5.0] [dh:gtc-saccharomyces cerevisiae] |
| CONTIG5500 | 2148252_f3_7 | 3442 | 17545 | 1482 | 494 | YDL170W | 125 | 0.00011 | Saccharomyces cerevisiae | [ui:ydl170w] [pn:transcriptional activator for gaba catabolic genes:transcriptional activator protein] [gn:uga3] [gtcfc:2.6.2.7:10.1:10.2] [keggfc:14.2] [sgdfc:1.2.2:4.8.2:9.5.0] [dh:gtc-saccharomyces cerevisiae] |
| CONTIG1227 | 7083433_c3_4 | 3443 | 17546 | 237 | 79 | YDR207C | 114 | 1.0(10)-5 | Saccharomyces cerevisiae | [ui:ydr207c] [pn:negative transcriptional regulator;transcriptional regulator umc6;negative transcriptional regulator of ime2] [gn:ume6:cargr1:nim2:yd8142] [gtcfc:2.6.2.7:10.1:10.2:12.12.8] [keggfc:14.2] [sgdfc:1.1.2.1.2.2:1.6.4.3.] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4708 | 1348311_f1_1 | 3444 | 17547 | 2907 | 969 | YDR207C | 115 | 0.005 | Saccharomyces cerevisiae | [ui:ydr207c][pn:negative transcriptional regulator:transcriptional regulator umc6:negative transcriptional regulator of ime2] [gn:ume6:car80:cargr1:nim2:yd8142] [gtcfc:2.6:2.7:10.1:10.2:12.8] [keggfc:14.2] [sgdfc:1.1.2:1.2.2:1.6.4:3.] |
| CONTIG5000 | 3907502_c1_8 | 3445 | 17548 | 1638 | 546 | YDR207C | 118 | 0.00119 | Saccharomyces cerevisiae | [ui:ydr207c][pn:negative transcriptional regulator:transcriptional regulator umc6:negative transcriptional regulator of ime2] [gn:ume6:car80:cargr1:nim2:yd8142] [gtcfc:2.6:2.7:10.1:10.2:12.8] [keggfc:14.2] [sgdfc:1.1.2:1.2.2:1.6.4:3.] |
| CONTIG5436 | 29337802_f2_8 | 3446 | 17549 | 1722 | 574 | YDR207C | 162 | 1.3(10)-8 | Saccharomyces cerevisiae | [ui:ydr207c][pn:negative transcriptional regulator:transcriptional regulator umc6:negative transcriptional regulator of ime2] [gn:ume6:car80:cargr1:nim2:yd8142] [gtcfc:2.6:2.7:10.1:10.2:12.8] [keggfc:14.2] [sgdfc:1.1.2:1.2.2:1.6.4:3.] |
| CONTIG2009 | 3380252_f2_1 | 3447 | 17550 | 306 | 102 | YDR207C | 122 | 1.3(10)-6 | Saccharomyces cerevisiae | [ui:ydr207c][pn:negative transcriptional regulator:transcriptional regulator umc6:negative transcriptional regulator of ime2] [gn:ume6:car80:cargr1:nim2:yd8142] [gtcfc:2.6:2.7:10.1:10.2:12.8] [keggfc:14.2] [sgdfc:1.1.2:1.2.2:1.6.4:3.] |
| CONTIG4838 | 13867077_f1_2 | 3448 | 17551 | 1755 | 585 | YDR253C | 232 | 1.6(10)-19 | Saccharomyces cerevisiae | [ui:ydr253c] [pn:transcriptional regulator of sulfur amino acid metabolism] [gn:met32] [gtcfc:2.6:2.7:10.2] [keggfc:14.2] [sgdfc:1.1.2:1.2.2:4.8.2] [db:gtc-saccharomyces cerevisiae] |
| CONTIG3525 | 12695305_f3_4 | 3449 | 17552 | 1146 | 382 | YEL062W | 695 | 1.3(10)-68 | Saccharomyces cerevisiae | [ui:yel062w] [pn:nitrogen permease regulator 2] [gn:npr2] [gtcfc:2.6:2.7:10.2] [keggfc:14.2] [sgdfc:1.2.2] [db:gtc-saccharomyces cerevisiae] |
| CONTIG3525 | 16097328_f3_5 | 3450 | 17553 | 549 | 183 | YEL062W | 175 | 2.0(10)-12 | Saccharomyces cerevisiae | [ui:yel062w] [pn:nitrogen permease regulator 2] [gn:npr2] [gtcfc:2.6:2.7:10.2] [keggfc:14.2] [sgdfc:1.2.2] [db:gtc-saccharomyces cerevisiae] |
| CONTIG1121 | 814000_f2_1 | 3451 | 17554 | 597 | 199 | YER040W | 154 | 4.5(10)-10 | Saccharomyces cerevisiae | [ui:yer040w] [pn:transcription factor for positive nitrogen regulation:nitrogen regulatory protein] [gn:gln3] [gtcfc:2.6:2.7:10.1:10.2] [keggfc:14.2] [sgdfc:1.2.2:4.8.2:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4255 | 23444436_f1_2 | 3452 | 17555 | 1572 | 524 | YER040W | 191 | 5.2(10)-12 | Saccharomyces cerevisiae | [ui:yer040w] [pn:transcription factor for positive nitrogen regulation:regulatory protein] [gn:gln3] [gtcfc:2.6:2.7:10.1:10.2] [keggfc:14.2] [sgdfc:1.2:2:4.8:2:9.5.0] [db:gtc-saccharomyces cerevisiae] |
| CONTIG4624 | 16287762_c2_6 | 3453 | 17556 | 888 | 296 | YER040W | 172 | 5.2(10)-12 | Saccharomyces cerevisiae | [ui:yer040w] [pn:transcription factor for positive nitrogen regulation:regulatory protein] [gn:gln3] [gtcfc:2.6:2.7:10.1:10.2] [keggfc:14.2] [sgdfc:1.2:2:4.8:2:9.5.0] [db:gtc-saccharomyces cerevisiae] |
| CONTIG544 | 22734512_f1_1 | 3454 | 17557 | 831 | 277 | YER040W | 96 | 0.04599 | Saccharomyces cerevisiae | [ui:yer040w] [pn:transcription factor for positive nitrogen regulation:regulatory protein] [gn:gln3] [gtcfc:2.6:2.7:10.1:10.2] [keggfc:14.2] [sgdfc:1.2:2:4.8:2:9.5.0] [db:gtc-saccharomyces cerevisiae] |
| CONTIG5817 | 1182650_c2_52 | 3455 | 17558 | 1404 | 468 | YER040W | 124 | 0.00013 | Saccharomyces cerevisiae | [ui:yer040w] [pn:transcription factor for positive nitrogen regulation:regulatory protein] [gn:gln3] [gtcfc:2.6:2.7:10.1:10.2] [keggfc:14.2] [sgdfc:1.2:2:4.8:2:9.5.0] [db:gtc-saccharomyces cerevisiae] |
| CONTIG4651 | 881451_c3_4 | 3456 | 17559 | 2160 | 720 | YFL021W | 245 | 1.3(10)-20 | Saccharomyces cerevisiae | [ui:yfl021w] [pn:transcription factor for nitrogen regulation:protein] [gn:gat1] [gtcfc:2.6:2.7:10.1:10.2] [keggfc:14.2] [sgdfc:1.2:2:4.8:2:9.5.0] [db:gtc-saccharomyces cerevisiae] |
| CONTIG2922 | 5266002_f3_3 | 3457 | 17560 | 1440 | 480 | YIR023W | 179 | 9.4(10)-23 | Saccharomyces cerevisiae | [ui:yir023w] [pn:transcriptional activator for allantoin and gaba catabolic genes:transcriptional activator protein dal81:regulatory protein uga35] [gn:dal81:uga35:dur1] [gtcfc:2.6:2.7:10.1:10.2] [sgdfc:14.2] [keggfc:1.1.2:1.2.2:1.3.5] |
| CONTIG2922 | 4298437_f2_2 | 3458 | 17561 | 990 | 330 | YIR023W | 270 | 2.6(10)-22 | Saccharomyces cerevisiae | [ui:yir023w] [pn:transcriptional activator for allantoin and gaba catabolic genes:transcriptional activator protein dal81:regulatory protein uga35] [gn:dal81:uga35:dur1] [gtcfc:2.6:2.7:10.1:10.2] [sgdfc:14.2] [keggfc:1.1.2:1.2.2:1.3.5] |
| CONTIG3788 | 29401875_f2_1 | 3459 | 17562 | 591 | 197 | YIR023W | 165 | 4.4(10)-11 | Saccharomyces cerevisiae | [ui:yir023w] [pn:transcriptional activator for allantoin and gaba catabolic genes:transcriptional activator |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5350 | 25390625_c2_14 | 3460 | 17563 | 756 | 252 | YIR030C | 276 | 3.3(10)-24 | Saccharomyces cerevisiae | protein dal81:regulatory protein uga35 [gn:dal81:uga35:dur1] [gtcfc:2.6.2.7:10.1:10.2] [keggfc:14.2] [sgdfc:1.1.2:1.2.2:1.3.5] [ui:yir030c] [pn:involved in nitrogen-catabolite metabolism:protein] [gn:deg1] [gtcfc:2.6.2.7:10.2] [keggfc:14.2] [sgdfc:1.2.2] [db:gtc-saccharomyces cerevisiae] |
| CONTIG4423 | 33395002_f3_5 | 3461 | 17564 | 618 | 206 | YKR034W | 253 | 9.1(10)-22 | Saccharomyces cerevisiae | [ui:ykr034w] [pn:transcriptional repressor for allantoin and gaba catabolic genes:nitrogen regulatory protein dal80:regulatory protein uga43] [gn:dal80:uga43] [gtcfc:2.6.2.7:10.1:10.2] [keggfc:14.2] [sgdfc:1.2.2:4.8.2:9.5.0] [db:gtc-s |
| CONTIG3432 | 13784427_f2_5 | 3462 | 17565 | 1158 | 386 | YLR013W | 126 | 6.5(10)-8 | Saccharomyces cerevisiae | [ui:ylr013w] [pn:weak similarity to nitrogen regulatory proteins] [gtcfc:2.6.2.7:10.2] [keggfc:14.2] [sgdfc:1.2.2:4.8.2] [db:gtc-saccharomyces cerevisiae] |
| CONTIG2823 | 16412508_f3_3 | 3463 | 17566 | 1530 | 510 | YML099C | 386 | 5.5(10)-70 | Saccharomyces cerevisiae | [ui:yml099c] [pn:transcription factor involved in arginine metabolism:arginine metabolism regulation protein ii] [gn:argr2:arg81] [gtcfc:2.6.2.7:10.1:10.2] [keggfc:14.2] [sgdfc:1.1.2:1.2.2:4.8.2:9.5.0] [db:gtc-saccharomyces cerevisiae] |
| CONTIG3422 | 35678951_f3_1 | 3464 | 17567 | 1920 | 640 | YML099C | 219 | 1.2(10)-14 | Saccharomyces cerevisiae | [ui:yml099c] [pn:transcription factor involved in arginine metabolism:arginine metabolism regulation protein ii] [gn:argr2:arg81] [gtcfc:2.6.2.7:10.1:10.2] [keggfc:14.2] [sgdfc:1.1.2:1.2.2:4.8.2:9.5.0] [db:gtc-saccharomyces cerevisiae] |
| CONTIG3860 | 2056555_c2_7 | 3465 | 17568 | 2283 | 761 | YML099C | 135 | 3.1(10)-5 | Saccharomyces cerevisiae | [ui:yml099c] [pn:transcription factor involved in arginine metabolism:arginine metabolism regulation protein ii] [gn:argr2:arg81] [gtcfc:2.6.2.7:10.1:10.2] [keggfc:14.2] [sgdfc:1.1.2:1.2.2:4.8.2:9.5.0] [db:gtc-saccharomyces cerevisiae] |
| CONTIG5347 | 19728392_f1_2 | 3466 | 17569 | 1275 | 425 | YNL216W | 222 | 2.0(10)-18 | Saccharomyces cerevisiae | [ui:ynl216w] [pn:dna-binding protein with repressor and activator activity:dna-binding protein rap1:sbf-e:repressor/activator site binding protein:tuf] [gn:rap1:frf1:n1310] [gtcfc:2.6.2.7:10.1:10.2:10.3:10.7:12:13:12.8] [keggfc:14.2] |
| CONTIG1882 | 823957_c3_8 | 3467 | 17570 | 426 | 142 | YNL183C | 266 | 5.0(10)-22 | Saccharomyces cerevisiae | [ui:ynl183c] [pn:ser/thr protein kinase:nitrogen permease reactivator protein] [gn:npr1:n1631] [gtcfc: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3963 | 23914686_f3_4 | 3468 | 17571 | 1692 | 564 | YNL183C | 986 | 1.8(10)-125 | Saccharomyces cerevisiae | 2.6:2.7:8.5:9.4:10.2:12.13:12.16] [ec:2.7.1.-] [keggfc:8.5:9.4] [sgdfc:1.2.2:8.8.0:15.0.0] [db:gtc-saccharomyces cerevisiae] [ui:ynl183c] [pn:ser/thr protein kinase:nitrogen permease reactivator protein] [gn:npr1:n1631] [gtcfc: 2.6:2.7:8.5:9.4:10.2:12.13:12.16] [ec:2.7.1.-] [keggfc:8.5:9.4] [sgdfc:1.2.2:8.8.0:15.0.0] [db:gtc-saccharomyces cerevisiae] |
| CONTIG5149 | 10562550_c1_6 | 3469 | 17572 | 954 | 318 | YNL103W | 113 | 5.2(10)-11 | Saccharomyces cerevisiae | [ui:ynl103w] [pn:transcriptional activator of sulfur metabolism:transcriptional activator of sulfur metabolism met4] [gn:met4:n2177] [gtcfc:2.6:2.7:10.1:10.2] [keggfc:14.2] [sgdfc:1.1.2:1.2.2:4.8.2: 9.5.0] [db:gtc-saccharomyces cerevis] |
| CONTIG4800 | 10276552_f2_1 | 3470 | 17573 | 960 | 320 | YPL111W | 822 | 4.7(10)-82 | Saccharomyces cerevisiae | [ui:ypl111w] [pn:arginase] [gn:car1:lph15w] [gtcfc:2.6:2.7:5.10:5.16:5.3:10.2] [ec:3.5.3.1] [keggfc:5.10:5.16] [sgdfc:1.1.4:1.2.2:9.2.0] [db-gtc-saccharomyces cerevisiae] |
| CONTIG1775 | 4094050_c3_2 | 3471 | 17574 | 378 | 126 | YGR012W | 203 | 6.4(10)-16 | Saccharomyces cerevisiae | [ui:ygr012w] [pn:similarity to e. nidulans cysteine synthase:putative cysteine synthase:o-acetylserine sulfhydrylase:o-acetylserine:thiol-lyase:c-sase] [gtcfc:2.7:5.5:6.4:6.6] [ec:4.2.99.8] [keggfc:2.6:5.5: 6.4] [sgdfc:1.1.1] [db:gtc-sa] |
| CONTIG5459 | 2361458_f1_1 | 3472 | 17575 | 840 | 280 | YGR012W | 809 | 1.1(10)-80 | Saccharomyces cerevisiae | [ui:ygr012w] [pn:similarity to e. nidulans cysteine synthase:putative cysteine synthase:o-acetylserine sulfhydrylase:o-acetylserine:thiol-lyase:c-sase] [gtcfc:2.7:5.5:6.4:6.6] [ec:4.2.99.8] [keggfc:2.6:5.5: 6.4] [sgdfc:1.1.1] [db:gtc-sa] |
| CONTIG374 | 16502278_f1_1 | 3473 | 17576 | 798 | 266 | YJR130C | 656 | 1.8(10)-64 | Saccharomyces cerevisiae | [ui:yjr130c] [pn:similarity to o-succinylhomoserine:putative cystathionine gamma-synthase: o-succinylhomoserine:thiol-lyase] [gn:j2063] [gtcfc:2.7:5.3:5.4:5.5:6.4:6.6] [db:gtc-sa] [ec:4.2.99.9] [keggfc: 2.6:5.3:5.4:5.5:6.4] [sgdfc:1.1.1] |
| CONTIG3902 | 20113130_c1_9 | 3474 | 17577 | 213 | 71 | YJR130C | 134 | 5.2(10)-8 | Saccharomyces cerevisiae | [ui:yjr130c] [pn:similarity to o-succinylhomoserine:putative cystathionine gamma-synthase: o-succinylhomoserine:thiol-lyase] [gn:j2063] [gtcfc:2.7:5.3:5.4:5.5:6.4:6.6] [keggfc: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11275.x | 4195393_c3_4 | 3475 | 17578 | 510 | 170 | YJR130C | 94 | 3.3(10)-5 | Saccharomyces cerevisiae | 2.6:5.3:5.4:5.5:6.4] [ui:yjr130c] [pn:similarity to o-succinylhomoserine:putative cystathionine gamma-synthase: o-succinylhomoserine:thiol-lyase] [gn:j2063] [gtcfc:2.7:5.3:5.4:5.5:6.4:6.6] [ec:4.2.99.9] [keggfc: 2.6:5.3:5.4:5.5:6.4] [sgdfc:1.1.1] [db:gtc-sa |
| CONTIG5804 | 12929007_c1_48 | 3476 | 17579 | 1329 | 443 | YLR303W | 1533 | 2.1(10)-157 | Saccharomyces cerevisiae | [ui:ylr303w] [pn:o-acetylhomoserine sulfhydrylase:oah sulfhydrylase/o-acetylserine sulfhydrylase:oas sulfhydrylase] [gn:met17:met25:i8003] [gtcfc:2.7:5.4:5.5:6.4:6.6] [keggfc:2.6:5.4: 5.5:6.4] [sgdfc:1.1.1:9.2.0] [db:gtc-saccharomyce |
| CONTIG5122 | 4035893_f3_3 | 3477 | 17580 | 804 | 268 | YNL277W | 357 | 2.1(10)-63 | Saccharomyces cerevisiae | [ui:ynl277w] [pn:homoserine o-acetyltransferase:homoserine o-trans- acetylase] [gn:met2:n0615] [gtcfc:2.7:5.4:6.6] [ec:2.3.1.31] [sgdfc:1.1.19.2.0] [db:gtc-saccharomyces cerevisiae] |
| CONTIG5162 | 23445306_f2_2 | 3478 | 17581 | 1458 | 486 | YDR402C | 1109 | 1.8(10)-112 | Saccharomyces cerevisiae | [ui:ydr402c] [pn:cytochrome p450 56:cytochrome p450-dit2] [gn:dit2:cyp56:d9509] [gtcfc:2.8:3.2:5.14] [11.1:12.12.15] [ec:1.14.14.1] [keg- gtc:3.2:5.14:] [sgdfc:4.3.0:9.1.0:11.3.0:11.4.0] [db:gtc-saccharomyces cerevisiae] |
| CONTIG3996 | 10589592_f2_2 | 3479 | 17582 | 426 | 142 | YDR402C | 117 | 2.3(10)-6 | Saccharomyces cerevisiae | [ui:ydr402c] [pn:cytochrome p450 56:cytochrome p450-dit2] [gn:dit2:cyp56:d9509] [gtcfc:2.8:3.2:5.14] [11.1:12.12.15] [ec:1.14.14.1] [keg- gtc:3.2:5.14:] [sgdfc:4.3.0:9.1.0:11.3.0:11.4.0] [db:gtc-saccharomyces cerevisiae] |
| CONTIG5647 | 34020179_c1_11 | 3480 | 17583 | 234 | 78 | YDR402C | 163 | 2.6(10)-11 | Saccharomyces cerevisiae | [ui:ydr402c] [pn:cytochrome p450 56:cytochrome p450-dit2] [gn:dit2:cyp56:d9509] [gtcfc:2.8:3.2:5.14] [11.1:12.12.15] [ec:1.14.14.1] [keg- gtc:3.2:5.14:] [sgdfc:4.3.0:9.1.0:11.3.0:11.4.0] [db:gtc-saccharomyces cerevisiae] |
| CONTIG4384 | 861287_f3_5 | 3481 | 17584 | 1575 | 525 | YHR007C | 1782 | 8.6(10)-184 | Saccharomyces cerevisiae | [ui:yhr007c] [pn:cytochrome p450 lanosterol 14a-demethylase:cytochrome p450 11:14dm:lanosterol 14- alpha demethylase] [gn:erg11:cyp51:14dm] [gtcfc:2.8:3.2:3.4:5.14:8.1:8.2:12.12.16] [ec:1.14.14.1] [keggfc:3.2:5.14] [sgdfc:1.6.1:9.4.] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1870 | 24222802_f1_1 | 3482 | 17585 | 939 | 313 | YLL057C | 224 | 3.2(10)-17 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG2070 | 24390875_f3_3 | 3483 | 17586 | 1293 | 431 | YLL057C | 348 | 7.9(10)-32 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG5677 | 33390750_c3_26 | 3484 | 17587 | 1227 | 409 | YLL057C | 1020 | 4.9(10)-103 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG5811 | 12923431_c1_25 | 3485 | 17588 | 1173 | 391 | YLL057C | 810 | 8.6(10)-81 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG714 | 34252802_c1_3 | 3486 | 17589 | 393 | 131 | YLL057C | 337 | 1.2(10)-30 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG663 | 1047775_f1_1 | 3487 | 17590 | 696 | 232 | YLL057C | 445 | 4.2(10)-42 | Saccharomyces cerevisiae | [ui:yll057c][pn:similarity to e. coli dioxygenase][gtcfc:2.8:12.12][keggfc14.2][sgdfc:11.3.0:11.4.0][db:gtc-saccharomyces cerevisiae] |
| CONTIG3969 | 4338280_f2_1 | 3488 | 17591 | 861 | 287 | YMR015C | 1058 | 4.5(10)-107 | Saccharomyces cerevisiae | [ui:ymr015c][pn:cytochrome p450c-22 sterol desaturase][gn:crg5:cyp61:ym9711][gtcfc:2.8:3.4.8.1:8.2:12.12.16][ec:1.14.14.-][keggfc:14.1][sdgfc:1.6.1:9.4.0:11.3.0:11.4.0][db:gtc-saccharomyces cerevisiae] |
| CONTIG4915 | 489175_f1_3 | 3489 | 17592 | 783 | 261 | YMR015C | 703 | 1.8(10)-69 | Saccharomyces cerevisiae | [ui:ymr015c][pn:cytochrome p450c-22 sterol desaturase][gn:crg5:cyp61:ym9711][gtcfc:2.8:3.4.8.1:8.2:12.12.16][ec:1.14.14.-][keggfc:14.1][sdgfc:1.6.1:9.4.0:11.3.0:11.4.0][db:gtc-saccharomyces cerevisiae] |
| b3x16057.y | 33751662_c3_4 | 3490 | 17593 | 765 | 255 | YMR015C | 672 | 3.7(10)-66 | Saccharomyces cerevisiae | [ui:ymr015c][pn:cytochrome p450c-22 sterol desaturase][gn:crg5:cyp61:ym9711][gtcfc:2.8:3.4.8.1:8.2:12.12.16][ec:1.14.14.-][keggfc:14.1][sdgfc:1.6.1:9.4.0:11.3.0:11.4.0][db:gtc-saccharomyces cerevisiae] |
| CONTIG2335 | 9954125_c3_2 | 3491 | 17594 | 834 | 278 | YAR035W | 454 | 9.9(10)-43 | Saccharomyces cerevisiae | [ui:yar035w][pn:carnitine acetyltransferase, mitochondrial/putative mitochondrial carnitine o-acetyltransferase][gn:yat1][gtfc:2.8:5.2:12.2:12.6][ec:2.3.1.7][keggfc:1.6.5: |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3931 | 12680325_f2_1 | 3492 | 17595 | 2013 | 671 | YAR035W | 841 | 3.1(10)-91 | Saccharomyces cerevisiae | 7.11.0:8.2.0:9.7.0] [db:gtc-saccharomyces cer] [ui:yar035w] [pn:carnitine acetyltransferase, mitochondrial:putative mitochondrial carnitine o-acetyltransferase] [gn:yat1] [gtcfc:2.8.5.2:12.2:12.6] [ec:2.3.1.7] [keggfc:5.2] [sgdfc:1.6.5: 7.11.0:8.2.0:9.7.0] [db:gtc-saccharomyces cer] |
| CONTIG457 | 480041_f3_1 | 3493 | 17596 | 789 | 263 | YAR035W | 482 | 5.0(10)-46 | Saccharomyces cerevisiae | [ui:yar035w] [pn:carnitine acetyltransferase, mitochondrial:putative mitochondrial carnitine o-acetyltransferase] [gn:yat1] [gtcfc:2.8.5.2:12.2:12.6] [ec:2.3.1.7] [keggfc:5.2] [sgdfc:1.6.5: 7.11.0:8.2.0:9.7.0] [db:gtc-saccharomyces cer] |
| CONTIG2303 | 24226432_f1_1 | 3494 | 17597 | 924 | 308 | YBL030C | 957 | 2.2(10)-96 | Saccharomyces cerevisiae | [ui:ybl030c] [pn:adp/atp carrier protein:mcf:adp,atp carrier protein 2:adp/atp translocase 2:adenine nucleotide translocator 2:ant 2] [gn:aac2;pet9;ybl0421] [gtcfc:2.8:12.3] [keggfc:14.2] [sgdfc: 1.3:7.7.6.0:8.2.0:9.7.0] [db:gtc-saccha] |
| CONTIG3611 | 7119027_f2_3 | 3495 | 17598 | 333 | 111 | YBR091C | 190 | 4.4(10)-15 | Saccharomyces cerevisiae | [ui:ybr091c] [pn:mitochondrial biogenesis protein:mitochondrial regulator of splicing 5] [gn:mrs5: ybr0812] [gtcfc:2.8] [keggfc:14.2] [sgdfc:8.2.0:9.7.0] [db:gtc-saccharomyces cerevisiae] |
| CONTIG3509 | 5274087_f3_5 | 3496 | 17599 | 678 | 226 | YBR192W | 312 | 5.2(10)-28 | Saccharomyces cerevisiae | [ui:ybr192w] [pn:mitochondrial carrier protein:mcf:mitochondrial carrier protein rim2] [gn:rim2: ybr1402] [gtcfc:2.8.12.3] [keggfc:14.2] [sgdfc:2.5.0:7.6.0:8.2.0:9.7.0] [db:gtc-saccharomyces cerevisiae] |
| b9x12176.y | 10819692_f2_2 | 3497 | 17600 | 279 | 93 | YBR192W | 361 | 3.2(10)-33 | Saccharomyces cerevisiae | [ui:ybr192w] [pn:mitochondrial carrier protein:mcf:mitochondrial carrier protein rim2] [gn:rim2: ybr1402] [gtcfc:2.8.12.3] [keggfc:14.2] [sgdfc:2.5.0:7.6.0:8.2.0:9.7.0] [db:gtc-saccharomyces cerevisiae] |
| CONTIG5597 | 23437500_f1_1 | 3498 | 17601 | 882 | 294 | YBR291C | 1033 | 2.0(10)-104 | Saccharomyces cerevisiae | [ui:ybr291c] [pn:citrate transport protein, mitochondrial:mcf:putative mitochondrial carrier ybr291c] [gn:ctp1:ybr2039] [gtcfc:2.8:12.2] [keggfc:14.2] [sgdfc:1.5.3:7.3.0:8.2.0:9.7.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5519 | 19960962_c2_8 | 3499 | 17602 | 2232 | 744 | YER024W | 657 | 1.3(10)-64 | Saccharomyces cerevisiae | [ui:yer024w] [pn:similarity to carnitine o-acetyltransferase yat1p:hypothetical 103.3 kd protein in pro3-gcd11 intergenic region] [gtcfc:2.8.12.2:12.6] [keggfc:14.2] [sgdfc:1.6.5:7.11.0:8.2.0] [db:gtc-saccharomyces cerevisiae] |
| CONTIG3626 | 36072182_c2_4 | 3500 | 17603 | 1020 | 340 | YER053C | 913 | 1.1(10)-91 | Saccharomyces cerevisiae | [ui:yer053c] [pn:strong similarity to mitochondrial phosphate carrier protein:putative mitochondrial carrier yer053c] [gtcfc:2.8.12.4:12.6,13.10] [keggfc:14.2] [sgdfc:1.4.3:1.8.2:7.2.3:8.2.0] [db:gtc-saccharomyces cerevisiae] |
| CONTIG5803 | 4722802_c1_25 | 3501 | 17604 | 1137 | 379 | YGR028W | 1022 | 3.0(10)-103 | Saccharomyces cerevisiae | [ui:ygr028w] [pn:intra-mitochondrial sorting protein:msp1 protein:tat-binding homolog 4] [gn:msp1:yta4] [gtcfc:2.8.10.7:11.1] [keggfc:14.2] [sgdfc:6.2.0:8.2.0:9.7.0] [db:gtc-saccharomyces cerevisiae] |
| CONTIG3874 | 31409627_c2_9 | 3502 | 17605 | 534 | 178 | YGR082W | 291 | 8.6(10)-26 | Saccharomyces cerevisiae | [ui:ygr082w] [pn:mitochondrial outer membrane import receptor subunit, 20 kd:mitochondrial import receptor subunit tom20:mitochondrial 20 kd outer membrane protein:mas20 protein:translocase of outer membrane 20 kd subunit] [gn:tom20:ma] |
| CONTIG4567 | 20422807_f3_4 | 3503 | 17606 | 783 | 261 | YHR050W | 629 | 1.3(10)-61 | Saccharomyces cerevisiae | [ui:yhr050w] [pn:suppressor of mitochondrial matrix mutant:transporter protein] [gn:smf2] [gtcfc:2.8:11.1:12.6] [keggfc:14.2] [sgdfc:6.2.0:8.2.0:9.7.0] [db:gtc-saccharomyces cerevisiae] |
| CONTIG1532 | 25554688_c2_4 | 3504 | 17607 | 1233 | 411 | YHR117W | 822 | 4.7(10)-82 | Saccharomyces cerevisiae | [ui:yhr117w] [pn:strong similarity to tom70p/mas70p:hypothetical 71.9 kd protein in cdc12-orc6 intergenic region] [gn:tom71] [gtcfc:2.8] [keggfc:14.2] [sgdfc:8.2.0:9.7.0] [db:gtc-saccharomyces cerevisiae] |
| CONTIG5759 | 20343942_c3_23 | 3505 | 17608 | 963 | 321 | YIL134W | 446 | 3.2(10)-42 | Saccharomyces cerevisiae | [ui:yil134w] [pn:fad carrier protein:mcf, mitochondrial:mitochondrial fad carrier protein] [gn:flx1] [gtcfc:2.8.12.6] [keggfc:14.2] [sgdfc:1.7.4:7.11.0:8.2.0:9.7.0] [db:gtc-saccharomyces cerevisiae] |
| CONTIG2741 | 16805418_c2_9 | 3506 | 17609 | 348 | 116 | YIL022W | 345 | 1.6(10)-31 | Saccharomyces cerevisiae | [ui:yil022w] [pn:mitochondrial inner membrane import receptor subunit:mitochondrial import inner |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4344 | 1562_c1_7 | 3507 | 17610 | 447 | 149 | YIL022W | 265 | 1.1(10)-22 | Saccharomyces cerevisiae | [ui:yil022w] [pn:mitochondrial inner membrane import receptor subunit:mitochondrial import inner membrane translocase subunit tim44 precursor:mitochondrial protein import protein 1: inner membrane import site protein 45:isp45:membrane i] membrane translocase subunit tim44 precursor:mitochondrial protein import protein 1:inner membrane import site protein 45:isp45:membrane i |
| CONTIG2657 | 21595262_f1_2 | 3508 | 17611 | 513 | 171 | YIL143W | 575 | 7.0(10)-56 | Saccharomyces cerevisiae | [ui:yil143w] [pn:mitochondrial inner membrane import translocase subunit:mitochondrial import inner membrane translocase subunit tim17:mitochondrial protein import protein 2:mitochondrial inner membrane protein mim17] [gn:tim17:mpi2:mi |
| CONTIG3799 | 23625277_c3_7 | 3509 | 17612 | 945 | 315 | YJR077C | 1082 | 1.3(10)-109 | Saccharomyces cerevisiae | [ui:yjr077c] [pn:phosphate transport protein, mitochondrial:mcf:mitochondrial phosphate carrier protein:phosphate transport protein:mitochondrial import receptor:p32] [gn:mir1:j1837] [gtcfc:2.8;12.4:13.10] [keggfc:14.2] [sgdfc:1.4.3:1 |
| CONTIG115 | 23525252_c2_1 | 3510 | 17613 | 780 | 260 | YLL024C | 1081 | 1.7(10)-109 | Saccharomyces cerevisiae | [ui:yll024c] [pn:heat shock protein of hsp70 family, cytosolic:heat shock protein ssa2] [gn:ssa2:10931] [gtcfc:12.7:13.2] [keggfc:14.2] [sgdfc:6.1.0:8.2.0:8.3.0:9.1.0:9.2.0: 11.1.0] [db:gtc-saccharomyces cerevisiae] |
| CONTIG3302 | 4767150_f2_1 | 3511 | 17614 | 696 | 232 | YLL024C | 974 | 3.7(10)-98 | Saccharomyces cerevisiae | [ui:yll024c] [pn:heat shock protein of hsp70 family, cytosolic:heat shock protein ssa2] [gn:ssa2:10931] [gtcfc:12.7:13.2] [keggfc:14.2] [sgdfc:6.1.0:8.2.0:8.3.0:9.1.0:9.2.0: 11.1.0] [db:gtc-saccharomyces cerevisiae] |
| CONTIG4595 | 245275_c1_6 | 3512 | 17615 | 627 | 209 | YLL024C | 392 | 5.5(10)-36 | Saccharomyces cerevisiae | [ui:yll024c] [pn:heat shock protein of hsp70 family, cytosolic:heat shock protein ssa2] [gn:ssa2:10931] [gtcfc:12.7:13.2] [keggfc:14.2] [sgdfc:6.1.0:8.2.0:8.3.0:9.1.0:9.2.0: 11.1.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4595 | 35392500_c3_9 | 3513 | 17616 | 291 | 97 | YLL024C | 433 | 1.2(10)-40 | Saccharomyces cerevisiae | [ui:yll024c] [pn:heat shock protein of hsp70 family, cytosolic:heat shock protein ssa2] [gn:sssa2:i0931] [gtcfc 12.7.13.2] [keggfc:14.2] [sgdfc:6.1.0:8.2.0.8.3.0:9.1.0:9.2.0 11.1.0] [db gtc-saccharomyces cerevisiae] |
| CONTIG3436 | 35192193_c2_8 | 3514 | 17617 | 477 | 159 | YLR034C | 90 | 0.03599 | Saccharomyces cerevisiae | [ui:ylr034c] [pn strong similarity to smf2 protein] [gtcfc:2.8] [keggfc:14.2] [sgdfc:8.2.0] [db-gtc-saccharomyces cerevisiae] |
| CONTIG5774 | 2642212_c1_21 | 3515 | 17618 | 741 | 247 | YLR034C | 602 | 9.5(10)-59 | Saccharomyces cerevisiae | [ui:ylr034c] [pn:strong similarity to smf2 protein] [gtcfc:2.8] [keggfc:14.2] [sgdfc:8.2.0] [db-gtc-saccharomyces cerevisiae] |
| CONTIG5774 | 4944430_c3_35 | 3516 | 17619 | 921 | 307 | YLR034C | 659 | 8.8(10)-65 | Saccharomyces cerevisiae | [ui:ylr034c] [pn:strong similarity to smf2 protein] [gtcfc:2.8] [keggfc:14.2] [sgdfc:8.2.0] [db-gtc-saccharomyces cerevisiae] |
| CONTIG1263 | 9850016_f1_2 | 3517 | 17620 | 309 | 103 | YLR295C | 114 | 5.0(10)-7 | Saccharomyces cerevisiae | [ui:ylr295c] [pn:f1f0-atpase complex, subunit h] [gn:atp14] [gtcfc:2.8:12.6] [keggfc:14.2] [sgdfc:1.8.2:2.5.0:7.8.0:8.2.0:9.7.0] [db-gtc-saccharomyces cerevisiae] |
| CONTIG4198 | 269027_c2_7 | 3518 | 17621 | 942 | 314 | YLR348C | 762 | 1.1(10)-75 | Saccharomyces cerevisiae | [ui:ylr348c] [pn:dicarboxylate carrier protein] [gtcfc:2.8:12.2:12.4:12.6:13.10] [keggfc:14.2] [sgdfc:1.4.3:1.5.3:1.8.2:7.2.3:7.3.0: 8.2.0:9.7.0] [db:gtc-saccharomyces cerevisiae] |
| CONTIG4306 | 1367876_f3_2 | 3519 | 17622 | 267 | 89 | YM1042W | 167 | 1.6(10)-11 | Saccharomyces cerevisiae | [ui:yml042w] [pn:carnitine o-acetyltransferase:carnitine o-acetyltransferase precursor:carnitine acetylase] [gn:cat2:cat:ycat:ym8054] [gtcfc:2.8:3.4.5.2:8.1.8.2:12.2:12.6] [ec:2.3.1.7] [keggfc:5.2] |
| CONTIG2997 | 23828257_c2_3 | 3520 | 17623 | 1260 | 420 | YMR203W | 1211 | 2.7(10)-123 | Saccharomyces cerevisiae | [ui:ymr203w] [pn:mitochondrial outer membrane import receptor subunit, 40 kd:mitochondrial Import receptor subunit tom40:mitochondrial import-site-protein isp42:translocase of outer membrane 40 kd subunit] [gn:tom40:isp42:mom38:ym8325] |
| CONTIG1803 | 986632_f1_1 | 3521 | 17624 | 822 | 274 | YMR301C | 799 | 1.3(10)-79 | Saccharomyces cerevisiae | [ui:ymr301c] [pn:atp-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | cassette transporter protein, mitochondrial:mitochondrial transporter atm1 precursor [gn:atm1:mdy:ym9952] [gtcfc:2.8:12.6] [keggfc:14.2] [sgdfc:7.9.0:8.2.0:9.7.0] [db:gtc-saccharomyces cerevisiae] |
| CONTIG4293 | 33234452_c1_5 | 3522 | 17625 | 702 | 234 | YMR301C | 370 | 2.1(10)-33 | Saccharomyces cerevisiae | [ui:ym301c] [pn:atp-binding cassette transporter protein, mitochondrial:mitochondrial transporter atm1 precursor] [gn:atm1:mdy:ym9952] [gtcfc:2.8:12.6] [keggfc:14.2] [sgdfc:7.9.0:8.2.0:9.7.0] [db:gtc-saccharomyces cerevisiae] |
| CONTIG5759 | 16835932_c1_15 | 3523 | 17626 | 204 | 68 | YNL070W | 191 | 3.3(10)-15 | Saccharomyces cerevisiae | [ui:ynl070w] [pn:mitochondrial outer membrane import receptor subunit, 7 kd:mitochondrial import receptor subunit tom7:translocase of outer membrane 7 kd subunit] [gn:tom7:mom7:n2378] [gtcfc:2.8:10.7:11.1:12.6] [keggfc:14.2] [sgdfc:6. |
| CONTIG4156 | 6539567_c2_5 | 3524 | 17627 | 822 | 274 | YNL064C | 338 | 9.0(10)-31 | Saccharomyces cerevisiae | [ui:ynl064c] [pn:mitochondrial and er import protein:mitochondrial protein import protein mas5:protein ydj1] [gn:mas5:ydj1:n2418:yn12418c] [gtcfc:2.8:12.10:12.16:12.8:13.2] [keggfc:14.2] [sgdfc:3.8.0:8.2.0:8.3.0:9.4.0:11.1.0] [db:gtc- |
| CONTIG5691 | 6907502_c2_24 | 3525 | 17628 | 1194 | 398 | YNL064C | 1145 | 2.7(10)-116 | Saccharomyces cerevisiae | [ui:ynl064c] [pn:mitochondrial and er import protein:mitochondrial protein import protein mas5:protein ydj1] [gn:mass:ydj1:n2418:yn12418c] [gtck:2.8:12.10:12.16:12.8:13.2] [keggfc:14.2] [sgdfc:3.8.0:8.2.0:8.3.0:9.4.0:11.1.0] [db:gtc- |
| CONTIG5753 | 21953556_f1_3 | 3526 | 17629 | 963 | 321 | YNL064C | 265 | 4.4(10)-45 | Saccharomyces cerevisiae | [ui:ynl064c] [pn:mitochondrial and er import protein:mitochondrial protein import protein mas5:protein ydj1] [gn:mass:ydj1:n2418:yn12418c] [gtcfc:2.8:12.10:12.16:12.8:13.2] [keggfc:14.2] [sgdfc:3.8.0:8.2.0:8.3.0:9.4.0:11.1. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| blx19545.y | 9774166_f3_2 | 3527 | 17630 | 582 | 194 | YNL055C | 428 | 2.6(10)-40 | Saccharomyces cerevisiae | 0] [dg:gtc-[ui:ynl055c] [pn:mitochondrial outer membrane porin:outer mitochondrial membrane protein porin:voltage-dependent anion-selective channel protein] [gn:omp2:vdac:por1:n2441:ynl2441c] [gtcfc:2.8;12.6] [keggfc:14.2] [sgdfc:7.11.0:8.2.0;9. |
| CONTIG5440 | 24035886_f3_11 | 3528 | 17631 | 675 | 225 | YNR017W | 614 | 5.0(10)-60 | Saccharomyces cerevisiae | [ui:ynr017w] [pn:mitochondrial inner membrane import translocase subunit:mitochondrial import inner membrane translocase subunit tim23:mitochondrial protein import protein 3:mitochondrial protein import protein mas6:membrane import mac |
| CONTIG3964 | 515700_c2_3 | 3529 | 17632 | 1614 | 538 | YOR037W | 288 | 6.5(10)-24 | Saccharomyces cerevisiae | [ui:yor037w] [pn:cytochrome-c mitochondrial import factor:cytochrome c mitochondrial import factor cyc2] [gn:cyc2:or26] [gtcfc:2.8] [keggfc:14.2] [sgdfc:8.2.0;9.7.0] [db:gtc-saccharomyces cerevisiae] |
| CONTIG4142 | 14238135_c2_3 | 3530 | 17633 | 1080 | 360 | YOR130C | 98 | 0.019 | Saccharomyces cerevisiae | [ui:yor130c] [pn:member of the mitochondrial carrier family:mcf] [gn:arg11] [gtcfc:2.8;12.1] [keggfc:14.2] [sgdfc:1.1.3;7.4.0:8.2.0;9.7.0] [db:gtc-saccharomyces cerevisiae] |
| CONTIG4890 | 14629511_c2_7 | 3531 | 17634 | 939 | 313 | YOR130C | 469 | 1.2(10)-44 | Saccharomyces cerevisiae | [ui:yor130c] [pn:member of the mitochondrial carrier family:mcf] [gn:arg11] [gtcfc:2.8;12.1] [keggfc:14.2] [sgdfc:1.1.3;7.4.0:8.2.0;9.7.0] [db:gtc-saccharomyces cerevisiae] |
| CONTIG5518 | 33384662_f1_2 | 3532 | 17635 | 732 | 244 | YOR232W | 451 | 9.5(10)-43 | Saccharomyces cerevisiae | [ui:yor232w] [pn:heat shock protein - chaperone:grpe protein homolog precursor] [gn:grpe1:grpe:yge1:mge1:o5099] [gtcfc:12.7] [keggfc:14.2] [sgdfc:6.1.0.8.2.0;9.7.0] [db:gtc-saccharomyces cerevisiae] |
| CONTIG5217 | 10735260_f3_7 | 3533 | 17636 | 900 | 300 | YPL134C | 866 | 1.0(10)-86 | Saccharomyces cerevisiae | [ui:ypl134c] [pn:similarity to adp/atp carrier proteins] [gtcfc:2.8;12.3] [keggfc:14.2] [sgdfc:7.6.0:8.2.0] [db:gtc-saccharomyces cerevisiae] |
| CONTIG4546 | 892167_c3_5 | 3534 | 17637 | 1854 | 618 | YPR021C | 760 | 3.2(10)-83 | Saccharomyces cerevisiae | [ui:ypr021c] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5148 | 20742137_c1_6 | 3535 | 17638 | 1152 | 384 | YPR058W | 288 | 1.8(10)-25 | Saccharomyces cerevisiae | human citrate transporter protein] [gtcfc:2.8;12.2] [keggfc:14.2] [sgdfc:1.5.3;7.3.0;8.2.0] [db:gtc-saccharomyces cerevisiae [ui:ypr058w] [pn:mitochondrial carrier protein:mcf:mitochondrial carrier protein precursor] [gn:ymc1] [gtcfc:2.8;12.6] [keggfc:14.2] [sgdfc:7.11.0;8.2.0;9.7.0] [db:gtc-saccharomyces cerevisiae |
| CONTIG3294 | 1050437_c3_4 | 3536 | 17639 | 777 | 259 | YPR058W | 683 | 2.5(10)-67 | Saccharomyces cerevisiae | [ui:ypr058w] [pn:mitochondrial carrier protein:mcf:mitochondrial carrier protein precursor; [gn:ymc1] [gtcfc:2.8;12.6] [keggfc:14.2] [sgdfc:7.11.0;8.2.0;9.7.0] [db:gtc-saccharomyces cerevisiae |
| CONTIG5768 | 4094812_f1_4 | 3537 | 17640 | 918 | 306 | YPR058W | 438 | 2.2(10)-41 | Saccharomyces cerevisiae | [ui:ypr058w] [pn:mitochondrial carrier protein:mcf:mitochondrial carrier protein precursor] [gn:ymc1] [gtcfc:2.8;12.6] [keggfc:14.2] [sgdfc:7.11.0;8.2.0;9.7.0] [db:gtc-saccharomyces cerevisiae |
| CONTIG5371 | 21876430_f3_6 | 3538 | 17641 | 471 | 157 | YAL039C | 383 | 1.5(10)-35 | Saccharomyces cerevisiae | [ui:yal039c] [pn:cytochrome c heme lyase:cch1:holocytochrome-c synthase] [gn:cyc3] [gtcfc:2.8;9.10;9.12;10.7] [ec:4.4.1.17] [keggfc:9.10] [sgdfc:1.7.2;6.3.0;9.7.0] [db:gtc-saccharomyces cerevisiae |
| CONTIG5332 | 422036_f1_1 | 3539 | 17642 | 1845 | 615 | YAL011W | 147 | 9.0(10)-14 | Saccharomyces cerevisiae | [ui:yal011w] [pn:protein of unknown function:hypothetical 74.1 kd protein in cys3-mdm10 intergenic region precursor] [gn:fun36] [gtcfc:2.8] [keggfc:14.2] [sgdfc:9.7.0] [db:gtc-saccharomyces cerevisiae |
| CONTIG5332 | 26761063_f1_2 | 3540 | 17643 | 1728 | 576 | YAL011W | 163 | 7.5(10)-17 | Saccharomyces cerevisiae | [ui:yal011w] [pn:protein of unknown function:hypothetical 74.1 kd protein in cys3-mdm10 intergenic region precursor] [gn:fun36] [gtcfc:2.8] [keggfc:14.2] [sgdfc:9.7.0] [db:gtc-saccharomyces cerevisiae |
| CONTIG5503 | 25787775_f3_4 | 3541 | 17644 | 1563 | 521 | YAL011W | 108 | 0.01099 | Saccharomyces cerevisiae | [ui:yal011w] [pn:protein of unknown function:hypothetical 74.1 kd protein in cys3-mdm10 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1672 | 14532750_c3_3 | 3542 | 17645 | 669 | 223 | YAL010C | 213 | 9.8(10)-17 | Saccharomyces cerevisiae | intergenic region precursor] [gn:fun36] [gtcfc:2.8] [keggfc:14.2] [sgdfc:9.7.0] [db:gtc-saccharomyces cerevisiae] [ui:yal010c] [pn:involved in mitochondrial morphology and inheritance:mitochondrial inheritance component mdm10 [gn:mdm10:fun37] [gtcfc:2.8] [keggfc:14.2] [sgdfc:9.7.0] [db:gtc-saccharomyces cerevisiae] |
| CONTIG392 | 35173385_c2_3 | 3543 | 17646 | 843 | 281 | YAL010C | 274 | 4.5(10)-35 | Saccharomyces cerevisiae | [ui:yal010c] [pn:involved in mitochondrial morphology and inheritance:mitochondrial inheritance component mdm10 [gn:mdm10:fun37] [gtcfc:2.8] [keggfc:14.2] [sgdfc:9.7.0] [dh:gtc-saccharomyces cerevisiae] |
| CONTIG5043 | 6258567_c1_9 | 3544 | 17647 | 672 | 224 | YBL038W | 562 | 1.7(10)-54 | Saccharomyces cerevisiae | [ui:ybl038w] [pn:ribosomal protein, mitochondrial:probable mitochondrial 60s ribosomal protein 116 precursor] [gn:mrpl16:rml16:ybl0411] [gtcfc:2.8:10.4] [keggfc:14.2] [sgdfc:5.1.0:9.7.0] [db:gtc-saccharomyces cerevisiae] |
| CONTIG5540 | 2239824_c1_13 | 3545 | 17648 | 2517 | 839 | YBL022C | 1039 | 2.3(10)-170 | Saccharomyces cerevisiae | [ui:ybl022c] [pn:atp-dependent protease, mitochondrial:mitochondrial atp-dependent protease precursor] [gn:pim1:lon:ybl0440] [gtcfc:2.8:10.11:12.16] [ec:3.4.21.-] [keggfc:14.1] [sgdfc:6.4.0:6.5.3:9.7.0] [db:gtc-saccharomyces cerevisiae] |
| CONTIG5197 | 25402150_f3_2 | 3546 | 17649 | 1074 | 358 | YBL013W | 291 | 7.2(10)-34 | Saccharomyces cerevisiae | [ui:ybl013w] [pn:similarity to methionyl-trna formyltransferase:probable methionyl-trna formyltransferase precursor] [gn:ybl0313:ybl0311] [gtcfc:2.8:5.4:9.6:10.6] [ec:2.1.2.9] [keggfc:5.4.9.8:10.1] [sgdfc:4.6.0:9.7.0] [db:gtc-saccharomyces cerevisiae] |
| CONTIG1888 | 423567_c2_3 | 3547 | 17650 | 816 | 272 | YBR003W | 684 | 2.0(10)-67 | Saccharomyces cerevisiae | [ui:ybr003w] [pn:hexaprenyl pyrophosphate synthetase precursor:hps] [gn:coq1:ybr0109] [gtcfc:2.8.3.1:7.1:9.10:9.11:9.12:1 1.3] [ec:2.5.1.-] [keggfc:7.2:9.13] [sgdfc:1.6.3:1.7.1:9.7.0] [dh:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2937 | 4350306_f2_2 | 3548 | 17651 | 552 | 184 | YBR003W | 324 | 2.7(10)-29 | *Saccharomyces cerevisiae* | *saccharomyces cerevisiae* [ui:ybr003w] [pn:hexaprenyl pyrophosphate synthetase precursor:hps] [gn:coq1:ybr0109] [gtcfc:2.8.3.1:7.1:9.10:9.11:9.12:1.1.3] [ec:2.5.1.-] [keggfc:7.2:9.13] [sgdfc:1.6.3:1.7.1:9.7.0] [db:gtc-saccharomyces cerevisiae] |
| CONTIG974 | 10634682_f2_1 | 3549 | 17652 | 342 | 114 | YBR120C | 200 | 3.7(10)-16 | *Saccharomyces cerevisiae* | [ui:ybr120c] [pn:apo-cytochrome b pre-mrna processing protein:cytochrome b pre-mrna processing protein 6] [gn:chp6:ybr0916] [gtcfc:2.8:10.7:10.9] [keggk:14.2] [sgdfc:4.10.0:5.3.0:9.7.0] [db:gtc-saccharomyces cerevisiae] |
| CONTIG4172 | 6850300_f2_1 | 3550 | 17653 | 648 | 216 | YBR122C | 144 | 3.2(10)-10 | *Saccharomyces cerevisiae* | [ui:ybr122c] [pn:ribosomal protein yml36 precursor, mitochondrial:mitochondrial 60s ribosomal protein l36 precursor:yml36] [gn:mrpl36:ybr0918] [gtcfc:2.8:10.4] [keggfc:14.2] [sgdfc:5.1.0:9.7.0] [db:gtc-saccharomyces cerevisiae] |
| CONTIG1483 | 16847911_f3_1 | 3551 | 17654 | 450 | 150 | YBR146W | 429 | 2.1(10)-40 | *Saccharomyces cerevisiae* | [ui:ybr146w] [pn:ribosomal protein s9 precursor, mitochondrial:probable mitochondrial 40s ribosomal protein s9 precursor] [gn:mrps9:ybr1123] [gtcfc:2.8:10.4] [keggfc:14.2] [sgdfc:5.1.0:9.7.0] [db:gtc-saccharomyces cerevisiae] |
| CONTIG3627 | 11847287_f2_2 | 3552 | 17655 | 492 | 164 | YBR185C | 137 | 5.0(10)-9 | *Saccharomyces cerevisiae* | [ui:ybr185c] [pn:respiratory chain assembly protein:mba1 protein precursor] [gn:mba1:ybr1307] [gtcfc:2.8:12.16] [keggfc:14.2] [sgdfc:2.5.0:6.4.0:9.7.0] [db:gtc-saccharomyces cerevisiae] |
| CONTIG3140 | 14977213_c1_3 | 3553 | 17656 | 807 | 269 | YBR251W | 203 | 1.8(10)-16 | *Saccharomyces cerevisiae* | [ui:ybr251w] [pn:ribosomal protein s5, mitochondrial:probable mitochondrial 40s ribosomal protein s5] [gn:mrps5:ybr1704] [gtctc:2.8:10.4] [keggfc:14.2] [sgdfc:5.1.0:9.7.0] [db:gtc-saccharomyces cerevisiae] |
| CONTIG5278 | 15678260_f1_3 | 3554 | 17657 | 534 | 178 | YBR252W | 492 | 4.4(10)-47 | *Saccharomyces cerevisiae* | [ui:ybr252w] [pn:dutp pyrophosphatase precursor, |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | mitochondrial:deoxyuridine 5'-triphosphate nucleotidohydrolase:dutpase:dutp pyrophosphatase] [gn:dut1:ybr1705] [gtcfc:2.8.4.2] [ec:3.6.1.23] [keggfc:4.2] [sgdfc:1.3.2:9.7.0] [db:gtc-sac |
| CONTIG2452 | 10582807_c1_4 | 3555 | 17658 | 381 | 127 | YBR268W | 180 | 5.0(10)-14 | Saccharomyces cerevisiae | [ui:ybr268w] [pn:ribosomal protein yml37, mitochondrial:mitochondrial 60s ribosomal protein 137 precursor:yml37] [gn:mrpl37:ybr1736a] [gtcfc:2.8:10.4] [keggfc:14.2] [sgdfc:5.1.0:9.7.0] [db:gtc-saccharomyces cerevisiae] |
| b3x13305.y | 558192_c3_3 | 3556 | 17659 | 432 | 144 | YBR282W | 167 | 1.2(10)-12 | Saccharomyces cerevisiae | [ui:ybr282w] [pn:ribosomal protein yml27 precursor, mitochondrial:mitochondrial 60s ribosomal protein 127 precursor:yml27] [gn:mrpl27:ybr2019] [gtcfc:2.8:10.4] [keggfc:14.2] [sgdfc:5.1.0:9.7.0] [db:gtc-saccharomyces cerevisiae] |
| CONTIG4072 | 16850075_f2_1 | 3557 | 17660 | 279 | 93 | YCL017C | 387 | 5.7(10)-36 | Saccharomyces cerevisiae | [ui:ycl017c] [pn:involved in tma-processing and mitochondrial metabolism:nifs-like 54.5 kd protein] [gn:nfs1:spl1:ycl17c] [gtcfc:2.8:10.1:10.2:10.6] [keggfc:14.2] [sgdfc:4.5.0:9.5.0:9.7.0] [db:gtc-saccharomyces cerevisiae] |
| CONTIG2311 | 593752_c3_6 | 3558 | 17661 | 1008 | 336 | YCL017C | 966 | 2.6(10)-97 | Saccharomyces cerevisiae | [ui:ycl017c] [pn:involved in tma-processing and mitochondrial metabolism:nifs-like 54.5 kd protein] [gn:nfs1:spl1:ycl17c] [gtcfc:2.8:10.1:10.2:10.6] [keggfc:14.2] [sgdfc:4.5.0:9.5.0:9.7.0] [db:gtc-saccharomyces cerevisiae] |
| CONTIG3547 | 21640801_f3_2 | 3559 | 17662 | 645 | 215 | YCR003W | 186 | 1.2(10)-14 | Saccharomyces cerevisiae | [ui:ycr003w] [pn:ribosomal protein yml32, mitochondrial:mitochondrial 60s ribosomal protein 132 precursor:yml32] [gn:mrpl32:ycr3w:ycr041] [gtcfc:2.8:10.4] [keggfc:14.2] [sgdfc:5.1.0:9.7.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4644 | 5907938_f3_5 | 3560 | 17663 | 528 | 176 | YCR024C | 399 | 3.1(10)-37 | *Saccharomyces cerevisiae* | *saccharomyces cerevisiae* [ui:ycr024c] [pn:asn-trna synthetase, mitochondrial:probable asparaginyl-trna synthetase:asparagine-- trna ligase:asnrs] [gn:ycr24c;ycr242] [gtcfc:2.8.5.2:10.6] [ec:6.1.1.22] [keggfc:5.2:10.1:10.2] [sgdfc:5.4.0:9.7.0] [db:gtc-saccharo |
| CONTIG5186 | 12772510_c3_20 | 3561 | 17664 | 987 | 329 | YCR024C | 612 | 8.4(10)-60 | *Saccharomyces cerevisiae* | [ui:ycr024c] [pn:asn-trna synthetase, mitochondrial:probable asparaginyl- trna synthetase:asparagine-- trna ligase:asnrs] [gn:ycr24c;ycr242] [gtcfc:2.8.5.2:10.6] [ec:6.1.1.22] [keggfc:5.2:10.1:10.2] [sgdfc:5.4.0:9.7.0] [db:gtc-saccharo |
| b3x15336.x | 6664130_f2_1 | 3562 | 17665 | 297 | 99 | YCR046C | 91 | 0.00018 | *Saccharomyces cerevisiae* | [ui:ycr046c] [pn:ribosomal protein, mitochondrial:hypothetical 19.4 kd protein in tsm1-arc1 intergenic region] [gn:petcr46;ycr46c] [gtcfc:2.8:10.4] [keggfc:14.2] [sgdfc:5.1.0:9.7.0] [db-gtc-*saccharomyces cerevisiae*] |
| CONTIG2667 | 19924125_f1_2 | 3563 | 17666 | 264 | 88 | YDR079W | 214 | 1.3(10)-17 | *Saccharomyces cerevisiae* | [ui:ydr079w] [pn:cytochrome c oxidase assembly protein:hypothetical 13.2 kd protein in sed1 -pdc2 intergenic region] [gn:pet100:d4441] [gtcfc:2.8:12.16] [keggfc:14.2] [sgdfc:2.5.0:6.4.0:9.7.0] [db-gtc-*saccharomyces cerevisiae*] |
| CONTIG1205 | 23478430_f1_1 | 3564 | 17667 | 465 | 155 | YDR120C | 160 | 2.0(10)-22 | *Saccharomyces cerevisiae* | [ui:ydr120c] [pn:n2-dimethylguanine trna methyltransferase:n2,n2-dimethylguanosine trna methyltransferase precursor] [gn:trm1:yd9727] [gtctc:2.8:10.6] [ec:2.1.1.32] [keggfc:14.1] [sgdfc:4.6.0:9.7.0] [db-gtc-*saccharomyces cerevisiae* |
| CONTIG645 | 15829015_c3_3 | 3565 | 17668 | 744 | 248 | YDR120C | 646 | 2.1(10)-63 | *Saccharomyces cerevisiae* | [ui:ydr120c] [pn:n2-dimethylguanine trna methyltransferase:n2,n2-dimethylguanosine trna methyltransferase precursor] [gn:trm1:yd9727] [gtctc:2.8:10.6] [ec:2.1.1.32] [keggfc:14.1] [sgdfc:4.6.0:9.7.0] [db-gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5076 | 1203416_c2_9 | 3566 | 17669 | 2013 | 671 | YDR194C | 524 | 1.8(10)-50 | *Saccharomyces cerevisiae* | *saccharomyces cerevisiae* [ui:ydr194c] [pn:rna helicase of the dead box family, mitochondrial:atp-dependent rna helicase mss116 precursor] [gn:mss116;yd9346] [gtcfc:2.8:10.2] [keggfc:14.2] [sgdfc:4.9.0:9.7.0] [db:gtc-*saccharomyces cerevisiae*] |
| CONTIG4689 | 22298761_c3_11 | 3567 | 17670 | 564 | 188 | YDR197W | 139 | 6.7(10)-9 | *Saccharomyces cerevisiae* | [ui:ydr197w] [pn:cytochrome b translational activator protein:cytochrome b translational activator protein cbs2] [gn:cbs2;cbp7:yd9346] [gtcfc:2.8:10.7] [keggfc:14.2] [sgdfc:5.3.0:9.7.0] [db:gtc-*saccharomyces cerevisiae*] |
| CONTIG3239 | 995667_c2_7 | 3568 | 17671 | 711 | 237 | YDR232W | 715 | 1.0(10)-70 | *Saccharomyces cerevisiae* | [ui:ydr232w] [pn:5-aminolevulinate synthase:5-aminolevulinic acid synthase, mitochondrial precursor:delta-aminolevulinate synthase:delta-ala synthetase] [gn:hem1:yd9934] [gtcfc:2.8:5.3:9.10:9.11] [cc:2.3.1.37] [keggfc:5.3] [sgdfc:1.7. |
| CONTIG3239 | 9882667_c1_5 | 3569 | 17672 | 930 | 310 | YDR232W | 945 | 4.2(10)-95 | *Saccharomyces cerevisiae* | [ui:ydr232w] [pn:5-aminolevulinate synthase:5-aminolevulinic acid synthase, mitochondrial precursor:delta-aminolevulinate synthase:delta-ala synthetase] [gn:hem1:yd9934] [gtcfc:2.8:5.3:9.10:9.11] [cc:2.3.1.37] [keggfc:5.3] [sgdk:1.7. |
| CONTIG4672 | 21640811_c1_8 | 3570 | 17673 | 1158 | 386 | YDR234W | 97 | 0.13 | *Saccharomyces cerevisiae* | [ui:ydr234w] [pn:homoaconitase:homoaconitate precursor:homoaconitate hydratase] [gn:lys4;yd9934] [gtcfc:2.8:58:6.6] [ec:4.2.1.36] [keggfc:5.8] [sgdfc:1.1.1:9.7.0] [db:gtc-*saccharomyces cerevisiae*] |
| CONTIG4880 | 34703879_c1_6 | 3571 | 17674 | 1977 | 659 | YDR234W | 2353 | 2.7(10)-244 | *Saccharomyces cerevisiae* | [ui:ydr234w] [pn:homoaconitase:homoaconitate precursor:homoaconitate hydratase] [gnck:2.8:5.8:6.6] [ec:4.2.1.36] [keggfc:5.8] [sgdfc:1.1.1:9.7.0] [db:gtc-*saccharomyces cerevisiae*] |
| CONTIG5547 | 13787567_c3_17 | 3572 | 17675 | 2328 | 776 | YDR258C | 2282 | 9.0(10)-237 | *Saccharomyces cerevisiae* | [ui:ydr258c] [pn:heat shock protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | of clpb family of atp-dependent proteases, mitochondrial:mitochondrial heat shock protein 78 precursor] [gn:hsp78] [gtcfc:12.7.2.8:10.11:13.2] [keggfc:14.2] [sgdfc:6.6.0:9.7.0:11.1.0] [db:gtc-saccha |
| CONTIG5125 | 24414078_c2_14 | 3573 | 17676 | 1215 | 405 | YDR268W | 977 | 1.8(10)-98 | Saccharomyces cerevisiae | [ui:ydr268w] [pn:tryptophanyl-trna synthetase, mitochondrial:tryptophan–trna ligase:trprs] [gn:msw1:msw:d9954] [gtcfc:2.8.5.14:10.6] [ec:6.1.1.2] [keggfc:5.14:10.1:10.2] [sgdfc:5.4.0:97.0] [db:gtc-saccharomyces cerevisiae] |
| CONTIG5518 | 9765627_c3_20 | 3574 | 17677 | 1047 | 349 | YDR337W | 439 | 1.8(10)-41 | Saccharomyces cerevisiae | [ui:ydr337w] [pn:ribosomal protein of the small subunit, mitochondrial:mitochondrial 40s ribosomal protein s28 precursor] [gn:mrps28:d9651] [gtcfc:2.8:10.4] [keggfc:14.2] [sgdfc:5.1.0:9.7.0] [db:gtc-saccharomyces cerevisiae] |
| CONTIG4636 | 501381_f3_2 | 3575 | 17678 | 1077 | 359 | YDR347W | 163 | 5.9(10)-10 | Saccharomyces cerevisiae | [ui:ydr347w] [pn:ribosomal protein of the small subunit, mitochondrial:mitochondrial 40s ribosomal protein mrp1] [gn:mrp1:d9651] [gtcfc:2.8:10.4] [keggfc:14.2] [sgdfc:5.1.0:9.7.0] [db:gtc-saccharomyces cerevisiae] |
| CONTIG2236 | 21650937_f1_1 | 3576 | 17679 | 627 | 209 | YDR375C | 795 | 3.3(10)-79 | Saccharomyces cerevisiae | [ui:ydr375c] [pn:mitochondrial protein of the cdc48/pas1/sec18:aaa family of atpases:bcs1 protein] [gn:bcs1:d9481] [gtcfc:2.8:12.16] [keggfc:14.2] [sgdfc:6.4.0:9.7.0] [db:gtc-saccharomyces cerevisiae] |
| CONTIG4291 | 16836540_f2_3 | 3577 | 17680 | 309 | 103 | YDR375C | 118 | 1.7(10)-6 | Saccharomyces cerevisiae | [ui:ydr375c] [pn:mitochondrial protein of the cdc48/pas1/sec18:aaa family of atpases:bcs1 protein] [gn:bcs1:d9481] [gtcfc:2.8:12.16] [keggfc:14.2] [sgdfc:6.4.0:9.7.0] [db:gtc-saccharomyces cerevisiae] |
| CONTIG3826 | 11038567_c2_3 | 3578 | 17681 | 813 | 271 | YDR376W | 345 | 1.6(10)-31 | Saccharomyces cerevisiae | [ui:ydr376w] [pn:similarity to human adrenodoxin reductase and ferredoxin-nadp+ reductase:nadph:adrenodoxin oxidoreductase homolog precursor:adrenodoxin reductase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1088 | 22378775_f3_1 | 3579 | 17682 | 609 | 203 | YDR405W | 279 | 1.6(10)-24 | *Saccharomyces cerevisiae* | homolog] [gn:arh1:d9481] [gtcfc:2.8:3.4:8.1:8.2] [keggfc:14.2] [sgdfc:1 [ui:ydr405w] [pn:ribosomal protein of the large subunit, mitochondrial:mitochondrial 60s ribosomal protein l41 precursor:yml41] [gn:mrpl41:mrp20:d9509] [gtcfc:2.8:10.4] [keggfc:14.2] [sgdfc:5.1.0:9.7.0] [db:gtc-saccharomyces cerevisia |
| CONTIG2510 | 6640687_f1_1 | 3580 | 17683 | 495 | 165 | YDR462W | 316 | 1.8(10)-28 | *Saccharomyces cerevisiae* | [ui:ydr462w] [pn:ribosomal protein yml28, mitochondrial] [gtcfc:2.8:10.4] [keggfc:14.2] [sgdfc:5.1.0:9.7.0] [db:gtc-saccharomyces cerevisiae] |
| CONTIG2838 | 4085965_c2_4 | 3581 | 17684 | 960 | 320 | YER014W | 327 | 3.7(10)-29 | *Saccharomyces cerevisiae* | [ui:yer014w] [pn:protoporphyrinogen oxidase, mitochondrial:protoporphyrinogen oxidase:ppo] [gn:hem14] [gtcfc:2.8,9.10:9.11] [ec:1.3.3.4] [keggfc:9.10] [sgdfc:1.7.1:9.7.0] [db:gtc-saccharomyces cerevisiae] |
| CONTIG5244 | 10156251_f3_10 | 3582 | 17685 | 621 | 207 | YER014W | 379 | 4.0(10)-35 | *Saccharomyces cerevisiae* | [ui:yer014w] [pn:protoporphyrinogen oxidase, mitochondrial:protoporphyrinogen oxidase:ppo] [gn:hem14] [gtcfc:2.8,9.10:9.11] [ec:1.3.3.4] [keggfc:9.10] [sgdfc:1.7.1:9.7.0] [db:gtc-saccharomyces cerevisiae] |
| CONTIG1007 | 24320317_f2_1 | 3583 | 17686 | 855 | 285 | YER017C | 575 | 7.0(10)-56 | *Saccharomyces cerevisiae* | [ui:yer017c] [pn:protease of the sec18/cdc48/pas1 family of atpases:aaa:afg3 protein:tat-binding homolog 10] [gn:afg3:yta10] [gtcfc:2.8:10.11:12.16] [ec:3.4.24.-] [keggfc:14.1] [sgdfc:6.4.0:6.5.3:9.7.0] [db:gtc-saccharomyces cerevisia |
| CONTIG5132 | 24508438_c2_11 | 3584 | 17687 | 1209 | 403 | YER017C | 959 | 4.5(10)-126 | *Saccharomyces cerevisiae* | [ui:yer017c] [pn:protease of the sec18/cdc48/pas1 family of atpases:aaa:afg3 protein:tat-binding homolog 10] [gn:afg3:yta10] [gtcfc:2.8:10.11:12.16] [ec:3.4.24.-] [keggfc:14.1] [sgdfc:6.4.0:6.5.3:9.7.0] [db:gtc-saccharomyces cerevisia |
| CONTIG385 | 11750755_c3_4 | 3585 | 17688 | 687 | 229 | YER026C | 708 | 5.5(10)-70 | *Saccharomyces cerevisiae* | [ui:yer026c] [pn:cdp-diacylglycerol serine o- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2766 | 10632776_c2_6 | 3586 | 17689 | 306 | 102 | YER058W | 128 | 1.6(10)-8 | Saccharomyces cerevisiae | phosphatidyltransferase:cdp-diacylglycerol--serine o-phosphatidyltransferase:phosphatidyl-serine synthase] [gn:cho1:pss1:pss] [gtcfc:2.8:3.4:5.3:8.1:8.2:12.16] [ec:2.7.8.8] [keggfc:5.3:8.1] [ui:yer058w] [pn:cytochrome c oxidase assembly factor:protein precursor] [gn:pet117] [gtcfc:2.8: 12.16] [keggfc:14.2] [sgdfc:6.4:0:9.7.0] [db:gtc-saccharomyces cerevisiae |
| CONTIG4186 | 6647807_f3_2 | 3587 | 17690 | 924 | 308 | YER061C | 534 | 1.5(10)-51 | Saccharomyces cerevisiae | [ui:yer061c] [pn:3-oxoacyl-acyl carrier-protein synthase homolog:beta-keto-acyl-acp synthase, mitochondrial] [gn:cem1] [gtcfc:2.8:3.1:3.4:8.1:8.2] [ec:2.3.1.41] [keggfc:3.1] [sgdfc:1.6.1:2.5.0:9.7.0] [db:gtc-saccharomyces cerevisiae |
| CONTIG4985 | 20897942_c3_9 | 3588 | 17691 | 282 | 94 | YER061C | 220 | 1.2(10)-17 | Saccharomyces cerevisiae | [ui:yer061c] [pn:3-oxoacyl-acyl carrier-protein synthase homolog:beta-keto-acyl-acp synthase, mitochondrial] [gn:cem1] [gtcfc:2.8:3.1:3.4:8.1:8.2] [ec:2.3.1.41] [keggfc:3.1] [sgdk:1.6.1:2.5.0:9.7.0] [dh:gtc-saccharomyces cerevisiae |
| CONTIG5605 | 486575_f1_2 | 3589 | 17692 | 2598 | 866 | YER069W | 2780 | 1.5(10)-289 | Saccharomyces cerevisiae | [ui:yer069w] [pn:acetylglutamate kinase and acetylglutamyl-phosphate reductase] [gn:arg5:6] [gtcfc:2.8:6.6] [keggfc:14.2] [sgdfc:1.1.1:9.7.0] [db:gtc-saccharomyces cerevisiae |
| CONTIG4952 | 26270942_c3_8 | 3590 | 17693 | 660 | 220 | YER086W | 671 | 4.7(10)-66 | Saccharomyces cerevisiae | [ui:yer086w] [pn:anabolic serine and threonine dehydratase precursor:threonine dehydratase precursor:threonine deaminase] [gn:ilv1] [gtcfc:2.8:5.3:6.6] [ec:4.2.1.16] [keggfc:5.3] [sgdfc:1.1.1:9.7.0] [db:gtc-saccharomyces cerevisiae |
| CONTIG5168 | 32209802_f1_2 | 3591 | 17694 | 582 | 194 | YER086W | 565 | 8.0(10)-55 | Saccharomyces cerevisiae | [ui:yer086w] [pn:anabolic serine and threonine dehydratase precursor:threonine dehydratase precursor:threonine deaminase] [gn:ilv1] [gtcfc:2.8:5.3:6.6] [ec:4.2.1.16] [keggfc:5.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5806 | 38877_f3_16 | 3592 | 17695 | 1245 | 415 | YER141W | 1031 | 3.2(10)-104 | Saccharomyces cerevisiae | [sgdfc:1.1.1.9.7.0] [db:gtc-saccharomyces cerevisiae] [ui:yer141w] [pn:cytochrome oxidase assembly factor:cytochrome c oxidase assembly protein] [gn:cox15] [gtcfc:2.8.12.16] [kegg fc:14.2] [sgdfc:6.40:9.7.0] [db:gtc-saccharomyces cerevisiae] |
| CONTIG1344 | 3906275_f1_1 | 3593 | 17696 | 909 | 303 | YER154W | 478 | 1.3(10)-45 | Saccharomyces cerevisiae | [ui:yer154w] [pn:cytochrome oxidase biogenesis protein:cytochrome oxidase biogenesis protein oxa1 precursor] [gn:oxa1:pet1402] [gtcfc:2.8:12.16] [kegg fc:14.2] [sgdfc:2.5.0:6.4.0:9.7.0] [db:gtc-saccharomyces cerevisiae] |
| CONTIG3807 | 24484452_c1_7 | 3594 | 17697 | 1644 | 548 | YER168C | 927 | 3.5(10)-93 | Saccharomyces cerevisiae | [ui:yer168c] [pn:trna nucleotidyltransferase:trna nucleotidyltransferase precursor:trna adenylyltransferase:trna cca-pyrophosphorylase] [gn:cca1:tnt1] [gtcfc:2.8.10.1:10.2:10.6:14.1] [ec:2.7.7.25] [keggfc:14.1] [sgdfc:4.6.0:9.2.0:9.5. |
| CONTIG4129 | 3223908_c3_14 | 3595 | 17698 | 588 | 196 | YER170W | 501 | 4.7(10)-48 | Saccharomyces cerevisiae | [ui:yer170w] [pn:adenylate kinase, mitochondrial:adenylate kinase 2:atp-amp transphosphorylase] [gn:adk2:pak3] [gtcfc:2.8.4.1:12.13:12.8] [ec:2.7.4.3] [keggfc:4.1] [sgdfc:1.3.8:3.1.0:9.7.0] [db:gtc-saccharomyces cerevisiae] |
| CONTIG4374 | 6347656_f2_1 | 3596 | 17699 | 2058 | 686 | YFL036W | 1308 | 1.5(10)-133 | Saccharomyces cerevisiae | [ui:yfl036w] [pn:dna-directed rna polymerase, mitochondrial:dna-directed rna polymerase mitochondrial precursor] [gn:rpo41] [gtcfc:2.8.4.1:4.2:10.2:10.8] [ec:2.7.7.6] [keggfc:4.1:4.2] [sgdfc:3.6.0:4.8.1:9.7.0] [db:gtc-saccharomyces cerevisiae ce |
| CONTIG4904 | 19744788_c2_4 | 3597 | 17700 | 1014 | 338 | YFL036W | 748 | 3.2(10)-73 | Saccharomyces cerevisiae | [ui:yfl036w] [pn:dna-directed rna polymerase, mitochondrial:dna-directed rna polymerase mitochondrial precursor] [gn:rpo41] [gtcfc:2.8.4.1:4.2:10.2:10.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5682 | 35347688_c3_27 | 3598 | 17701 | 834 | 278 | YFL036W | 392 | 4.2(10)-35 | Saccharomyces cerevisiae | [ec:2.7.7.6] [keggfc:4.1:4.2] [sgdfc:3.6.0:4.8.1:9.7.01[db:gtc-saccharomyces ce [ui:yfl036w] [pn:dna-directed rna polymerase, mitochondrial:dna-directed rna polymerase mitochondrial precursor] [gn:rpo41] [gtcfc:2.8.4.1:4.2:10.2:10.8] [ec:2.7.7.6] [keggfc:4.1:4.2] [sgdfc:3.6.0:4.8.1:9.7.0] [db:gtc-saccharomyces ce |
| CONTIG5682 | 2113792_c2_25 | 3599 | 17702 | 2190 | 730 | YFL036W | 189 | 8.4(10)-11 | Saccharomyces cerevisiae | [ui:yfl036w] [pn:dna-directed rna polymerase, mitochondrial:dna-directed rna polymerase mitochondrial precursor] [gn:rpo41] [gtcfc:2.8.4.1:4.2:10.2:10.8] [ec:2.7.7.6] [keggfc:4.1:4.2] [sgdfc:3.6.0:4.8.1:9.7.01[db:gtc-saccharomyces ce |
| CONTIG1885 | 34406587_f2_1 | 3600 | 17703 | 720 | 240 | YFL016C | 268 | 47(10)-36 | Saccharomyces cerevisiae | [ui:yi016c] [pn:heat shock protein chaperone:protein precursor] [gn:mdj1] [gtcfc:12.7:2.8:10.5:10.7:13.2] [keggfc:14.2] [sgdfc:6.1.0:9.7.0:11.1.0] [db:gtc-saccharomyces cerevisiae] |
| CONTIG5665 | 13862575_f1_1 | 3601 | 17704 | 267 | 89 | YFR049W | 98 | 2.5(10)-5 | Saccharomyces cerevisiae | [ui:yfr049w] [pn:ribosomal protein, mitochondrial:mitochondrial 40s ribosomal protein ymr-31 precursor] [gn:ymr31] [gtcfc:2.8:10.4] [keggk:14.2] [sgdfc:5.1.0:9.7.0] [db:gtc-saccharomyces cerevisiae |
| CONTIG5123 | 977140_c2_10 | 3602 | 17705 | 1860 | 620 | YGL119W | 1345 | 1.8(10)-137 | Saccharomyces cerevisiae | [ui:ygl119w] [pn:ubiquinol cytochrome-c reductase complex assembly protein:protein precursor] [gn:abc1] [gtcfc:2.8.12.16] [keggfc:14.2] [sgdk:2.5.0.6.4.0:9.7.0] [db:gtc-saccharomyces cerevisiae |
| CONTIG5275 | 10574224_c1_14 | 3603 | 17706 | 219 | 73 | YGL068W | 229 | 3.2(10)-19 | Saccharomyces cerevisiae | [ui:ygl068w] [pn:probable ribosomal protein 112:putative mitochondrial 60s ribosomal protein 17/112 precursor] [gtcfc:2.8:10.4] [keggfc:14.2] [sgdfc:5.1.0:9.7.0] [db:gtc-saccharomyces cerevisiae |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5447 | 24407830_f1_3 | 3604 | 17707 | 543 | 181 | YGR076C | 233 | 1.2(10)-19 | *Saccharomyces cerevisiae* | [ui:ygr076c] [pn:ribosomal protein ymr26:yml25, mitochondrial:mitochondrial 60s ribosomal protein l25:yml25] [gn:mrpl25:ymr26] [gtcfc:2.8:10.4] [keggfc:14.2] [sgdfc:5.1.0:9.7.0] [db:gtc-*saccharomyces cerevisiae*] |
| CONTIG1387 | 19573387_c1_2 | 3605 | 17708 | 945 | 315 | YGR094W | 952 | 7.7(10)-96 | *Saccharomyces cerevisiae* | [ui:ygr094w] [pn:valyl-trna synthetase; valyl-trna synthetase, mitochondrial precursor:valine--trna ligase:valrs1] [gn:vas1] [gtcfc:2.8:5.7:10.6] [ec:6.1.1.9] [keggfc:5.7:10.1:10.2] [sgdfc:5.4.0:9.2.0:9.7.0] [db:gtc-*saccharomyces cerevi*] |
| CONTIG3315 | 3157502_f2_2 | 3606 | 17709 | 1284 | 428 | YGR094W | 1122 | 7.5(10)-114 | *Saccharomyces cerevisiae* | [ui:ygr094w] [pn:valyl-trna synthetase:valyl-trna synthetase, mitochondrial precursor:valine--trna ligase:valrs1] [gn:vas1] [gtcfc:2.8:5.7:10.6] [ec:6.1.1.9] [keggfc:5.7:10.1:10.2] [sgdfc:5.40.9.2.0:9.7.0] [db:gtc-*saccharomyces cerevi*] |
| CONTIG3315 | 4102157_f1_1 | 3607 | 17710 | 1155 | 385 | YGR094W | 1601 | 1.3(10)-164 | *Saccharomyces cerevisiae* | [ui:ygr094w] [pn:valyl-trna synthetase:valyl-trna synthetase, mitochondrial precursor:valine--trna ligase:valrs1] [gn:vas1] [gtcfc:2.8:5.7:10.6] [ec:6.1.1.9] [keggfc:5.7:10.1:10.2] [sgdfc:5.4.0:9.2.0:9.7.0] [db:gtc-*saccharomyces cerevi*] |
| CONTIG5713 | 13773450_f1_1 | 3608 | 17711 | 486 | 162 | YGR171C | 180 | 5.0(10)-13 | *Saccharomyces cerevisiae* | [ui:ygr171c] [pn:methionyl-trna synthetase:methionyl-trna synthetase, mitochondrial:methionine--trna ligase:metrs] [gn:msm1] [gtcfc:2.8:5.4:6.4:10.6] [cc:6.1.1.10] |
| CONTIG3802 | 4335052_f2_3 | 3609 | 17712 | 444 | 148 | YGR174C | 331 | 5.0(10)-30 | *Saccharomyces cerevisiae* | [keggfc:5.4:6.4:10.1:10.2] [sgdfc:5.4.0:9.7.0] [db:gtc-*saccharomyces cerevisiae*] [ui:ygr174c] [pn:ubiquinol-cytochrome c reductase assembly factor:protein precursor] [gn:cbp4] [gtcfc:2.8:12.16] [keggfc:14.2] [sgdfc:2.5.0:6.4.0:9.7.0] [db:gtc-*saccharomyces cerevisiae*] |
| b2x13522.y | 23632941_c3_2 | 3610 | 17713 | 618 | 206 | YGR207C | 437 | 2.8(10)-41 | *Saccharomyces* | [ui:ygr207c] [pn:electron- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x14802.y | 16413507_c1_1 | 3611 | 17714 | 528 | 176 | YGR207C | 349 | 6.2(10)-32 | Saccharomyces cerevisiae | transferring flavoprotein, beta chain:probable electron transfer flavoprotein beta-subunit:beta- etf] [gn:etf-beta:g7742] [gtcfc:2.5.0.9.7.0] [keggfc:14.2] [sgdfc:2.8] [dh:gtc-saccharomyces cerevisiae] [ui:ygr207c] [pn:electron-transferring flavoprotein, beta chain:probable electron transfer flavoprotein beta-subunit:beta- etf] [gn:etf-beta:g7742] [gtcfc:2.5.0.9.7.0] [keggfc:14.2] [sgdfc:2.8] [db:gtc-saccharomyces cerevisiae] |
| CONTIG2016 | 787562_f3_1 | 3612 | 17715 | 702 | 234 | YGR220C | 396 | 6.5(10)-37 | Saccharomyces cerevisiae | [ui:ygr220cf [pn:ribosomal protein of the large subunit, mitochondrial:mitochondrial 60s ribosomal protein l9 precursor:yml9] [gn:mrpl9:g8520] [gtcfc:28:10.4] [keggfc:14.2] [sgdfc:5.1.0:9.7.0] [db:gtc-saccharomyces cerevisiae] |
| CONTIG2325 | 34267142_f1_1 | 3613 | 17716 | 522 | 174 | YHL004W | 322 | 4.5(10)-29 | Saccharomyces cerevisiae | [ui:yhl004w] [pn:ribosomal protein of the small subunit, mitochondrial:mitochondrial 40s ribosomal protein] [gn:mrp4] [gtcfc:2.8:10.4] [keggfc:14.2] [sgdfc:5.1.0:9.7.0] [db:gtc-saccharomyces cerevisiae] |
| CONTIG2859 | 30595705_c2_5 | 3614 | 17717 | 885 | 295 | YHL004W | 146 | 3.0(10)-8 | Saccharomyces cerevisiae | [ui:yhl004w] [pn:ribosomal protein of the small subunit, mitochondrial:mitochondrial 40s ribosomal protein] [gn:mrp4] [gtcfc:2.8:10.4] [keggfc:14.2] [sgdfc:5.1.0:9.7.0] [db:gtc-saccharomyces cerevisiae] |
| CONTIG2395 | 1210300_c3_6 | 3615 | 17718 | 687 | 229 | YHR008C | 691 | 3.6(10)-68 | Saccharomyces cerevisiae | [ui:yhr008c] [pn:superoxide dismutase:mn precursor, mitochondrial:superoxide dismutase precursor:mn] [gn:sod2] [gtcfc:2.8:12.12] [ec:1.15.1.1] [keggfc:14.1] [sgdfc:9.7.0:11.3.0] [db:gtc-saccharomyces cerevisiae] |
| CONTIG4301 | 15660212_f2_4 | 3616 | 17719 | 204 | 68 | YHR008C | 91 | 0.00044 | Saccharomyces cerevisiae | [ui:yhr008c] [pn:superoxide dismutase:mn precursor, mitochondrial:superoxide dismutase precursor:mn] [gn:sod2] [gtcfc:2.8:12.12] [ec:1.15.1.1] [keggk:14.1] [sgdfc:9.7.0:11.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4301 | 15673286_f2_5 | 3617 | 17720 | 516 | 172 | YHR008C | 578 | 3.3(10)-56 | *Saccharomyces cerevisiae* | [ui:yhr008c] [pn:superoxide dismutase:mn precursor, mitochondrial:superoxide dismutase precursor:mn] [gn:sod2] [gtcfc:2.812.12] [ec:1.15.1.1] [keggfc:14.1] [sgdfc:9.7.0:11.3.0] [db:gtc-*saccharomyces cerevisiae*] |
| CONTIG5325 | 4335003_c2_13 | 3618 | 17721 | 543 | 181 | YHR024C | 310 | 15(10)-27 | *Saccharomyces cerevisiae* | [ui:yhr024c] [pn:processing peptidase, catalytic 53 kda:alpha subunit, mitochoridrial:mitochondrial processing peptidase alpha subunit precursor:alpha-mpp] [gn:mas2:mif2] [gtcfc:2.8:10.7] [ec:3.4.24.64] [keggfc:14.1] [sgdfc:6.3.0:9.7.0] |
| CONTIG5325 | 14455305_c1_7 | 3619 | 17722 | 1137 | 379 | YHR024C | 817 | 1.6(10)-81 | *Saccharomyces cerevisiae* | [ui:yhr024c] [pn:processing peptidase, catalytic 53 kda:alpha subunit, mitochoridrial:mitochondrial processing peptidase alpha subunit precursor:alpha-mpp] [gn:mas2:mif2] [gtcfc:2.8:10.7] [ec:3.4.24.64] [keggfc:4.1] [sgdfc:6.3.0:9.7.0] |
| CONTIG2505 | 20490811_f1_1 | 3620 | 17723 | 1257 | 419 | YHR037W | 1216 | 8.3(10)-124 | *Saccharomyces cerevisiae* | [ui:yhr037w] [pn:1-pyrroline-5-carboxylate dehydrogenase:delta-1-pyrroline-5-carboxylate dehydrogenase precursor:p5c dehydrogenase] [gn:put2] [gtcfc:2.8.5:1:5.10:6.6] [ec:1.5.1.12] [keggfc:5.1.5.10] [sgdfc:1.1.1:97.0] [db-gtc-sacchar |
| CONTIG1990 | 819687_f2_2 | 3621 | 17724 | 1170 | 390 | YHR120W | 542 | 1.5(10)-51 | *Saccharomyces cerevisiae* | [ui:yhr120w] [pn:dna mismatch repair protein, mitochondrial:muts protein homolog 1] [gn:msh1] [gtcfc:2.8:10.8] [keggfc:14.2] [sgdfc:3.7.0:9.7.0] [db:gtc-*saccharomyces cerevisiae*] |
| CONTIG3662 | 30270253_c2_7 | 3622 | 17725 | 264 | 88 | YHR120W | 179 | 1.3(10)-12 | *Saccharomyces cerevisiae* | [ui:yhr120w] [pn:dna mismatch repair protein, mitochondrial:muts protein homolog 1] [gn:msh1] [gtcfc:2.8:10.8] [keggfc:14.2] [sgdfc:3.7.0:9.7.0] [db-gtc-*saccharomyces cerevisiae*] |
| CONTIG2483 | 2506556_c1_3 | 3623 | 17726 | 717 | 239 | YHR147C | 437 | 2.8(10)-41 | *Saccharomyces cerevisiae* | [ui:yhr147c] [pn:ribosomal protein of the large subunit, mitochondrial:mitochondrial 60s ribosomal protein l6 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2293 | 40636_c1_3 | 3624 | 17727 | 972 | 324 | YIL043C | 587 | 3.7(10)-57 | Saccharomyces cerevisiae | precursor:yml6] [gn:mpl6] [gtcfc:2.8:10.4] [keggfc:14.2] [sgdfc:5.1.0:9.7.0] [db:gtc-saccharomyces cerevisiae] [ui:yil043c] [pn:cytochrome-b5 reductase;putative nadh-cytochrome b5 reductase:p35] [gn:cbr1:cbr5:cbr] [gtcfc:2.8:7.1] [ec:1.6.2.2] [keggfc:4.4] [sgdfc:2.5.0:9.7.0] [db:gtc-saccharomyces cerevisiae] |
| CONTIG624 | 20899163_f2_2 | 3625 | 17728 | 342 | 114 | YIL208C | 330 | 6.4(10)-30 | Saccharomyces cerevisiae | [ui:yil208c] [pn:nuclease, mitochondrial:mitochondrial nuclease] [gn:nucl:j0310:hre329] [gtcfc:2.8:4.4:10.10] [ec:3.1.30.-] [keggfc:14.1] [sgdfc:1.3.6:9.7.0] [db:gtc-saccharomyces cerevisiae] |
| b3x14607.y | 23866630_c3_2 | 3626 | 17729 | 519 | 173 | YIL208C | 559 | 3.5(10)-54 | Saccharomyces cerevisiae | [ui:yj1208c] [pn:nuclease, mitochondrial:mitochondrial nuclease] [gn:nucl:j0310:hre329] [gtcfc:2.8:4.4:10.10] [ec:3.1.30.-] [keggfc:14.1] [sgdfc:1.3.6:9.7.0] [db:gtc-saccharomyces cerevisiae] |
| CONTIG1101 | 24476527_c1_2 | 3627 | 17730 | 594 | 198 | YJ180C | 287 | 2.2(10)-25 | Saccharomyces cerevisiae | [ui:yjl180c] [pn:f1f0-apase complex assembly protein:atp12 protein precursor] [gn:atp12:j0486] [gtcfc:2.8:12.16] [keggfc:14.21] [sgdfc:6.4.0:9.7.0] [db:gtc-saccharomyces cerevisiae] |
| CONTIG4516 | 4017160_c1_9 | 3628 | 17731 | 951 | 317 | YJL133W | 442 | 8.6(10)-42 | Saccharomyces cerevisiae | [ui:yjl133w] [pn:rna splicing protein and member of the mitochondrial carrier family:mcf:mitochondrial rna splicing protein mrs3] [gn:mrs3:j0675] [gtcfc:2.8:10.2] [keggfc:14.21] [sgdfc:4.9.0:9.7.0] [db:gtc-saccharomyces cerevisiae] |
| CONTIG5288 | 4322777_c2_15 | 3629 | 17732 | 2220 | 740 | YIL102W | 1303 | 5.0(10)-133 | Saccharomyces cerevisiae | [ui:yjl102w] [pn:translation elongation factor, mitochondrial:elongation factor g, mitochondrial 2 precursor:mef-g-2] [gn:mcf2:j0826] [gtcfc:2.8:10.7] [keggfc:14.2] [sgdfc:5.2.0:9.7.0] [db:gtc-saccharomyces cerevisiae] |
| CONTIG5801 | 781312_c1_25 | 3630 | 17733 | 843 | 281 | YIL063C | 175 | 2.1(10)-13 | Saccharomyces cerevisiae | [ui:yjl063c] [pn:ribosomal protein 117, mitochondrial:mitochondrial 60s ribosomal protein 18:yml8] [gn:mrpl8:j1125:hrd238] [gtcfc:2.8:10.4] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3687 | 19609687_f1_1 | 3631 | 17734 | 1806 | 602 | YJR016C | 2114 | 5.7(10)-219 | Saccharomyces cerevisiae | [sgdfc:5.1.0:9.7.0] [db:gtc-saccharomyces cerevisiae] [ui:yjr016c] [pn:dihydroxy-acid dehydratase:dihydroxy-acid dehydratase precursor:dad:2,3 dihydroxy acid hydrolyase] [gn:ilv3j1450] [gtcfc:2.8:5.7:6.6:9.5] [ec:4.2.1.9] [keggfc:5.7:9.5] [sgdfc:1.1.1:9.7.0] [db:gtc-saccharomyces cerev |
| CONTIG5200 | 23674202_c1_10 | 3632 | 17335 | 1965 | 655 | YJR045C | 1663 | 3.6(10)-171 | Saccharomyces cerevisiae | [ui:yjr045c] [pn:mitochondrial heat shock protein 70-related protein:mitochondrial heat shock protein ssc1 precursor:endonuclease scei 75 kd subunit] [gn:ssc1:cns1:j1639] [gtcfc:12.7:2.8:10.2:10.5:10.7:13.2] [keggfc:14.2] [sgdfc:4.9.0 |
| CONTIG5304 | 36204187_c3_9 | 3633 | 17736 | 1551 | 517 | YJR045C | 1998 | 1.1(10)-206 | Saccharomyces cerevisiae | [ui:yjr045c] [pn:mitochondrial heat shock protein 70-related protein:mitochondrial heat shock protein ssc1 precursor:endonuclease scei 75kd subunit] [gn:ssc1:ens1:j1639] [gtcfc:12.7:2.8:10.2:10.5:10.7:13.2] [keggfc:14.2] [sgdfc:4.9.0 |
| CONTIG4485 | 4689000_f1_2 | 3634 | 17737 | 363 | 121 | YJR048W | 479 | 1.0(10)-45 | Saccharomyces cerevisiae | [ui:yjr048w] [pn:cytochrome c isoform 1:cytochrome c, iso-1] [gn:cyc1:j1653] [gtcfc:2.8] [keggfc:14.2] [sgdfc:2.5.0:9.7.0] [db:gtc-saccharomyces cerevisiae] |
| CONTIG4669 | 3940677_c3_10 | 3635 | 17738 | 921 | 307 | YJR095W | 956 | 3.0(10)-96 | Saccharomyces cerevisiae | [ui:yjr095w] [pn:regulator of acetyl-coa synthetase activity] [gn:acr1;j1921] [gtcfc:2.8:12.13] [keggfc:14.2] [sgdfc:1.5.2:9.7.0] [db:gtc-saccharomyces cerevisiae] |
| CONTIG5093 | 312_f2_2 | 3636 | 17739 | 813 | 271 | YJR113C | 458 | 1.7(10)-43 | Saccharomyces cerevisiae | [ui:yjr113c] [pn:similarity to bacterial, chloroplast and mitochondrial ribosomal protein s7:putative 40s ribosomal protein yjr113c] [gtcfc:2.8:10.4] [keggfc:14.2] [gn:j2020] [sgdfc:5.1.0:9.7.0] [db:gtc-saccharomyces cerevisiae] |
| CONTIG3874 | 15658430_c3_10 | 3637 | 17740 | 774 | 258 | YJR144W | 566 | 6.2(10)-55 | Saccharomyces cerevisiae | [ui:yjr144w] [pn:mitochondrial genome maintenance protein:mitochondrial genome maintenance protein mgm101 precursor] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x12579.y | 36500900_c1_2 | 3638 | 17741 | 561 | 187 | YKL194C | 463 | 5.2(10)-44 | Saccharomyces cerevisiae | [gn:mgm101:mgm9;j2181][gtcfc:2.8][keggfc:14.2][sgdtc:9.7.0][db:gtc-saccharomyces cerevisiae][ui:ykl194c][pn:threonine-trna ligase, mitochondrial:threonyl-trna synthetase, mitochondrial precursor:threonine--trna ligase:thrrs][gn:mst1][gtcfc:2.8.5.3:10.6][ec:6.1.1.3][keggfc:5.3.10.1:10.2] |
| CONTIG5757 | 178936_f1_1 | 3639 | 17742 | 984 | 328 | YKL150W | 835 | 2.0(10)-83 | Saccharomyces cerevisiae | [sgdfc:5.4.0:9.7.0][db:gtc-sacc][ui:ykl150w][pn:cytochrome-b5 reductase:nadh-cytochrome b5 reductase precursor:p34/p32][gn:mcr1:ykl605][gtcfc:2.8:7.1][ec:1.6.2.2][keggfc:4.4][sgdfc:2.5.0:9.7.0][db:gtc-saccharomyces cerevisiae] |
| CONTIG1385 | 24870933_c1_5 | 3640 | 17743 | 612 | 204 | YKL142W | 202 | 2.2(10)-16 | Saccharomyces cerevisiae | [ui:ykl142w][pn:ribosomal protein, mitochondrial:mitochondrial 40s ribosomal protein mrp8][gn:mrp8:ykl3][gtcfc:2.8:10.4][keggfc:14.2][sgdfc:5.1.0:9.7.0][db:gtc-saccharomyces cerevisiae] |
| CONTIG5410 | 12615636_c3_18 | 3641 | 17744 | 1800 | 600 | YKL134C | 1115 | 4.2(10)-113 | Saccharomyces cerevisiae | [ui:ykl134c][pn:mitochondrial intermediate peptidase:hypothetical zinc metalloproteinase ykl134c][gtcfc:107:2.8][ec:3.4.24.-][keggfc:14.1][sgdfc:6.3.0:9.7.0][db:gtc-saccharomyces cerevisiae] |
| CONTIG5780 | 5094437_f2_21 | 3642 | 17745 | 519 | 173 | YKL134C | 237 | 6.2(10)-19 | Saccharomyces cerevisiae | [ui:ykl134c][pn:mitochondrial intermediate peptidase:hypothetical zinc metalloproteinase ykl134c][gtcfc:10.7:2.8][ec:3.4.24.-][keggfc:14.1][sgdfc:6.3.0:9.7.0][dh:gtc-saccharomyces cerevisiae] |
| CONTIG5465 | 15017827_f3_4 | 3643 | 17746 | 1053 | 351 | YKL120W | 909 | 2.7(10)-91 | Saccharomyces cerevisiae | [ui:ykl120w][pn:similarity to mitochondrial uncoupling proteins:mcf:mitochondrial carrier protein, pmt][gn:pmt1:ykl522][gtcfc:2.8][keggfc:14.2][sgdfc:9.7.0][db:gtc-saccharomyces cerevisiae] |
| CONTIG3351 | 1188257_f3_3 | 3644 | 17747 | 795 | 265 | YKL087C | 501 | 4.7(10)-48 | Saccharomyces cerevisiae | [ui:ykl087c][pn:holocytochrome-c1 synthase:cytochrome c1 heme lyase:cc1h1][gn:cyt2][gtcfc:2.8.9.12:10.7][ec:4.4.1.-] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3460 | 14625285_f3_3 | 3645 | 17748 | 1116 | 372 | YKR066C | 728 | 4.2(10)-72 | Saccharomyces cerevisiae | [keggfc:14.1] [sgdfc:1.7.2:6.3.0:9.7.0] [db:gtc-saccharomyces cerevisiae] [ui:ykr066c] [pn:cytochrome-c peroxidase precursor:cytochrome c peroxidase precursor:ccp] [gn:ccp1:ccp:cpo] [gtcfc:2.8.12.12] [ec:1.11.1.5] [keggfc:14.1] [sgdfc:9.7.0:11.3.0] [db:gtc-saccharomyces cerevisiae] |
| CONTIG5793 | 35189387_c2_20 | 3646 | 17749 | 936 | 312 | YKR066C | 550 | 3.1(10)-53 | Saccharomyces cerevisiae | [ui:ykr066c] [pn:cytochrome-c peroxidase precursor:cytochrome c peroxidase precursor:ccp] [gn:ccp1:ccp:cpo] [gtcfc:2.8.12.12] [ec:1.11.1.5] [keggfc:14.1] [sgdfc:9.7.0:11.3.0] [db:gtc-saccharomyces cerevisiae] |
| CONTIG859 | 26257692_c3_1 | 3647 | 17750 | 921 | 307 | YLR067C | 127 | 6.0(10)-5 | Saccharomyces cerevisiae | [ui:ylr067c] [pn:required for stability and translation of cox1 mrna:pet309 protein precursor] [gn:pet309:12189] [gtcfc:2.8.10.2:10.7] [keggfc:14.2] [sgdfc:4.12.0:5.3.0:9.7.0] [db:gtc-saccharomyces cerevisiae] |
| CONTIG2753 | 167508_c3_5 | 3648 | 17751 | 804 | 268 | YLR069C | 768 | 2.5(10)-76 | Saccharomyces cerevisiae | [ui:ylr069c] [pn:translation elongation factor g, mitochondrial:elongation factor g, mitochondrial 1 precursor:mef-g-1] [gn:mef1] [gtcfc:2.8:0.7] [keggfc:14.2] [sgdfc:5.2.0:9.7.0] [db:gtc-saccharomyces cerevisiae] |
| b3x14382.x | 34428141_c2_2 | 3649 | 17752 | 630 | 210 | YLR069C | 765 | 5.0(10)-76 | Saccharomyces cerevisiae | [ui:ylr069c] [pn:translation elongation factor g, mitochondrial:elongation factor g, mitochondrial 1 precursor:mef-g-1] [gn:mef1] [gtcfc:2.8:0.7] [keggfc:14.2] [sgdfc:5.2.0:9.7.0] [db:gtc-saccharomyces cerevisiae] |
| CONTIG4884 | 23945307_f3_2 | 3650 | 17753 | 2271 | 757 | YLR139C | 136 | 1.3(10)-5 | Saccharomyces cerevisiae | [ui:ylr139c] [pn:suppresses lethality of ssm4 deletion:sls1 protein] [gn:sls1:13162] [gtcfc:2.8:10.2] [keggfc:14.2] [sgdfc:4.12.0:9.7.0] [db:gtc-saccharomyces cerevisiae] |
| CONTIG2451 | 24298302_f1_1 | 3651 | 17754 | 1446 | 482 | YLR142W | 1009 | 7.0(10)-102 | Saccharomyces cerevisiae | [ui:ylr42w] [pn:proline oxidase:proline oxidase precursor] [gn:put1:13170:19606] [gtcfc:2.8:5.3:6.6] [ec:1.5.3.-] [keggfc:14.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4430 | 9853302_f1_1 | 3652 | 17755 | 1449 | 483 | YLR163C | 1248 | 3.3(10)-127 | Saccharomyces cerevisiae | [sgdfc:1.1.1.1.4:9.7.0] [db:gtc-saccharomyces cerevisiae] [ui:ylr163c] [pn:mitochondrial processing peptidase:mitochondrial processing peptidase beta subunit precursor:beta-mpp:pep] [gn:mas1:mif1:19632] [gtcfc:2.8:10.7] [ec:3.4.24.64] [keggfc:14.1] [sgdfc:6.3.0:9.7.0] [db:gtc-saccharomyces c |
| CONTIG692 | 4898961_c3_3 | 3653 | 17756 | 468 | 156 | YLR168C | 368 | 6.0(10)-34 | Saccharomyces cerevisiae | [ui:ylr168c] [pn:probably involved in intramitochondrial protein sorting:msf1 protein] [gtcfc:2.8:10.7:11.1] [keggfc:14.2] [sgdfc:6.2.0:9.7.0] [db:gtc-saccharomyces cerevisiae] |
| CONTIG2059 | 42707_c3_5 | 3654 | 17757 | 240 | 80 | YLR203C | 119 | 1.2(10)-6 | Saccharomyces cerevisiae | [ui:ylr203c] [pn:possibly involved in translational activation of cox1 and cob mrna:mss51 protein] [gn:mss51:l8167] [gtcfc:2.8:10.7] [keggfc:14.2] [sgdfc:5.3.0:9.7.0] [db:gtc-saccharomyces cerevisiae] |
| CONTIG3403 | 23867908_c1_7 | 3655 | 17758 | 300 | 100 | YLR203C | 124 | 3.5(10)-7 | Saccharomyces cerevisiae | [ui:ylr203c] [pn:possibly involved in translational activation of cox1 and cob mrna:mss51 protein] [gn:mss51:l81671] [gtcfc:2.8:10.7] [keggfc:14.2] [sgdfc:5.3.0:9.7.0] [db:gtc-saccharomyces cerevisiae] |
| CONTIG3403 | 19000_c1_6 | 3656 | 17759 | 672 | 224 | YLR203C | 620 | 1.2(10)-60 | Saccharomyces cerevisiae | [ui:ylr203c] [pn:possibly involved in translational activation of cox1 and cob mrna:mss51 protein] [gn:mss51:l8167] [gtcfc:2.8:10.7] [keggfc:14.2] [sgdfc:5.3.0:9.7.0] [db:gtc-saccharomyces cerevisiae] |
| b9x10g13.y | 4898505_c2_2 | 3657 | 17760 | 567 | 189 | YLR259C | 798 | 1.6(10)-79 | Saccharomyces cerevisiae | [ui:ylr259c] [pn:heat shock protein chaperone, mitochondrial:heat shock protein 60 precursor:stimulator factor i 66 kd component:p66:cpn60] [gn:hsp60:mif4:l8479] [gtcfc:12.7:2.8:10.5:7:13.2] [keggfc:14.2] |
| CONTIG3815 | 13711563_f2_2 | 3658 | 17761 | 834 | 278 | YLR355C | 920 | 1.8(10)-92 | Saccharomyces cerevisiae | [sgdfc:6.1.0:9.7.0:11.1. [ui:ylr355c] [pn:ketol-acid reducto-isomerase:ketol-acid reductoisomerase precursor:acetohydroxy-acid reductoisomerase:alpha-keto-beta-hydroxytacil reductoisomerase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5098 | 14144091_f2_3 | 3659 | 17762 | 210 | 70 | YLR355C | 271 | 1.1(10)-23 | Saccharomyces cerevisiae | [gn:ilvs:l9638] [gtcfc:2.8:5.7:6.6:9.5] [ec:1.1.1.86] [keggfc:5.7:9. [ui:ylr355c] [pn:ketol-acid reducto-isomerase:ketol-acid reductoisomerase precursor:acetohydroxy-acid reductoisomerase:alpha-keto-beta-hydroxylacil reductoisomerase] [gn:ilv5:l9638] [gtcfc:2.8:5.7:6.6:9.5] [ec:1.1.1.861][keggfc:5.7:9. |
| CONTIG131 | 33784438_c1_3 | 3660 | 17763 | 510 | 170 | YLR382C | 170 | 1.1(10)-11 | Saccharomyces cerevisiae | [ui:ylr382c] [pn:leucine--trna ligase precursor, mitochondrial:leucyl-trna synthetase, mitochondrial precursor:leucine--trna ligase:leurs [gn:nam2:msl1:l3502] [gtcfc:2.8:5.7:10.2:10.6] [ec:6.1.1.4] [keggfc:5.7:10.1:10.2] [sgdfc:4.9.0] |
| CONTIG43753 | 22459702_f3_6 | 3661 | 17764 | 372 | 124 | YLR382C | 236 | 1.0(10)-18 | Saccharomyces cerevisiae | [ui:ylr382c] [pn:leucine--trna ligase precursor, mitochondrial:leucyl-trna synthetase, mitochondrial precursor:leucine--trna ligase:leurs [gn:nam2:msl1:l3502] [gtcfc:2.8:5.7:10.2:10.6] [ec:6.1.1.4] [keggfc:5.7:10.1:10.2] [sgdfc:4.9.0] |
| CONTIG3253 | 16689694_c2_5 | 3662 | 17765 | 1515 | 505 | YLR382C | 1341 | 4.7(10)-137 | Saccharomyces cerevisiae | [ui:ylr382c] [pn:leucine--trna ligase precursor, mitochondrial:leucyl-trna synthetase, mitochondrial precursor:leucine--trna ligase:leurs [gn:nam2:msl1:l3502] [gtcfc:2.8:5.7:10.2:10.6] [ec:6.1.1.4] [keggfc:5.7:10.1:10.2] [sgdfc:4.9.0] |
| CONTIG4120 | 26195187_f3_5 | 3663 | 17766 | 621 | 207 | YLR393W | 324 | 2.7(10)-29 | Saccharomyces cerevisiae | [ui:ylr393w] [pn:f1f0 atpase complex assembly protein:protein] [gn:atp10] [gtcfc:2.8:12.16] [keggfc:14.2] [sgdfc:6.4.0:9.7.0] [db:gtc-saccharomyces cerevisiae] |
| CONTIG3359 | 1178567_f3_3 | 3664 | 17767 | 513 | 171 | YLR439W | 153 | 1.2(10)-10 | Saccharomyces cerevisiae | [ui:ylr439w] [pn:ribosomal protein, mitochondrial:mitochondrial 60s ribosomal protein 14 precursor:yml4] [gn:mpl4:l9753] [gtcfc:2.8:10.4] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3871 | 24814713_c1_8 | 3665 | 17768 | 675 | 225 | YML078W | 549 | 4.0(10)-53 | Saccharomyces cerevisiae | [sgdfc:5.1.0:9.7.0] [db:gtc-saccharomyces cerevisiae] [ui:yml078w] [pn:cyclophilin:peptidylprolyl isomerase, mitochondrial:peptidyl-prolyl cis-trans isomerase c precursor:ppiase:rotamase:cyclophilin cppi-iii] [gn:cpr3:cyp3] [gtcfc:2.8:10.5:10.7:12.7] [ec:5.2.1.8] [keggfc:14.1] |
| CONTIG5562 | 4334651_c3_13 | 3666 | 17769 | 846 | 282 | YML025C | 396 | 6.5(10)-37 | Saccharomyces cerevisiae | [sgdfc:6.[ui:yml025c] [pn:ribosomal protein, mitochondrial:putative 14p like ribosomal protein] [gtcfc:2.8:10.4] [keggfc:14.2] [sgdfc:5.1.0:9.7.0] [db:gtc-saccharomyces cerevisiae] |
| CONTIG5744 | 2400410_c2_22 | 3667 | 17770 | 645 | 215 | YML021C | 472 | 5.7(10)-45 | Saccharomyces cerevisiae | [ui:yml021c] [pn:uracil-dna glycosylase:uracil-dna glycosylase precursor] [gn:ung1] [gtcfc:2.8:10.1:10.2:10.8:14.1] [ec:3.2.2.-] [keggfc:14.1] [sgdfc:3.7.0:9.5.0:9.7.0] [db:gtc-saccharomyces cerevisiae] |
| CONTIG1523 | 24616002_c3_3 | 3668 | 17771 | 405 | 135 | YMR023C | 283 | 2.6(10)-24 | Saccharomyces cerevisiae | [ui:ymr023c] [pn:mitochondrial gtpase involved in expression of cox1:mitochondrial gtpase mss1 precursor] [gn:mss1:pet53:ym9711] gtcfc:2.8:10.2:10.7] [keggfc:14.2] [sgdfc:4.9.0:5.2.0:9.7.0] [db:gtc-saccharomyces cerevisiae] |
| CONTIG3233 | 5094182_f3_3 | 3669 | 17772 | 1227 | 409 | YMR023C | 700 | 4.0(10)-69 | Saccharomyces cerevisiae | [ui:ymr023c] [pn:mitochondrial gtpase involved in expression of cox1:mitochondrial gtpase mss1 precursor] [gn:mss1:pet53:ym9711] [gtcfc:2.8:10.2:10.7] [keggfc:14.2] [sgdfc:4.9.0:5.2.0:9.7.0] [db:gtc-saccharomyces cerevisiae] |
| CONTIG5743 | 29923130_f2_9 | 3670 | 17773 | 1266 | 422 | YMR024W | 449 | 1.6(10)-42 | Saccharomyces cerevisiae | [ui:ymr024w] [pn:ribosomal protein of the large subunit, mitochondrial:mitochondrial 60s ribosomal protein 13 precursor:yml3] [gn:mrpl3:ym9711] [gtcfc:2.8:10.4] [keggfc:14.2] [sgdfc:5.1.0:9.7.0] [db:gtc-saccharomyces cerevisiae] |
| CONTIG5040 | 4729557_c3_15 | 3671 | 17774 | 498 | 166 | YMR035W | 450 | 1.2(10)-42 | Saccharomyces | [ui:ymr035w] [pn:mitochondrial |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | inner membrane protease subunit:mitochondrial inner membrane protease subunit 2] [gn:imp2:ym9973] [gtcfc:2.810.11:10.7:11.1] [ec:3.4.99.-] [keggfc:14.1] [sgdfc:6.2.0:6.3.0:9.7.0:11.2.1] [db:gtc-saccharo |
| CONTIG5507 | 4725027_f3_6 | 3672 | 17775 | 774 | 258 | YMR038C | 420 | 1.8(10)-39 | Saccharomyces cerevisiae | [ui:ymr038c] [pn:regulation of lysine biosynthesis:homocitrate dehydratase] [gn:lys7:ym9532] [gtcfc:5.81.2:2.8] [ec:4.2.-.-] [keggfc:14.1] [sgdk:1.4.1:9.7.0] [db:gtc-saccharomyces cerevisiae] |
| CONTIG2077 | 26345250_f2_1 | 3673 | 17776 | 1155 | 385 | YMR089C | 1539 | 4.9(10)-158 | Saccharomyces cerevisiae | [ui:ymr089c] [pn:protease of the sec18/cdc48/pas1 family of atpases:aaa:mitochondrial respiratory chain complexes assembly protein real:tat-binding homolog 12] [gn:real:yta12:ym9582] [gtcfc:2.8:10.11:12.16] [ec:3.4.24.-] [keggfc:14.1] |
| CONTIG3564 | 29335008_f2_2 | 3674 | 17777 | 315 | 105 | YMR089C | 273 | 9.5(10)-23 | Saccharomyces cerevisiae | [ui:ymr089c] [pn:protease of the sect8/cdc48/past family of atpases:aaa:mitochondrial respiratory chain complexes assembly protein real:tat-binding homolog 12] [gtcfc:2.8:10.11:12.16] [ec:3.4.24.-] [keggfc:14.1] |
| CONTIG1243 | 900305_f3_2 | 3675 | 17778 | 555 | 185 | YMR150C | 538 | 5.7(10)-52 | Saccharomyces cerevisiae | [ui:ymr150c] [pn:protease, mitochondrial:mitochondrial inner membrane protease subunit 1] [gn:imp1:pet2858:ym9375] [gtcfc:2.8:10.11:11.1] [ec:3.4.99.-] [keggfc:14.1] [sgdfc:6.2.0:6.3.0:9.7.0] [db:gtc-saccharomyces cerevisiae] |
| CONTIG5578 | 21879093_f1_1 | 3676 | 17779 | 3006 | 1002 | YMR189W | 3211 | 0 | Saccharomyces cerevisiae | [ui:ymr189w] [pn:glycine decarboxylase subunit:glycine dehydrogenase:decarboxylating precursor:glycine decarboxylase:glycine cleavage system p- protein] [gn:gcv2:gsd2:ym9646] [gtcfc:2.8:5.3] [ec:1.4.4.2] [keggfc:5.3] [sgdfc:1.1.4:9.7. |
| CONTIG2692 | 36515911_c2_5 | 3677 | 17780 | 474 | 158 | YMR193W | 172 | 3.5(10)-13 | Saccharomyces | [ui:ymr193w] [pn:ribosomal |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | protein of the large subunit, mitochondrial:mitochondrial 60s ribosomat protein l24 precursor:yml24] [gn:mrpl24:ym9646] [gtcfc:2.8:10.4] [keggfc:14.2] [sgdfc:5.1.0:9.7.0] [db:gtc-saccharomyces cerevisiae] |
| CONTIG4790 | 24416057_f2_4 | 3678 | 17781 | 375 | 125 | YMR225C | 186 | 1.2(10)-14 | Saccharomyces cerevisiae | [ui:ymr225c] [pn:ribosomal protein ymr44, mitochondrial:mitochondrial 60s ribosomal protein l44:yml44] [gn:mrpl44:ymr44:ym9959] [gtcfc:2.8:10.4] [keggfc:14.2] [sgdfc:5.1.0:9.7.0] [db:gtc-saccharomyces cerevisiae] |
| CONTIG1699 | 33672643_f1_1 | 3679 | 17782 | 579 | 193 | YMR228W | 213 | 2.5(10)-17 | Saccharomyces cerevisiae | [ui:ymr228w] [pn:rna polymerase specificity factor, mitochondrial:mitochondrial replication protein mtf1:rf1023:mitochondrial specificity factor] [gn:mtf1:ym9959] [gtcfc:3.7.0:4.8.1:9.7.0] [db:gtc-sacc |
| CONTIG5740 | 79526_c1_13 | 3680 | 17783 | 912 | 304 | YMR244W | 761 | 1.3(10)-75 | Saccharomyces cerevisiae | [ui:ymr244] [pn:similarity to nca3 and sun4 protein] [gtcfc:2.8] [keggfc:14.2] [sgdfc:2.5.0:9.7.0] [db:gtc-saccharomyces cerevisiae] |
| CONTIG3274 | 35947500_f3_2 | 3681 | 17784 | 204 | 68 | YMR286W | 96 | 4.0(10)-5 | Saccharomyces cerevisiae | [ui:ymr286w] [pn:ribosomal protein of the large subunit, mitochondrial:mitochondrial 60s ribosomal protein l33:yml33] [gn:mrpl33:ym8021] [gtcfc:2.8:10.4] [keggfc:14.2] [sgdfc:5.1.0:9.7.0] [db:gtc-saccharomyces cerevisiae] |
| CONTIG5730 | 12772760_f3_8 | 3682 | 17785 | 1911 | 637 | YMR287C | 132 | 9.1(10)-9 | Saccharomyces cerevisiae | [ui:ymr287c] [pn:3"-5" exonuclease for rna 3" ss-tail, mitochondrial:mitochondrial biogenesis msu1 protein] [gn:msu1:ym8021] [gtcfc:2.8:4.4:10.10] [keggfc:14.2] [sgdfc:1.3.6:9.7.0] [db:gtc-saccharomyces cerevisiae] |
| CONTIG5730 | 4017186_f3_9 | 3683 | 17786 | 1575 | 525 | YMR287C | 176 | 1.0(10)-20 | Saccharomyces cerevisiae | [ui:ymr287c] [pn:3"-5" exonuclease for rna 3" ss-tail, mitochondrial:mitochondrial |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | biogenesis msu1 protein] [gn:msu1:ym8021] [gtcfc:2.8.4:4:10.10] [keggfc:14.2] [sgdfc:1.3.6:9.7.0] [db:gtc-saccharomyces cerevisiae] |
| CONTIG5419 | 20078556_f2_3 | 3684 | 17787 | 2124 | 708 | YMR302C | 557 | 2.7(10)-117 | Saccharomyces cerevisiae | [ui:ym302c][pn:involved in early maturation of pre-rna:rna12 protein] [gn:rna12:prp12:ym9952] [gtcfc:2.8:10.3] [keggfc:14.2] [sgdfc:4.3:0:9.7.0] [db:gtc-saccharomyces cerevisiae] |
| CONTIG5419 | 2236262_f3_8 | 3685 | 17788 | 459 | 153 | YMR302C | 113 | 1.3(10)-5 | Saccharomyces cerevisiae | [ui:ym302c][pn:involved to early maturation of pre-rna:rna12 protein] [gn:rna12:prp12:ym9952] [gtcfc:2.8:10.3] [keggfc:14.2] [sgdfc:4.3:0:9.7.0] [db:gtc-saccharomyces cerevisiae] |
| CONTIG557 | 22273311_c3_2 | 3686 | 17789 | 783 | 261 | YNL315C | 448 | 2.0(10)-42 | Saccharomyces cerevisiae | [ui:ynl315c] [pn:ff10-atpase complex assembly protein:atp11 protein precursor] [gn:atp11:n0357] [gtcfc:2.8:12.16] [keggfc:14.2] [sgdfc:6.4.0:9.7.0] [db:gtc-saccharomyces cerevisiae] |
| CONTIG5405 | 13945135_c3_9 | 3687 | 17790 | 870 | 290 | YNL252C | 527 | 8.5(10)-51 | Saccharomyces cerevisiae | [ui:ynl252c] [pn:ribosomal protein yml30, mitochondrial:mitochondrial 60s ribosomal protein l30 precursor:yml30] [gn:mrpl30:n08064] [gtcfc:2.8:10.4] [keggfc:14.2] [sgdfc:5.1.0:9.7.0] [db:gtc-saccharomyces cerevisiae] |
| CONTIG2737 | 14531262_c2_4 | 3688 | 17791 | 1641 | 547 | YNL237W | 758 | 2.2(10)-90 | Saccharomyces cerevisiae | [ui:ynl237w] [pn:weak similarity to mitochondrial electron transport proteins:ytp1 protein] [gn:ytp1:n1129] [gtcfc:2.8:12.6] [keggfc:14.2] [sgdfc:2.5.0:9.7.0] [db:gtc-saccharomyces cerevisiae] |
| CONTIG1625 | 33362500_f2_1 | 3689 | 17792 | 972 | 324 | YNL169C | 574 | 8.9(10)-56 | Saccharomyces cerevisiae | [ui:ynl169c] [pn:phosphatidylserine decarboxylase 1:phosphatidylserine decarboxylase proenzyme 1 precursor] [gn:psd1:n1692] [gtcfc:2.8.3:4.5.3:8.1:8.2:10.2] [ec:4.1.1.65] [keggfc:5.3:8.1] [sgdfc:1.6.1.1.6.4:9.7.0] [db:gtc-saccharomyces cerevisiae] |
| CONTIG3682 | 12929655_f3_4 | 3690 | 17793 | 1392 | 464 | YNL137C | 607 | 2.7(10)-59 | Saccharomyces cerevisiae | [ui:ynl137c] [pn:ribosomal protein, mitochondrial:nam9 protein precursor] [gn:nam9:n1211:n1840] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4489 | 5272257_f2_6 | 3691 | 17794 | 309 | 103 | YNL066W | 293 | 5.2(10)-26 | Saccharomyces cerevisiae | [gtcfc:2.8:10.4] [keggfc:14.2] [sgdfc:5.10:9.7.0] [db-gtc-saccharomyces cerevisiae] [ui:ynl066w] [pn:involved in the aging process:proteasome component sun4] [gn:sun4:n2411:ynl2411w] [gtcfc:2.8:12.13] [keggfc:14.2] [sgdfc:9.7.0:11.5.0] [db-gtc-saccharomyces cerevisiae] |
| CONTIG5792 | 6665902_c3_40 | 3692 | 17795 | 1050 | 350 | YNR041C | 884 | 1.3(10)-88 | Saccharomyces cerevisiae | [ui:ynr041c] [pn:para-hydroxybenzoate--polyprenyltransferase:para-hydroxybenzoate--polyprenyltransferase precursor:phb:polyprenyltransferase] [gn:coq2:n3419] [gtcfc:2.8:7.1:9.10:9.11:9.12:11.3] [ec:2.5.1.-] [keggfc:7.2:9.13] [sgdfc:1. |
| CONTIG5748 | 1250135_c3_23 | 3693 | 17796 | 1494 | 498 | YOL140W | 1053 | 1.6(10)-106 | Saccharomyces cerevisiae | [ui:yol140w] [pn:acetylornithine aminotransferase:acetylornithine aminotransferase precursor:acoat] [gn:arg8] [gtcfc:2.8:5.16:6.6] [ec:2.6.1.11] [keggfc:5.16] [sgdfc:1.1:9.7.0] [dbgtc-saccharomyces cerevisiae] |
| CONTIG4945 | 38887_c3_12 | 3694 | 17797 | 1002 | 334 | YOL096C | 727 | 5.5(10)-72 | Saccharomyces cerevisiae | [ui:yol096c] [pn:3,4-dihydroxy-5-hexaprenylbenzoate methyltransferase:hexaprenyl-dihydroxybenzoate methyltransferase precursor:dihydroxyhexaprenylbenzoate methyltransferase:3,4-dihydroxy-5-hexaprenylbenzoate methyltransferase:dhhb meth |
| CONTIG5635 | 34378252_c1_14 | 3695 | 17798 | 1626 | 542 | YOL033W | 1090 | 7.7(10)-118 | Saccharomyces cerevisiae | [ui:yol033w] [pn:glutamyl-tRNA synthetase, mitochondrial:glutamate--tRNA ligase:glurs] [gn:mse1] [gtcfc:2.8:5:1:9.10:10.6] [ec:6.1.1.17] [keggfc:5.1:9.10:10.1:10.2] [sgdfc:5.4:0:9.7.0] [dbgtc-saccharomyces cerevisiae] |
| CONTIG5529 | 1458318_f1_1 | 3696 | 17799 | 429 | 143 | YOL023W | 398 | 1.6(10)-36 | Saccharomyces cerevisiae | [ui:yol023w] [pn:translation initiation factor 2, mitochondrial:initiation factor if-2, mitochondrial precursor:if-2mt] [gn:ifm1] [gtcfc:2.8:10.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5529 | 21682937_f3_6 | 3697 | 17800 | 1449 | 483 | YOL023W | 931 | 1.3(10)-93 | Saccharomyces cerevisiae | [keggfc:14.2] [sgdfc:5.2.0:9.7.0] [db:gtc-saccharomyces cerevisiae] [ui:yol023w] [pn:translation initiation factor 2, mitochondrial:initiation factor if-2, mitochondrial precursor:if-2mt] [gn:ifm1] [gtcfc:2.8:10.7] [kdeggfc:14.2] [sgdfc:5.2.0:9.7.0] [db:gtc-saccharomyces cerevisiae] |
| CONTIG5796 | 25397577_f1_8 | 3698 | 17801 | 1287 | 429 | YOL009C | 300 | 4.7(10)-44 | Saccharomyces cerevisiae | [ui:yol009c] [pn:involved in mitochondrial inheritance] [gn:mdm12] [gtcfc:2.8] [keggfc:14.2] [sgdfc:9.7.0] [db:gtc-saccharomyces cerevisiae] |
| CONTIG623 | 25506942_f1_1 | 3699 | 17802 | 756 | 252 | YOR017W | 177 | 1.8(10)-12 | Saccharomyces cerevisiae | [ui:yor017w] [pn:component of mitochondrial translation system:putative mitochondrial translation system component pet127] [gn:pet127:or26] [gtcfc:2.8:10.7] [keggfc:14.2] [sgdfc:5.3.0:9.7.0] [db:gtc-saccharomyces cerevisiae] |
| b9x11t72.x | 21954437_c3_2 | 3700 | 17803 | 783 | 261 | YOR017W | 208 | 8.4(10)-16 | Saccharomyces cerevisiae | [ui:yor017w] [pn:component of mitochondrial translation system:putative mitochondrial translation system component pet127] [gn:pet127:or26] [gtcfc:2.8:10.7] [keggfc:14.2] [sgdfc:5.3.0:9.7.0] [db:gtc-saccharomyces cerevisiae] |
| CONTIG4846 | 2772530_c1_9 | 3701 | 17804 | 318 | 106 | YOR020C | 312 | 5.2(10)-28 | Saccharomyces cerevisiae | [ui:yor020c] [pn:chaperonin, mitochondrial:10 kd heat shock protein, mitochondrial:hsp10:10 kd chaperonin] [gn:hsp10:cpn10:or26] [gtcfc:12.7:2.8:10.7:11.1] [keggfc:14.2] [sgdfc:6.2.0:9.7.0] [db:gtc-saccharomyces cerevisiae] |
| CONTIG987 | 880017_f3_1 | 3702 | 17805 | 429 | 143 | YOR065W | 561 | 2.1(10)-54 | Saccharomyces cerevisiae | [ui:yor065w] [pn:cytochrome c1:cytochrome c1, heme protein precursor] [gn:ctc1:cyt1] [gtcfc:2.8] [sgdfc:2.5.0:9.7.0] [db:gtc-saccharomyces cerevisiae] |
| CONTIG2506 | 20007785_c1_4 | 3703 | 17806 | 549 | 183 | YOR150W | 510 | 5.4(10)-49 | Saccharomyces cerevisiae | [ui:yor150w] [pn:similarity to ribosomal protein 113] [gtcfc:2.8:10.4] [keggfc:14.2] [sgdfc:5.1.0:9.7.0] [db:gtc-saccharomyces cerevisiae] |
| CONTIG5467 | 3023443_c2_17 | 3704 | 17807 | 693 | 231 | YOR158W | 218 | 4.7(10)-18 | Saccharomyces cerevisiae | [ui:yor158w] [pn:ribosomal |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5788 | 29462502_f3_10 | 3705 | 17808 | 1206 | 402 | YOR176W | 1254 | 7.7(10)-128 | Saccharomyces cerevisiae | protein, mitochondrial:mitochondrial 40s ribosomal protein precursor] [gn:pet123] [gtcfc:2.8:10.4] [keggfc:14.2] [sgdfc:5.10:9.7.0] [db:gtc-saccharomyces cerevisiae] [ui:yor176w] [pn:ferrochelatase precursor:protoheme ferrolyase:heme synthetase] [gn:hem15] [gtcfc:2.8,9.10:9.11.12.6] [ec:4.99.1.1] [keggfc:9.10] [sgdfc:1.7.1:1.8.1:9.7.0] [db:gtc-saccharomyces cerevisiae] |
| CONTIG4202 | 26618966_f2_2 | 3706 | 17809 | 663 | 221 | YOR187W | 664 | 2.6(10)-65 | Saccharomyces cerevisiae | [ui:yor187w] [pn:translation elongation factor tu, mitochondrial:elongation factor tu, mitochondrial precursor] [gn:tuf1:tufm] [gtcfc:2.8:10.7] [keggfc:14.2] [sgdfc:5.2.0:9.7.0] [db:gtc-saccharomyces cerevisiae] |
| CONTIG2136 | 35199025_c2_2 | 3707 | 17810 | 480 | 160 | YOR196C | 483 | 3.8(10)-46 | Saccharomyces cerevisiae | [ui:yor196c] [pn:lipoic acid synthase:lipoic acid synthetase precursor:lip-syn] [gn:lip5] [gtcfc:2.8,9.10:9.11] [keggfc:14.2] [sgdfc:1.7.1:9.7.0] [db:gtc-saccharomyces cerevisiae] |
| CONTIG2598 | 32032812_c3_2 | 3708 | 17811 | 1275 | 425 | YOR201C | 297 | 1.1(10)-40 | Saccharomyces cerevisiae | [ui:yor201c] [pn:rrna:guanosine-2''-o-methyltransferase:ribose methyltransferase:mitochondrial large ribosomal rna ribose methylase] [gn:rpet56] [gtcfc:3.7.5.11.5.14:9.12:10.3] [ec:2.1.1.-] [keggfc:3.7.5.11.5.14:9.13] [sgdfc:4.2.0: |
| CONTIG1196 | 1304582_f1_1 | 3709 | 17812 | 1065 | 355 | YOR211C | 705 | 1.2(10)-69 | Saccharomyces cerevisiae | [ui:yor211c] [pn:dynamin-like protein:mgm1 protein precursor] [gn:mgm1:yor50-1] [gtcfc:2.8] [keggfc:14.2] [sgdfc:9.7.0] [db:gtc-saccharomyces cerevisiae] |
| CONTIG3428 | 31542562_f3_2 | 3710 | 17813 | 1026 | 342 | YOR211C | 332 | 1.2(10)-44 | Saccharomyces cerevisiae | [ui:yor211c] [pn:dynamin-like protein:mgm1 protein precursor] [gn:mgm1:yor50-1] [gtcfc:2.8] [keggfc:4.2] [sgdfc:9.7.0] [db:gtc-saccharomyces cerevisiae] |
| CONTIG4453 | 30211575_f3_2 | 3711 | 17814 | 372 | 124 | YOR211C | 280 | 2.0(10)-23 | Saccharomyces cerevisiae | [ui:yor211c] [pn:dynamin-like protein:mgm1 protein precursor] [gn:mgm1:yor50-1] [gtcfc:2.8] [keggfc:14.2] [sgdfc:9.7.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2021 | 19743805_f3_1 | 3712 | 17815 | 1161 | 387 | YOR274W | 692 | 2.7(10)-68 | *Saccharomyces cerevisiae* | *sacharomyces cerevisiae* [ui:yor274w] [pn:isopentenyl-diphosphate:trna isopentenyltransferase:ipp transferase:ippt] [gn:mod5] [gtcfc:2.8:10.1:10.2:10.6:14.1] [ec:2.5.1.8] [keggfc:14.1] [sgdfc:4.6.0:9.5.0:9.7.0] |
| CONTIG3071 | 4381436_f3_3 | 3713 | 17816 | 963 | 321 | YOR330C | 426 | 9.0(10)-39 | *Saccharomyces cerevisiae* | [db:gtc-*saccharomyces cerevisiae*] [ui:yor330c] [pn:dna-directed dna polymerase gamma catalytic subunit, mitochondrial:dna polymerase gamma:mitochondrial dna polymerase catalytic subunit] [gn:mip1] [gtcfc:2.8:4.1:4.2:10.8] [ec:2.7.7.7] [keggfc:4.1:4.2] [sgdfc:3.6.0:9.7] |
| CONTIG5060 | 21963277_c3_7 | 3714 | 17817 | 2232 | 744 | YOR330C | 1455 | 3.8(10)-149 | *Saccharomyces cerevisiae* | [ui:yor330c] [pn:dna-directed dna polymerase gamma catalytic subunit, mitochondrial:dna polymerase gamma:mitochondrial dna polymerase catalytic subunit] [gn:mip1] [gtcfc:2.8:4.1:4.2:10.8] [ec:2.7.7.7] [keggfc:4.1:4.2] [sgdfc:3.6.0:9.7] |
| CONTIG4036 | 34251377_c1_5 | 3715 | 17818 | 1155 | 385 | YOR334W | 780 | 1.3(10)-77 | *Saccharomyces cerevisiae* | [ui:yor334w] [pn:rna splicing protein and member of the mitochondrial carrier family:mcf:mitochondrial rna splicing protein mrs2 precursor] [gn:mrs2;yor333c] [gtcfc:2.8:10.2] [keggfc:14.2] [sgdfc:4.9.0:9.7.0] [db:gtc-saccharomyces cer |
| CONTIG4238 | 14648436_c3_8 | 3716 | 17819 | 1482 | 494 | YOR355W | 329 | 1.8(10)-29 | *Saccharomyces cerevisiae* | [ui:yor355w] [pn:nam9-1 suppressor:protein] [gn:gds1] [gtcfc:2.8] [keggfc:14.2] [sgdfc:9.7.0] [db:gtc-*saccharomyces cerevisiae*] |
| CONTIG2959 | 31258541_f2_2 | 3717 | 17820 | 183 | 61 | YPL215W | 92 | 0.00067 | *Saccharomyces cerevisiae* | [ui:ypl215w] [pn:required for assembly of cytochrome bc1 complex:protein precursor] [gn:cbp3] [gtcfc:2.8:12.16] [keggfc:14.2] [sgdfc:6.4.0:9.7.0] [db:gtc-*saccharomyces cerevisiae*] |
| CONTIG3142 | 781256_f2_2 | 3718 | 17821 | 1008 | 336 | YPL215W | 736 | 6.0(10)-73 | *Saccharomyces cerevisiae* | [ui:ypl215w] [pn:required for assembly of cytochrome bc1 complex:protein precursor] [gn:cbp3] [gtcfc:2.8:12.16] [keggfc:14.2] [sgdfc:6.4.0:9.7.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2108 | 10663437_f1_1 | 3719 | 17822 | 639 | 213 | YPL173W | 161 | 1.2(10)-11 | Saccharomyces cerevisiae | [db:gtc-saccharomyces cerevisiae] [ui:ypl173w] [pn:ribosomal protein yml40, mitochondrial:mitochondrial 60s ribosomal protein 140:yml40] [gn:mrpl40] [gtcfc:2.8.10.4] [keggfc:14.2] [sgdfc:5.1.0.9.7.0] |
| CONTIG5191 | 15097650_c3_11 | 3720 | 17823 | 336 | 112 | YPL172C | 199 | 2.7(10)-15 | Saccharomyces cerevisiae | [db:gtc-saccharomyces cerevisiae] [ui:ypl172c] [pn:farnesyl transferase:cytochrome c oxidase assembly protein precursor] [gn:cox10] [gtcfc:2.8.3.1:9.10:9.11:12.16] [keggfc: 14.2] [sgdfc:1.6.3:1.7.1:6.4.0:9.7.0] |
| CONTIG5559 | 33773507_f3_13 | 3721 | 17824 | 1167 | 389 | YPL172C | 899 | 3.2(10)-90 | Saccharomyces cerevisiae | [db:gtc-saccharomyces cerevisiae] [ui:ypl172c] [pn:farnesyl transferase:cytochrome c oxidase assembly protein precursor] [gn:cox 10] [gtcfc:2.8.3.1:9.10:9.11:12.16] [keggfc: 14.2] [sgdfc:1.6.3:1.7.1:6.4.0:9.7.0] |
| CONTIG4714 | 33400257_f2_2 | 3722 | 17825 | 825 | 275 | YPL132W | 764 | 6.5(10)-76 | Saccharomyces cerevisiae | [db:gtc-saccharomyces cerevisiae] [ui:ypl132w] [pn:cytochrome-c oxidase assembly protein:cytochrome c oxidase assembly protein cox11] [gn:cox11:lpi13w] [gtcfc:2.8.9.10:9.11:12.16] [keggfc:14.2] [sgdfc:1.7.1:6.4.0:9.7.0] |
| CONTIG4972 | 22867143_c1_9 | 3723 | 17826 | 1683 | 561 | YPL104W | 678 | 8.5(10)-67 | Saccharomyces cerevisiae | [db:gtc-saccharomyces cerevisiae] [ui:ypl104w] [pn:aspartate--trna ligase, mitochondrial:aspartyl-trna synthetase, mitochondrial:aspartate--trna ligase:asprs] [gn:msd1:lpg5w] [gtcfc:2.8.5.2:10.6] [ec:6.1.1.12] [keggfc:5.2:10.1:10.2] |
| CONTIG4559 | 34171950_c2_5 | 3724 | 17827 | 255 | 85 | YPL097W | 100 | 0.00016 | Saccharomyces cerevisiae | [db:gtc-saccha [ui:ypl097w] [pn:tyrosyl-trna synthetase:tyrosyl-trna synthetase, mitochondrial precursor:tyrosine--trna ligase:tyrrs] [gn:mys1:lpg11w] [gtcfc:2.8:5.15:10.6] [ec:6.1.1.1] [keggfc:5.4.0:9.7.0] [deggfc:5.15:10.1:10.2] [sgdfc:5.4.0:9.7.0] [db:gtc-saccharomyc |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG578 | 976587_c1_3 | 3725 | 17828 | 537 | 179 | YPL097W | 249 | 1.1(10)-20 | Saccharomyces cerevisiae | [ui:ypl097w] [pn:tyrosyl-trna synthetase:tyrosyl-trna synthetase, mitochondrial precursor:tyrosine--trna ligase:tyrrs] [gn:mys1:lpg11w] [gtcfc:2.8.5.15:10.6] [ec:6.1.1.1] [keggfc:5.15:10:1:10.2] [sgdfc:5.4.0:9.7.0] [db:gt-saccharomyc |
| CONTIG5813 | 3912836_c2_44 | 3726 | 17829 | 1164 | 388 | YPL040C | 591 | 8.4(10)-57 | Saccharomyces cerevisiae | [ui:ypl040c] [pn:isoleusine--trna ligase, mitochondrial:isoleucyl-trna synthetase, mitochondrial:isoleucine--trna ligase:ilers] [gn:ism1:p7102] [gtcfc:2.8.5.7:10.6] [ec:6.1.1.5] [keggfc:5.7:10.1:10.2] [sgdfc:5.4.0:9.7.0] [db:gtc-sacch |
| CONTIG5813 | 258387_c1_33 | 3727 | 17830 | 1821 | 607 | YPL040C | 1204 | 1.5(10)-122 | Saccharomyces cerevisiae | [ui:ypl040c] [pn:isoleusine--trna ligase, mitochondrial:isoleucyl-trna synthetase, mitochondrial:isoleucine--trna ligase:ilers] [gn:ism1:p7102] [gtcfc:2.8.5.7:10.6] [ec:6.1.1.5] [keggfc:5.7:10.1:10.2] [sgdfc:5.4.0:9.7.0] [db:gtc-sacch |
| CONTIG5153 | 1181552_f2_3 | 3728 | 17831 | 2166 | 722 | YPL029W | 1113 | 6.7(10)-113 | Saccharomyces cerevisiae | [ui:ypl029w] [pn:atp-dependent rna helicase, mitochondrial:mitochondrial atp-dependent rna helicase suv3 precursor] [gn:suv3:lpb2w] [gtcfc:2.8.4.4:10.10.2:10.3:10.7] [keggfc:14.2] [sgdfc:1.3.6.4.2.0:4.9.0:5.3.0:9.7.0] [db:gtc-sacch] |
| CONTIG3664 | 1550_c2_8 | 3729 | 17832 | 630 | 210 | YPL013C | 279 | 1.6(10)-24 | Saccharomyces cerevisiae | [ui:ypl013c] [pn:ribosomal protein s16, mitochondrial] [gtcfc:2.8:10.4] [keggfc:14.2] [sgdfc:5.1.0:9.7.0] [db:gtc-saccharomyces cerevisiae] |
| CONTIG5198 | 31913311_c1_8 | 3730 | 17833 | 1302 | 434 | YPR024W | 1043 | 1.8(10)-105 | Saccharomyces cerevisiae | [ui:ypr024w] [pn:protease of the sec18/cdc48/pas1 family of atpases:aaa:yme1 protein:tat-binding homolog 11:osd1 protein] [gn:yme1:yta11:osd1:yp9367] [gtcfc:2.8:10.11:12.16] [ec:3.4.24.-] [keggfc:14.1] |
| CONTIG816 | 33492754_c2_5 | 3731 | 17834 | 909 | 303 | YPR024W | 978 | 1.3(10)-98 | Saccharomyces cerevisiae | [sgdfc:6.4.0:6.5.3:9.7.0] [db:gt [ui:ypr024w] [pn:protease of the sec18/cdc48/pas1 family of atpases:aaa:yme1 protein:tat- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5155 | 5353307_f1_1 | 3732 | 17835 | 606 | 202 | YPR037C | 351 | 3.7(10)-32 | Saccharomyces cerevisiae | binding homolog 11:0sd1 protein] [gn:yme1:yta11:osd1:yp9367] [gtcfc:2.8.10.11:12.16] [ec:3.4.24.-] [keggfc:14.1] [sgdfc:6.4.0:6.5.3:9.7.0] [db:gt [ui:ypr037c] [pn:similarity to erv1p and rat alr protein] [gtcfc:2.8] [keggfc:14.2] [sgdfc:9.7.0] [db:gtc-saccharomyces cerevisiae] |
| CONTIG4428 | 14100281_f3_4 | 3733 | 17836 | 357 | 119 | YPR047W | 167 | 8.9(10)-12 | Saccharomyces cerevisiae | [ui:ypr047w] [pn:phenylalanine--trna ligase alpha chain, mitochondrial] [gn:msf1] [gtcfc:2.8:5.15:15.10.6:10.7:11.1] [ec:6.1.1.20] [keggfc:5.15:10.1:10.2] [sgdfc:5.4.0:6.2.0:9.7.0] [db:gtc-saccharomyces cerevisiae] |
| CONTIG5336 | 26265627_c2_12 | 3734 | 17837 | 918 | 306 | YPR047W | 871 | 3.0(10)-87 | Saccharomyces cerevisiae | [ui:ypr047w] [pn:phenylalanine--trna ligase alpha chain, mitochondrial] [gn:msf1] [gtcfc:2.8:5.15:15.10.6:10.7:11.1] [ec:6.1.1.20] [keggfc:5.15:10.1:10.2] [sgdfc:5.4.0:6.2.0:9.7.0] [db:gtc-saccharomyces cerevisiae] |
| CONTIG2365 | 16431388_c3_5 | 3735 | 17838 | 528 | 176 | YPR155C | 119 | 2.0(10)-15 | Saccharomyces cerevisiae | [ui:ypr155c] [pn:control of mitochondrial synthesis of atp6p and atp8p] [gn:nca2] [gtcfc:2.8] [keggfc:14.2] [sgdfc:9.7.0] [db:gtc-saccharomyces cerevisiae] |
| CONTIG5107 | 156261_c3_10 | 3736 | 17839 | 1605 | 535 | YPR155C | 193 | 5.7(10)-12 | Saccharomyces cerevisiae | [ui:ypr155c] [pn:control of mitochondrial synthesis of atp6p and atp8p] [gn:nca2] [gtcfc:2.8] [keggfc:14.2] [sgdfc:9.7.0] [db:gtc-saccharomyces cerevisiae] |
| CONTIG5523 | 21914062_f1_3 | 3737 | 17840 | 387 | 129 | YPR166C | 292 | 6.7(10)-26 | Saccharomyces cerevisiae | [ui:ypr166c] [pn:ribosomal protein s14:mitochondrial 40s ribosomal protein mrp2] [gn:mrp2:p9325] [gtcfc:2.8:10.4] [keggfc:14.2] [sgdfc:5.1.0:9.7.0] [db:gtc-saccharomyces cerevisiae] |
| CONTIG4269 | 12288260_c1_3 | 3738 | 17841 | 1242 | 414 | YDL107W | 266 | 2.8(10)-38 | Saccharomyces cerevisiae | [ui:ypl107w] [pn:ser/thr protein kinase:mss2 protein] [gn:mss2:d2340] [gtcfc:2.8.12.13] [keggfc:14.2] [sgdfc:2.5.0:15.0.0] [db:gtc-saccharomyces cerevisiae] |
| CONTIG3724 | 1586_f3_2 | 3739 | 17842 | 1452 | 484 | YEL053C | 247 | 1.8(10)-18 | Saccharomyces cerevisiae | [ui:yel053c] [pn:glucose-repressible protein:glucose repressible protein] [gn:mak10] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4466 | 26345312_f3_4 | 3740 | 17843 | 579 | 193 | YEL053C | 94 | 0.05199 | Saccharomyces cerevisiae | [gtcfc:2.8] [keggfc:14.2] [sgdfc:2.5.0] [db:gtc-saccharomyces cerevisiae] [ui:yel053c] [pn:glucose-repressible protein:glucose repressible protein] [gn:mak10] [gtcfc:2.8] [keggfc:14.2] [sgdfc:2.5.0] [db:gtc-saccharomyces cerevisiae] |
| CONTIG4070 | 2075981 3_c3_8 | 3741 | 17844 | 528 | 176 | YGR062C | 133 | 1.8(10)-8 | Saccharomyces cerevisiae | [ui:ygr062c] [pn:required for activity of mitochondrial cytochrome oxidase:cytochrome c oxidase assembly protein cox18 precursor] [gn:cox18:g4532] [gtcfc:2.8] [keggfc:14.2] [sgdfc:2.5.0] [db:gtc-saccharomyces cerevisiae] |
| CONTIG5713 | 26199067_f3_8 | 3742 | 17845 | 525 | 175 | YGR062C | 187 | 1.7(10)-14 | Saccharomyces cerevisiae | [ui:ygr062c] [pn:required for activity of mitochondrial cytochrome oxidase:cytochrome c oxidase assembly protein cox18 precursor] [gn:cox18:g4532] [gtcfc:2.8] [keggfc:14.2] [sgdfc:2.5.0] [db:gtc-saccharomyces cerevisiae] |
| CONTIG4949 | 959687_f1_2 | 3743 | 17846 | 246 | 82 | YLL009C | 102 | 9.3(10)-6 | Saccharomyces cerevisiae | [ui:yll009c] [pn:interacts genetically with sco1 and sco2 in cytochrome oxidase assembly] [gn:cox17] [gtcfc:2.8.12.16:12.6] [keggfc:14.2] [sgdfc:1.8.1:2.5.0:6.4.0:9.2.0] [db:gtc-saccharomyces cerevisiae] |
| b1x17891.y | 6033442_f1_1 | 3744 | 17847 | 519 | 173 | YML125C | 454 | 4.5(10)-43 | Saccharomyces cerevisiae | [ui:yml125c] [pn:strong similarity to cytochrome-b5- and nitrate reductases] [gtcfc:2.8] [keggfc:14.2] [sgdfc:2.5.0] [db-gtc-saccharomyces cerevisiae] |
| CONTIG1595 | 2054517_c1_4 | 3745 | 17848 | 660 | 220 | YMR073C | 186 | 4.0(10)-19 | Saccharomyces cerevisiae | [ui:ymr073c] [pn:weak similarity to c-terminal part of cytochrome b5 and b2] [gtcfc:2.8] [keggfc:14.2] [sgdfc:2.5.0] [db:gtc-saccharomyces cerevisiae] |
| CONTIG2926 | 36444568_c2_5 | 3746 | 17849 | 852 | 284 | YMR145C | 759 | 2.2(10)-75 | Saccharomyces cerevisiae | [ui:ymr145c] [pn:strong similarity to nadh dehydrogenase:ubiquinone:hypothetical 62.8 kd protein in mds1-swp1 intergenic region] [gn:ym9375] [gtcfc:2.8.9.12] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5718 | 12271933_c2_20 | 3747 | 17850 | 582 | 194 | YMR165C | 333 | 2.2(10)-33 | *Saccharomyces cerevisiae* | [sgdfc:2.5.0] [dg:gtc-*saccharomyces cerevisiae*] [ui:ymr165c] [pn:involved in plasmid maintenance, respiration and cell proliferation:smp2 protein] [gn:smp2:ym8520] [gtcfc:2.8:12.8] [keggfc:14.2] [sgdfc:2.5.0:3.1.0] [db:gtc-*saccharomyces cerevisiae*] |
| CONTIG5321 | 4375675_c3_32 | 3748 | 17851 | 1203 | 401 | YNL118C | 662 | 9.0(10)-65 | *Saccharomyces cerevisiae* | [ui:ynl118c] [pn:suppressor protein of a yeast pet mutant:psu1 protein] [gn:psu1:n1917] [gtcfc:2.8] [keggfc:14.2] [sgdfc:2.5.0] [db-gtc-*saccharomyces cerevisiae*] |
| CONTIG5628 | 24266511_f1_4 | 3749 | 17852 | 1905 | 635 | YOR356W | 1905 | 8.0(10)-197 | *Saccharomyces cerevisiae* | [ui:yor356w] [pn:strong similarity to human electron transfer flavoprotein-ubiquinone oxidoreductase:strong similarity to human electron transfer flavoprotein-ubiquinone oxidoreductase] [gtcfc:2.8:9.12] [keggfc:14.2] [sgdfc:2.5.0] [d |
| b3x16938.y | 14536001_c3_5 | 3750 | 17853 | 336 | 112 | YPR004C | 147 | 6.7(10)-10 | *Saccharomyces cerevisiae* | [ui:ypr004c] [pn:strong similarity to electron transfer flavoproteins alpha chain] [gtcfc:2.8] [keggfc:14.2] [sgdfc:2.5.0] [db:gtc-*saccharomyces cerevisiae*] |
| CONTIG4428 | 13864407_f3_3 | 3751 | 17854 | 861 | 287 | YPR048W | 347 | 4.5(10)-31 | *Saccharomyces cerevisiae* | [ui:ypr048w] [pn:similarity to m. domestica nadph-ferrihemoprotein reductase and mammalian nitric-oxide synthases) [gtcfc:2.8] [keggfc:14.2] [sgdfc:2.5.0] [db-gtc-*saccharomyces cerevisiae*] |
| CONTIG4428 | 22034632_f1_2 | 3752 | 17855 | 1068 | 356 | YPR048W | 628 | 1.7(10)-61 | *Saccharomyces cerevisiae* | [ui:ypr048w] [pn:similarity to m. domestica nadph-ferrihemoprotein reductase and mammalian nitric-oxide synthases] [gtcfc:2.8] [keggfc:14.2] [sgdfc:2.5.0] [db:gtc-*saccharomyces cerevisiae*] |
| CONTIG4071 | 22540967_f3_5 | 3753 | 17856 | 2067 | 689 | YKL182W | 2276 | 3.8(10)-236 | *Saccharomyces cerevisiae* | [ui:ykl182w] [pn:fatty-acyl-coa synthase, beta chain:fatty acid synthase, subunit beta:contains 3-hydroxypalmitoyl-acyl-carrier-protein dehydratase enoyl-acyl-carrier-protein reductase (nadh) acyl-carrier-protein acetyltransferase acyl |
| CONTIG3036 | 3944006_f3_3 | 3754 | 17857 | 1185 | 395 | YKL182W | 1029 | 1.1(10)-102 | *Saccharomyces cerevisiae* | [ui:ykl182w] [pn:fatty-acyl-coa |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | synthase, beta chain:fatty acid synthase, subunit beta:contains 3-hydroxypalmitoyl-acyl-carrier-protein dehydratase enoyl-acyl-carrier-protein reductase (nadh) acyl-carrier-protein acetyltransferase acyl |
| CONTIG2315 | 23938329_c1_3 | 3755 | 17858 | 909 | 303 | YKL182W | 968 | 3.5(10)-96 | Saccharomyces cerevisiae | [ui:ykl182w] [pn:fatty-acyl-coa synthase, beta chain:fatty acid synthase, subunit beta:contains 3-hydroxypalmitoyl-acyl-carrier-protein dehydratase enoyl-acyl-carrier-protein reductase (nadh) acyl-carrier-protein acetyltransferase acyl |
| CONTIG2544 | 1959375_c2_5 | 3756 | 17859 | 1209 | 403 | YPL231W | 1211 | 2.1(10)-122 | Saccharomyces cerevisiae | [ui:ypl231w] [pn:fatty-acyl-coa synthase, alpha chain:fatty acid synthase, subunit alpha:contains:ec 1.1.1.100, and ec 2.3.1.41] [gn:fas2] [gtcfc:3.1:3.4:8.1:8.2:12.16] [ec:2.3.1.86] [kegggfc:3.1] [sgdfc:1.6:1.6.4:0.9.2.0] [db:gtc-sacc |
| CONTIG3183 | 269442_f1_1 | 3757 | 17860 | 1242 | 414 | YPL231W | 1286 | 1.3(10)-130 | Saccharomyces cerevisiae | [ui:ypl231w] [pn:fatty-acyl-coa synthase, alpha chain:fatty acid synthase, subunit alpha:contains:ec 1.1.1.100, and ec 2.3.1.41] [gn:fas2] [gtcfc:3.1:3.4:8.1:8.2:12.16] [ec:2.3.1.86] [kegggfc:3.1] [sgdfc:1.6:1.6.4:0.9.2.0] [db:gtc-sacc |
| CONTIG3183 | 30096938_f3_5 | 3758 | 17861 | 222 | 74 | YPL231W | 132 | 3.1(10)-7 | Saccharomyces cerevisiae | [ui:ypl231w] [pn:fatty-acyl-coa synthase, alpha chain: fatty acid synthase, subunit alpha:contains:ec 1.1.1.100, and ec 2.3.1.41] [gn:fas2] [gtcfc:3.1:3.4:8.1:8.2:12.16] [ec:2.3.1.86] [kegggfc:3.1] [sgdfc:1.6:1.6.4:0.9.2.0] [db:gtc-sacc |
| CONTIG3995 | 36366563_c1_8 | 3759 | 17862 | 1131 | 377 | YPL231W | 1256 | 2.6(10)-127 | Saccharomyces cerevisiae | [ui:ypl231w] [pn:fatty-acyl-coa synthase, alpha chain:fatty acid synthase, subunit alpha:contains:ec 1.1.1.100,and ec 2.3.1.41] [gn:fas2] [gtcfc:3.1:3.4:8.1:8.2:12.16] [ec:2.3.1.86] [kegggfc:3.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG679 | 26376953_f2_3 | 3760 | 17863 | 240 | 80 | YPL231W | 320 | 3.2(10)-27 | Saccharomyces cerevisiae | [sgdfc:1.6.1:6.4.0:9.2.0] [db:gtc-sacc] [ui:ypl231w] [pn:fatty-acyl-coa synthase, alpha chain:fatty acid synthase, subunit alpha:contains:ec 1.1.1.100, and ec 2.3.1.41] [gn:fas2] [gtcfc:3.1.3.4:8.1:8.2:12.16] [ec:2.3.1.86] [keggfc:3.1] [sgdfc:1.6.1:6.4.0:9.2.0] [db:gtc-sacc] |
| CONTIG679 | 24610787_f3_4 | 3761 | 17864 | 1095 | 365 | YPL231W | 1397 | 5.5(10)-143 | Saccharomyces cerevisiae | [ui:ypl231w] [pn:fatty-acyl-coa synthase, alpha chain:fatty acid synthase, subunit alpha:contains:ec 1.1.1.100, and ec 2.3.1.41] [gn:fas2] [gtcfc:3.1.3.4:8.1:8.2:12.16] [ec:2.3.1.86] [keggfc:3.1] [sgdfc:1.6.1:6.4.0:9.2.0] [db:gtc-sacc] |
| CONTIG2925 | 20347787_c3_6 | 3762 | 17865 | 1185 | 395 | YDL090C | 231 | 4.2(10)-18 | Saccharomyces cerevisiae | [ui:ydl090c] [pn:protein farnesyltransferase, beta subunit:protein farnesyltransferase beta subunit:caax farnesyltransferase beta subunit:ras proteins prenyltransferase:ftase-beta] [gn:ram1:dpr1:ste16:scg2:d2412] [gtcfc:3.1:7.1:9.12:10 |
| b3x16082.x | 1994166_f2_1 | 3763 | 17866 | 288 | 96 | YDL090C | 135 | 2.2(10)-8 | Saccharomyces cerevisiae | [ui:ydl090c] [pn:protein farnesyltransferase, beta subunit:protein farnesyltransferase beta subunit:caax farnesyltransferase beta subunit:ras proteins prenyltransferase:ftase-beta] [gn:ram1:dpr1:ste16:scg2:d2412] [gtcfc:3.1:7.1:9.12:10 |
| CONTIG3892 | 14344057_f1_1 | 3764 | 17867 | 1425 | 475 | YDL040C | 1042 | 2.2(10)-105 | Saccharomyces cerevisiae | [ui:ydl040c] [pn:protein n-acetyltransferase subunit:n-terminal acetyltransferase 1:amino-terminal, alpha-amino, acetyltransferase 1] [gn:nat1:aaa1:d2720] [gtcfc:3.1.10.7:14.1] [ec:2.3.1.88] [keggfc:14.1] |
| CONTIG4324 | 24881577_c2_9 | 3765 | 17868 | 807 | 269 | YDL040C | 237 | 7.2(10)-19 | Saccharomyces cerevisiae | [sgdfc:1.6.3:5.5.0:6.3.0:9.2. [ui:ydl040c] [pn:protein n-acetyltransferase subunit:n-terminal acetyltransferase 1:amino-terminal, |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5041 | 10663925_f3_4 | 3766 | 17869 | 1080 | 360 | YDR331W | 1086 | 4.9(10)-110 | Saccharomyces cerevisiae | alpha-amino, acetyltransferase 1 [gn:nat1:aaa1d2720] [gtcfc:3.1:10.7:14.1] [ec:2.3.1.88] [keggfc:14.1] [sgdfc:1.6.3:5.5:0:6.3.0:9.2. [ui:ydr331w] [pn:essential for gpi anchor attachment:hypothetical 47.4 kd protein in pas3 3"region] [gn:gpi8:d9798] [gtcfc:3.1:10.7:12.16] [keggfc:14.2] [sgdfc:1.6.3:6.3.0:9.4.0] [db:gtc-saccharomyces cerevisiae] |
| CONTIG1277 | 24042550_c3_3 | 3767 | 17870 | 408 | 136 | YDR410C | 196 | 1.2(10)-19 | Saccharomyces cerevisiae | [ui:ydr410c] [pn:farnesyl cysteine carboxyl-methyltransferase:protein-s isoprenylcysteine o-methyltransferase:isoprenylcysteine carboxylmethyltransferase] [gn:ste14:d9461] [gtcfc:3.1:10.7] [ec:2.1.1.100] [keggfc:14.1] [sgdfc:1.6.3:6.3 |
| CONTIG3528 | 25549090_c2_5 | 3768 | 17871 | 843 | 281 | YDR410C | 191 | 3.3(10)-15 | Saccharomyces cerevisiae | [ui:ydr410c] [pn:farnesyl cysteine carboxyl-methyltransferase:protein-s isoprenylcysteine o-methyltransferase:isoprenylcysteine carboxylmethyltransferase] [gn:ste14:d9461] [gtcfc:3.1:10.7] [ec:2.1.1.100] [keggfc:14.1] [sgdfc:1.6.3:6.3 |
| CONTIG2198 | 21517168_f2_1 | 3769 | 17872 | 912 | 304 | YER015W | 723 | 1.3(10)-71 | Saccharomyces cerevisiae | [ui:yer015w] [pn:long-chain-fatty-acid--coa ligase:long-chain-fatty-acid--coa ligase 2:long-chain acyl-coa synthetase 2:fatty acid activator 2] [gn:faa2:fam1] [gtcfc:3.1:3.2:12.2:12.6] [ec:6.2.1.3] [keggfc:3.2] [sgdkc:1.6.3:1.6.5:8.4 |
| CONTIG3922 | 4773937_f1_1 | 3770 | 17873 | 975 | 325 | YER015W | 389 | 2.2(10)-35 | Saccharomyces cerevisiae | [ui:yer015w] [pn:long-chain-fatty-acid--coa ligase:long-chain-fatty-acid--coa ligase 2:long-chain acyl-coa synthetase 2:fatty acid activator 2] [gn:faa2:fam1] [gtcfc:3.1:3.2:12.2:12.6] [ec:6.2.1.3] [keggfc:3.2] [sgdkc:1.6.3:1.6.5:8.4 |
| CONTIG4532 | 12625281_f1_1 | 3771 | 17874 | 1380 | 460 | YER015W | 971 | 7.5(10)-98 | Saccharomyces cerevisiae | [ui:yer015w] [pn:long-chain-fatty-acid--coa ligase: long-chain-fatty-acid--coa ligase 2:long-chain acyl-coa synthetase 2:fatty acid activator |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4868 | 820425_f3_4 | 3772 | 17875 | 186 | 62 | YER015W | 128 | 2.7(10)-7 | Saccharomyces cerevisiae | 2] [gn:faa2:fam1] [gtcfc:3.1.3.2:12.2:12.6] [ec:6.2.1.3] [kegg fc:3.2] [sgdfc:16.3:1.6.5:8.4 |
| CONTIG5092 | 10976502_c1_10 | 3773 | 17876 | 1851 | 617 | YER015W | 718 | 4.9(10)-71 | Saccharomyces cerevisiae | [ui:yer015w] [pn:long-chain-fatty-acid--coa ligase: long-chain-fatty-acid--coa ligase 2:long-chain acyl-coa synthetase 2:fatty acid activator 2] [gn:faa2:fam1] [gtcfc:3.1.3.2:12.2:12.6] [ec:6.2.1.3] [kegg fc:3.2] [sgdfc:16.3:1.6.5:8.4 |
| CONTIG5818 | 23447052_f1_3 | 3774 | 17877 | 765 | 255 | YER015W | 167 | 2.1(10)-16 | Saccharomyces cerevisiae | [ui:yer015w] [pn:long-chain-fatty-acid--coa ligase: long-chain-fatty-acid--coaligase 2:long-chain acyl-coa synthetase 2:fatty acid activator 2] [gn:faa2:fam1] [gtcfc:3.1.3.2:12.2:12.6] [ec:6.2.1.3] [kegg fc:3.2] [sgdfc:16.3:1.6.5:8.4 |
| CONTIG5818 | 30173825_f2_15 | 3775 | 17878 | 1494 | 498 | YER015W | 919 | 2.5(10)-92 | Saccharomyces cerevisiae | [ui:yer015w] [pn:long-chain-fatty-acid--coa ligase:long-chain-fatty-acid--coa ligase 2:long-chain acyl-coa synthetase 2:fatty acid activator 2] [gn:faa2:fam1] [gtcfc:3.1.3.2:12.2:12.6] [ec:6.2.1.3] [kegg fc:3.2] [sgdfc:16.3:1.6.5:8.4 |
| b2x15869.x | 13788931_f2_1 | 3776 | 17879 | 483 | 161 | YGL155W | 137 | 1.0(10)-8 | Saccharomyces cerevisiae | [ui:ygl155w] [pn:geranylgeranyltransferase beta subunit:type i proteins geranylgeranyltransferase beta subunit:type i protein geranyl-geranyltransferase beta subunit:rggtase-i-beta:pggt:ras proteins geranylgeranyltransferase beta subuni |
| b1x18944.y | 866677_c2_1 | 3777 | 17880 | 477 | 159 | YGL155W | 206 | 2.5(10)-16 | Saccharomyces cerevisiae | [ui:ygl155w] [pn :geranylgeranyltransferase beta subunit:type i proteins geranylgeranyltransferase beta |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5696 | 14492952_f2_5 | 3778 | 17881 | 525 | 175 | YHR013C | 538 | 5.7(10)-52 | *Saccharomyces cerevisiae* | [ui:yhr013c] [pn:protein n-acetyltransferase subunit:n-terminal acetyltransferase complex subunit:arrest- defective protein 1] [gn:ard1] [gtcfc:3.1:10.7:12.8] [keggfc:14.2] [sgdfc:1.6.3:3.8.0:6.3.0:9.2.0] [db:gtc-*saccharomyces cerevis*] subunit:type i protein geranyl-geranyltransferase beta subunit:ggtase-i-beta:pggt:ras proteins geranylgeranyltransferase beta subuni |
| b3x16013.y | 21963942_f1_1 | 3779 | 17882 | 294 | 98 | YHR013C | 182 | 3.1(10)-14 | *Saccharomyces cerevisiae* | [ui:yhr013c] [pn:protein n-acetyltransferase subunit:n-terminal acetyltransferase complex subunit:arrest- defective protein 1] [gn:ard1] [gtcfc:3.1:10.7:12.8] [keggfc:14.2] [sgdfc:1.6.3:3.8.0:6.3.0:9.2.0] [db:gtc-*saccharomyces cerevis*] |
| CONTIG2298 | 12791267_f2_1 | 3780 | 17883 | 543 | 181 | YJL031C | 116 | 3.3(10)-9 | *Saccharomyces cerevisiae* | [ui:yjl031c] [pn:geranylgeranyl transferase, alpha chain:type ii proteins geranylgeranyltransferase alpha subunit:type ii protein geranyl-geranyltransferase alpha subunit:ypt1/sec4 proteins geranylgeranyltransferas |
| CONTIG1168 | 21485635_c3_3 | 3781 | 17884 | 792 | 264 | YJR066W | 202 | 1.1(10)-18 | *Saccharomyces cerevisiae* | [ui:yjr066w] [pn:phosphatidylinositol 3-kinase:phosphatidylinositol 3-kinase tor1:pi3-kinase:ptdins-3-kinase:pi3k] [gn:tor1:drr1:j1803] [gtcfc:3.18.1:10.7:12.8] [ec:2.7.1.137] [keggfc:8.1] [sgdfc:1.6.3:3.8.0:5.5.0] [db:gtc-saccharomy |
| b2x15416.x | 31273942_f2_1 | 3782 | 17885 | 816 | 272 | YJR066W | 832 | 1.6(10)-81 | *Saccharomyces cerevisiae* | [ui:yjr066w] [pn:phosphatidylinositol 3-kinase:phosphatidylinositol 3-kinase tor1:pi3-kinase:ptdins-3-kinase:pi3k] [gn:tor1:drr1:j1803] [gtcfc:3.18.1:10.7:12.8] [ec:2.7.1.137] [keggfc:8.1] [sgdfc:1.6.3:3.8.0:5.5.0] [db:gtc-saccharomy |
| CONTIG1565 | 16220261_c3_2 | 3783 | 17886 | 444 | 148 | YKL019W | 214 | 1.3(10)-17 | *Saccharomyces cerevisiae* | [ui:ykl019w] [pn:protein farnesyltransferase, alpha saccharomy |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | subunit:protein farnesyltransferase alpha subunit:caax farnesyltransferase alpha subunit:ras proteins prenyltransferase:ftase-alpha] [gn:ram2] [gtcfc:3.1:7.1:9.12:10.7:11.3] [ec:2.5. |
| CONTIG1565 | 4688312_c3_1 | 3784 | 17887 | 231 | 77 | YKL019W | 153 | 1.2(10)-10 | Saccharomyces cerevisiae | [ui:ykl019w] [pn:protein farnesyltransferase, alpha subunit:protein farnesyltransferase alpha subunit:caax farnesyltransferase alpha subunit:ras proteins prenyltransferase:ftase-alpha] [gn:ram2] [gtcfc:3.1:7.1:9.12:10.7:11.3] [ec:2.5. |
| CONTIG1936 | 24665901_c1_4 | 3785 | 17888 | 471 | 157 | YLR088W | 324 | 1.3(10)-28 | Saccharomyces cerevisiae | [ui:ylr088] [pn:required for attachment of gpi anchor onto proteins:gaa1 protein] [gn:gaa1:end2:19449] [gtcfc:3.1:10.7:12.16:12.6] [keggfc:14.2] [sgdfc:1.6.3:6.3.0:8.7.0:9.4.0] [db:gtc-saccharomyces cerevisiae] |
| CONTIG410 | 24797067_c3_1 | 3786 | 17889 | 726 | 242 | YLR195C | 637 | 1.8(10)-62 | Saccharomyces cerevisiae | [ui:ylr195c] [pn:n-myristoyltransferase:glycylpeptide n-tetradecanoyltransferase:peptide n-myristoyltransferase:myristoyl-coa:protein n-myristoyltransferase:nmt] [gn:nmt1:cdc72:l8167] [gtcfc:3.1:10.7:14.1] [ec:2.3.1.97] [keggfc:14.1] |
| b9x13972.y | 4070152_c1_2 | 3787 | 17890 | 630 | 210 | YMR013C | 129 | 1.3(10)-7 | Saccharomyces cerevisiae | [ui:ymr013c] [pn:dolichol kinase] [gn:sec59:yln8270] [gtcfc:3.1:7.1:11.3:12.15:12.16] [ec:2.7.1.108] [keggfc:7.2] [sgdfc:1.6.3:3.4.0:9.4.0] [db:gtc-saccharomyces cerevisiae] |
| CONTIG2707 | 4688932_c3_6 | 3788 | 17891 | 972 | 324 | YMR246W | 886 | 7.7(10)-89 | Saccharomyces cerevisiae | [ui:ymr246w] [pn:long-chain-fatty-acid--coa ligase:long-chain-fatty-acid--coa ligase 4:long-chain acyl-coa synthetase 4:fatty acid activator 4] [gn:faa4:ym9408] [gtcfc:3.1.3:2.3.4.8.1:8.2:12.2] [ec:6.2.1.3] [keggfc:3.2] [sgdfc:1.6.1:1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4397 | 984700_f3_2 | 3789 | 17892 | 1038 | 346 | YOR317W | 1076 | 5.7(10)-109 | Saccharomyces cerevisiae | [ui:yor317w] [pn:long-chain-fatty-acid--coa ligase; long-chain-fatty-acid--coa ligase 1:long-chain acyl-coa synthetase 1:fatty acid activator 1] [gn:faa1.o6136] [gtcfc:3.1.3.2:12.2] [ec:6.2.1.3] [keggfc:3.2] [sgdfc:1.6.3:1.6.5] [db:gt |
| CONTIG5608 | 12689637_c1_12 | 3790 | 17893 | 2031 | 677 | YOR370C | 1133 | 5.2(10)-115 | Saccharomyces cerevisiae | [ui:yor370c] [pn:geranylgeranyltransferase regulatory subunit:rab proteins geranylgeranyltransferase component a:rab escort protein:rep] [gn:msi4:mrs6] [gtcfc:3.1:10.7] [keggfc:14.2] [sgdfc:1.6.3:6.3.0] [db:gtc-saccharomyces cerevisia |
| CONTIG4727 | 25571936_f2_1 | 3791 | 17894 | 630 | 210 | YPR176C | 650 | 7.9(10)-64 | Saccharomyces cerevisiae | [ui:ypr176c] [pn:geranylgeranyltransferase type beta subunit:type ii proteins geranylgeranyltransferase beta subunit:type ii protein geranyl-geranyltransferase beta subunit::ggtase-ii-beta:pggt:ypt1/sec4 proteins geranylgeranyltransf |
| CONTIG5261 | 30478927_f1_3 | 3792 | 17895 | 426 | 142 | YPR176C | 155 | 7.7(10)-11 | Saccharomyces cerevisiae | [ui:ypr176c] [pn:geranylgeranyltransferase type beta suhunit:type ii proteins geranylgeranyltransferase beta subunit:type ii protein geranyl-geranyltransferase beta subunit::ggtase-ii-beta:pggt:ypt1/sec4 proteins geranylgeranyltransf |
| CONTIG1764 | 25976412_f1_1 | 3793 | 17896 | 672 | 224 | YDR058C | 441 | 1.1(10)-41 | Saccharomyces cerevisiae | [ui:ydr058c] [pn:lipase 2:triacylglycerol lipase] [gn:tg12:yd9609] [gtcfc:3.2:8.1] [ec:3.1.1.3] [keggfc:8.1] [sgdfc:1.6.2] [db:gtc-saccharomyces cerevisiae] |
| CONTIG2680 | 20394002_f1_1 | 3794 | 17897 | 861 | 287 | YJL068C | 629 | 1.3(10)-61 | Saccharomyces cerevisiae | [ui:yjl068c] [pn:strong similarity to human esterase d:hypothetical 33.9 kd esterase in scp160-mrpl8 intergenic region] [gn:j1102:hre299] [gtcfc:3.2] [ec:3.1.1.1] [keggfc:14.1] [sgdfc:1.6.2] [db:gtc-saccharomyces cerevisiae] |
| CONTIG1156 | 9979142_f1_1 | 3795 | 17898 | 621 | 207 | YKR031C | 203 | 7.7(10)-15 | Saccharomyces cerevisiae | [ui:ykr031c] [pn:phospholipase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | d:meiosis-specific sporulation protein] [gn:spo14] [gtcfc:3.2:12.15] [keggfc:14.2] [sgdfc:1.6:2:3.4.0] [db:gtc-saccharomyces cerevisiae] |
| CONTIG2461 | 23652262_c1_3 | 3796 | 17899 | 1089 | 363 | YKR031C | 973 | 5.0(10)-97 | Saccharomyces cerevisiae | [ui:ykr031c] [pn:phospholipase d:meiosis-specific sporulation protein] [gn:spo14] [gtcfc:3.2:12.15] [keggfc:14.2] [sgdfc:1.6:2:3.4.0] [db:gtc-saccharomyces cerevisiae] |
| CONTIG4483 | 9806677_c1_14 | 3797 | 17900 | 603 | 201 | YKR031C | 488 | 3.5(10)-45 | Saccharomyces cerevisiae | [ui:ykr031c] [pn:phospholipase d:meiosis-specific sporulation protein] [gn:spo14] [gtcfc:3.2:12.15] [kegggk:14.2] [sgdfc:1.6:2:3.4.0] [db:gtc-saccharomyces cerevisiae] |
| CONTIG4483 | 11959836_c3_18 | 3798 | 17901 | 858 | 286 | YKR031C | 218 | 6.0(10)-21 | Saccharomyces cerevisiae | [ui:ykr031c] [pn:phospholipase d:meiosis-specific sporulation protein] [gn:spo14] [gtcfc:3.2:12.15] [keggfc:14.2] [sgdfc:1.6:2:3.4.0] [db:gtc-saccharomyces cerevisiae] |
| CONTIG5808 | 9789126_f1_3 | 3799 | 17902 | 1593 | 531 | YLR020C | 368 | 7.0(10)-34 | Saccharomyces cerevisiae | [ui:ylr020c] [pn:similarity to triacylglycerol lipase] [gtcfc:3.2] [keggfc:14.2] [sgdfc:1.6.2] [db:gtc-saccharomyces cerevisiae] |
| CONTIG3882 | 892182_c2_5 | 3800 | 17903 | 1239 | 413 | YMR006C | 707 | 7.2(10)-70 | Saccharomyces cerevisiae | [ui:ymr006c] [pn:strong similarity to plb1p] [gtcfc:3.2] [keggfc:14.2] [sgdfc:1.6.2] [db:gtc-saccharomyces cerevisiae] |
| CONTIG620 | 26760175_c2_5 | 3801 | 17904 | 186 | 62 | YMR006C | 117 | 3.8(10)-6 | Saccharomyces cerevisiae | [ui:ymr006c] [pn:strong similarity to plb1p] [gtcfc:3.2] [keggfc:14.2] [sgdfc:1.6.2] [db:gtc-saccharomyces cerevisiae] |
| CONTIG5474 | 6665938_c1_10 | 3802 | 17905 | 1833 | 611 | YMR008C | 1218 | 5.0(10)-124 | Saccharomyces cerevisiae | [ui:ymr008c] [pn:lysophospholipase:lysophospholipase precursor:phospholipase b] [gn:plb1:ym8270] [gtcfc:3.2:8.4:11.1] [ec:3.1.1.5] [keggfc:8.4] [sgdfc:1.6.2:9.1.0] [db:gtc-saccharomyces cerevisiae] |
| CONTIG5527 | 22360301_f1_1 | 3803 | 17906 | 1914 | 638 | YMR008C | 1603 | 8.0(10)-165 | Saccharomyces cerevisiae | [ui:ymr008c] [pn:lysophospholipase:lysophospholipase precursor:phospholipase b] [gn:plb1:ym8270] [gtcfc:3.2:8.4:11.1] [ec:3.1.1.5] [keggfc:8.4] [sgdfc:1.6.2:9.1.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG620 | 33417768_c2_6 | 3804 | 17907 | 627 | 209 | YMR008C | 285 | 3.1(10)-24 | Saccharomyces cerevisiae | [ui:ymr008c] [pn:lysophospholipase:lysophospholipase precursor;phospholipase b] [gn:plb1;ym8270] [gtcfc:3.2.8.4:11.1] [ec:3.1.1.5] [keggfc:8.4] [sgdfc:1.6.2:9.1.0] [db:gtc-saccharomyces cerevisiae] |
| CONTIG4295 | 20507697_c2_6 | 3805 | 17908 | 990 | 330 | YNL012W | 484 | 3.1(10)-46 | Saccharomyces cerevisiae | [ui:ynl012w] [pn:transcriptional regulator involved in sporulation:sporulation protein sop1] [gn:spo1:n2858] [gtcfc:3.2:10.1:10.2:12.15:12.8] [keggfc:14.2] [sgdfc:1.6.2:3.4.0:3.8.0:4.8.2:9.5.0] [db:gtc-saccharomyces cerevisiae] |
| CONTIG3890 | 25627002_f2_1 | 3806 | 17909 | 1587 | 529 | YOL011W | 1135 | 3.2(10)-115 | Saccharomyces cerevisiae | [ui:yol011w] [pn:strong similarity to phospholipases] [gtcfc:3.2] [keggfc:14.2] [sgdfc:1.6.2] [db:gtc-saccharomyces cerevisiae] |
| CONTIG3994 | 24641561_c1_6 | 3807 | 17910 | 609 | 203 | YOL011W | 217 | 7.0(10)-17 | Saccharomyces cerevisiae | [ui:yol011w] [pn:strong similarity to phospholipases] [gtcfc:3.2] [keggfc:14.2] [sgdfc:1.6.2] [db:gtc-saccharomyces cerevisiae] |
| CONTIG5072 | 3751_c2_4 | 3808 | 17911 | 2142 | 714 | YOL011W | 928 | 2.7(10)-93 | Saccharomyces cerevisiae | [ui:yol011w] [pn:strong similarity to phospholipases] [gtcfc:3.2] [keggfc:14.2] [sgdfc:1.6.2] [db:gtc-saccharomyces cerevisiae] |
| CONTIG2195 | 20319377_f3_3 | 3809 | 17912 | 306 | 102 | YGR175C | 321 | 1.0(10)-28 | Saccharomyces cerevisiae | [ui:ygr175c] [pn:squalene monooxygenase:squalene epoxidase:se] [gn:erg1] [gtcfc:3.4:8.1:8.2:9.13:12.16] [ec:1.14.99.7] [keggfc:3.4:9.11] [sgdfc:1.6.1:9.4.0] [db:gtc-saccharomyces cerevisiae] |
| CONTIG2588 | 5875938_f2_1 | 3810 | 17913 | 255 | 85 | YHR072W | 286 | 3.0(10)-24 | Saccharomyces cerevisiae | [ui:yhr072w] [pn:lanosterol synthase:oxidosqualene--lanosterol cyclase:2,3-epoxysqualene--lanosterol cyclase:osc] [gn:erg7] [gtcfc:3.4:8.1:8.2:12.16] [ec:5.4.99.7] [keggfc:3.4] [sgdfc:1.6.1:9.4.0] [db:gtc-saccharomyces cerevisiae] |
| CONTIG515 | 21932809_c1_1 | 3811 | 17914 | 747 | 249 | YHR072W | 765 | 5.0(10)-76 | Saccharomyces cerevisiae | [ui:hyr072w] [pn:lanosterol synthase:oxidosqualene--lanosterol cyclase:2,3-epoxysqualene--lanosterol cyclase:osc] [gn:erg7] [gtcfc:3.4:8.1:8.2:12.16] [ec:5.4.99.7] [keggfc:3.4] [sgdfc:1.6.1:9.4.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3232 | 4772512_f3_5 | 3812 | 17915 | 1218 | 406 | YHR190W | 1129 | 1.3(10)-114 | *Saccharomyces cerevisiae* | *saccharomyces cerevisiae* [ui:yhr190w] [pn:farnesyl-diphosphate farnesyltransferase:squalene synthetase:sqsss:fpp:fpp farnesyltransferase] [gn:erg9] [gtcfc:3.4.8.1:8.2.9.13:12.16] [ec:2.5.1.21] [keggfc:3.4.9.11] [sgdfc:1.6.1.9.4.0] [db:gtc-saccharomyces cerev |
| CONTIG5151 | 23570892_c3_7 | 3813 | 17916 | 1224 | 408 | YJL167W | 1366 | 1.1(10)-139 | *Saccharomyces cerevisiae* | *saccharomyces cerevisiae* [ui:yjl67w] [pn:farnesyl-pyrophosphate synthetase:farnesyl pyrophosphate synthetase:fpp synthestase:dimethylallyltransferase/geranyltranstransferase] [gn:fpp1:fds1:bot3:erg20;j0525] [gtcfc:3.4.8.1: |
| CONTIG2477 | 35369020_f2_1 | 3814 | 17917 | 942 | 314 | YLR450W | 961 | 8.6(10)-97 | *Saccharomyces cerevisiae* | *saccharomyces cerevisiae* [ui:ylr450w] [pn:3-hydroxy-3-methylglutaryl-coenzyme a reductase 2:hmg-coa reductase 2] [gn:hmg2:19324] [gtcfc:3.4.8.1:8.2:12.16] [ec:1.1.1.34] [keggfc:3.4] [sgdfc:1.6.1.9.4.0] [db:gtc-saccharomyces cerevisiae] |
| CONTIG4037 | 24220450_c3_5 | 3815 | 17918 | 1014 | 338 | YLR450W | 279 | 3.2(10)-23 | *Saccharomyces cerevisiae* | *saccharomyces cerevisiae* [ui:ylr450w] [pn:3-hydroxy-3-methylglutaryl-coenzyme a reductase 2:hmg-coa reductase 2] [gn:hmg2:19324] [gtcfc:3.4.8.1:8.2:12.16] [ec:1.1.1.34] [keggfc:3.4] [sgdfc:1.6.1.9.4.0] [db:gtc-saccharomyces cerevisiae] |
| CONTIG4037 | 10823550_c2_3 | 3816 | 17919 | 870 | 290 | YLR450W | 350 | 8.3(10)-31 | *Saccharomyces cerevisiae* | *saccharomyces cerevisiae* [ui:ylr450w] [pn:3-hydroxy-3-methylglutaryl-coenzyme a reductase 2:hmg-coa reductase 2] [gn:hmg2:19324] [gtcfc:3.4.8.1:8.2:12.16] [ec:1.1.1.34] [keggfc:3.4] [sgdfc:1.6.1.9.4.0] [db:gtc saccharomyces cerevisiae] |
| CONTIG1965 | 28242313_c3_5 | 3817 | 17920 | 402 | 134 | YMR208W | 164 | 1.6(10)-11 | *Saccharomyces cerevisiae* | *saccharomyces cerevisiae* [ui:ymr208w] [pn:mevalonate kinase:mvk] [gn:rar1:erg12:ym8261] [gtcfc:3.4.10.21] [ec:2.7.1.36] [keggfc:3.4] [sgdfc:1.6.4:9.2.0] [db:gtc-saccharomyces cerevisiae] |
| CONTIG5199 | 22353426_f1_2 | 3818 | 17921 | 654 | 218 | YMR208W | 448 | 2.0(10)-42 | *Saccharomyces cerevisiae* | *saccharomyces cerevisiae* [ui:ymr208w] [pn:mevalonate |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2617 | 11177088_c3_7 | 3819 | 17922 | 1230 | 410 | YMR220W | 694 | 1.7(10)-68 | Saccharomyces cerevisiae | kinase:mvk] [gn:rar1:erg12:ym8261] [gtcfc:3.4.10.2] [ec:2.7.1.36] [keggfc:3.4] [sgdfc:1.6.4.9.2.0] [db:gtc-saccharomyces cerevisiae] [ui:ym220w] [pn:phosphomevalonate kinase] [gn:erg8:ym9959] [gtcfc:3.4.8.1:8.2] [ec:2.7.4.2] [keggfc:3.4] [sgdfc:1.6.1.9.2.0] [db:gtc-saccharomyces cerevisiae] |
| CONTIG5378 | 9882002_c2_18 | 3820 | 17923 | 765 | 255 | YMR220W | 517 | 9.8(10)-50 | Saccharomyces cerevisiae | [ui:ym220w] [pn:phosphomevalonate kinase] [gn:erg8:ym9959] [gtcfc:3.4.8.1:8.2] [ec:2.7.4.2] [keggfc:3.4] [sgdfc:1.6.1.9.2.0] [db:gtc-saccharomyces cerevisiae] |
| CONTIG5601 | 20890782_f2_8 | 3821 | 17924 | 1050 | 350 | YNR043W | 1039 | 2.3(10)-110 | Saccharomyces cerevisiae | [ui:ynr043w] [pn:diphosphomevalonate decarboxylase:mevalonate pyrophosphate decarboxylase] [gn:erg19:mvd1:mpd:n3427] [gtcfc:3.4.8.1:8.2] [ec:4.1.1.33] [keggfc:3.4] [sgdfc:1.6.1] [db:gtc-saccharomyces cerevisiae] |
| CONTIG1153 | 25579387_c3_1 | 3822 | 17925 | 186 | 62 | YPL117C | 206 | 8.8(10)-17 | Saccharomyces cerevisiae | [ui:ypl117c] [pn:isopentenyl-diphosphate delta-isomerase:ipp isomerase] [gn:idi1:bot2:lph10c] [gtcfc:3.4.8.1:8.2:9.13] [ec:5.3.3.2] [keggfc:3.4:9.11] [sgdfc:1.6.1.9.2.0] [db:gtc-saccharomyces cerevisiae] |
| b2x15112.y | 24472625_f2_1 | 3823 | 17926 | 543 | 181 | YPL117C | 491 | 5.5(10)-47 | Saccharomyces cerevisiae | [ui:ypl117c] [pn:isopentenyl-diphosphate delta-isomerase:ipp isomerase] [gn:idi1:bot2:lph10c] [gtcfc:3.4.8.1:8.2:9.13] [ec:5.3.3.2] [keggfc:3.4:9.11] [sgdfc:1.6.1.9.2.0] [db:gtc-saccharomyces cerevisiae] |
| CONTIG3968 | 35429566_f2_2 | 3824 | 17927 | 465 | 155 | YAR044W | 427 | 2.7(10)-39 | Saccharomyces cerevisiae | [ui:yar044w] [pn:similarity to human oxysterol binding protein:osbp:osh1 protein] [gn:osh1:swh1] [gtcfc:3.4.8.1:8.2:10.2] [keggfc:14.2] [sgdfc:1.6.1:4.8.3] [db:gtc-saccharomyces cerevisiae] |
| CONTIG1728 | 16509562_f1_1 | 3825 | 17928 | 693 | 231 | YBR029C | 635 | 3.1(10)-62 | Saccharomyces cerevisiae | [ui:ybr029c] [pn:cdp-diacylglycerol synthase:phosphatidate |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2244 | 10558385_c1_7 | 3826 | 17929 | 738 | 246 | YBR029C | 517 | 9.8(10)-50 | Saccharomyces cerevisiae | cytidylyltransferase:cdp-diglyceride synthetase:cdp-diglyceride pyrophosphorylase:cdp-diacylglycerol synthase] [gn:cds1:cdg1:ybr0313] [gtcfc:3.4:8.1:8.2:12.16] [ec:2.7.7.41] [ui:ybr029c] [pn:cdp-diacylglycerol synthase:phosphatidate cytidylyltransferase:cdp-diglyceride synthetase:cdp-diglyceride pyrophosphorylase:cdp-diacylglycerol synthase] [gn:cds1:cdg1:ybr0313] [gtcfc:3.4:8.1:8.2:12.6] [ec:2.7.7.41] |
| CONTIG3755 | 35413942_f2_2 | 3827 | 17930 | 270 | 90 | YBR159W | 225 | 1.1(10)-18 | Saccharomyces cerevisiae | [ui:ybr159w] [pn:similarity to human17-beta-hydroxysteroid dehydrogenase:hypothetical 38.7 kd protein in rpb5-cdc28 intergenic region] [gn:ybr1209] [gtcfc:3.4:8.1:8.2] [keggfc:14.2] [sgdfc:1.6.1] [db:gtc-saccharomyces cerevisiae] |
| CONTIG1747 | 20117314_c1_2 | 3828 | 17931 | 675 | 225 | YBR159W | 633 | 5.0(10)-62 | Saccharomyces cerevisiae | [ui:ybr159w] [pn:similarity to human 17-beta-hydroxysteroid dehydrogenase:hypothetical 38.7 kd protein in rpb5-cdc28 intergenic region] [gn:ybr1209] [gtcfc:3.4:8.1:8.2] [keggfc:14.2] [sgdfc:1.6.1] [db:gtc-saccharomyces cerevisiae] |
| CONTIG5601 | 22523251_c1_20 | 3829 | 17932 | 750 | 250 | YDL142C | 300 | 9.6(10)-27 | Saccharomyces cerevisiae | [ui:ydl142c] [pn:phosphatidylglycerophosphate synthase] [gn:pgs1] [gtcfc:3.4:8.1:8.2] [keggfc:14.2] [sgdfc:1.6.1] [db:gtc-saccharomyces cerevisiae] |
| CONTIG4549 | 12140636_c1_7 | 3830 | 17933 | 942 | 314 | YDL052C | 654 | 3.0(10)-64 | Saccharomyces cerevisiae | [ui:ydl052c] [pn:fatty acyltransferase:possible 1-acyl-sn-glycerol-3-phosphate acyltransferase] [gn:slc1] [gtcfc:3.4:8.1:8.2] [ec:2.3.1.51] [keggfc:8.1] [sgdfc:1.6.1] [db:gtc-saccharomyces cerevisiae] |
| CONTIG3968 | 35417136_f2_1 | 3831 | 17934 | 1254 | 418 | YDL019C | 927 | 3.5(10)-93 | Saccharomyces cerevisiae | [ui:ydl019c] [pn:similarity to osh1p] [gtcfc:3.4:8.1:8.2] [keggfc:14.2] [sgdfc:1.6.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4505 | 24344501_f2_3 | 3832 | 17935 | 2349 | 783 | YDL019C | 676 | 1.5(10)-75 | *Saccharomyces cerevisiae* | *saccharomyces cerevisiae* [ui:yld019c] [pn:similarity to osh1p] [gtcfc:3.4.8.1:8.2] [keggfc:14.2] [sgdfc:1.6.1] [db:gtc-saccharomyces cerevisiae] |
| CONTIG5157 | 26798437_c3_10 | 3833 | 17936 | 369 | 123 | YDR062W | 252 | 7.7(10)-21 | *Saccharomyces cerevisiae* | [ui:ydr062w] [pn:serine c-palmitoyltransferase subunit:serine palmitoyltransferase 2:long chain base biosynthesis protein 2:spt 2] [gn:lcb2:scs1:yd9609] [gtcfc:3.4.8.1:8:2:8.5] [ec:2.3.1.50] [keggfc:8.5] [sgdfc:1.6.1] [db:gtc-saccharo |
| CONTIG5157 | 35173137_c2_6 | 3834 | 17937 | 936 | 312 | YDR062W | 1025 | 1.3(10)-103 | *Saccharomyces cerevisiae* | [ui:ydr062w] [pn:serine c-palmitoyltransferase subunit:serine palmitoyltransferase 2:long chain base biosynthesis protein 2:spt 2] [gn:lcb2:scs1:yd9609] [gtcfc:3.4.8.1:8:2:8.5] [ec:2.3.1.50] [keggfc:8.5] [sgdfc:1.6.1] [db:gtc-saccharo |
| CONTIG2898 | 15626_f3_2 | 3835 | 17938 | 336 | 112 | YDR062W | 187 | 8.4(10)-14 | *Saccharomyces cerevisiae* | [ui:ydr062w] [pn:serine c-palmitoyltransferase subunit:serine palmitoyltransferase 2:long chain base biosynthesis protein 2:spt 2] [gn:lcb2:scs1:yd9609] [gtcfc:3.4.8.1:8:2:8.5] [ec:2.3.1.50] [keggfc:8.5] [sgdfc:1.6.1] [db:gtc-saccharo |
| CONTIG887 | 19710752_c2_4 | 3836 | 17939 | 858 | 286 | YDR208W | 470 | 3.8(10)-44 | *Saccharomyces cerevisiae* | [ui:ydr208w] [pn:similarity to human pip 5-kinase:-probable phosphatidylinositol-4-phosphate 5-kinase mss4:1-phosphatidylinositol-4-phosphate kinase:pip5k:ptdins:4p-5-kinase:diphosphoinositide kinase] [gn:mss4:yd81142a] [gtcfc:3.4.8.1.8 |
| b9x12u09.x | 50627_c1_1 | 3837 | 17940 | 582 | 194 | YDR208W | 446 | 1.7(10)-41 | *Saccharomyces cerevisiae* | [ui:ydr208w] [pn:similarity to human pip 5-kinase:-probable phosphatidylinositol-4-phosphate 5-kinase mss4:1-phosphatidylinositol-4-phosphate kinase:pip5k:ptdins:4p-5-kinase:diphosphoinositide kinase] [gn:mss4:yd81142a] [gtcfc:3.4.8.1.8 |
| CONTIG546 | 4038905_c2_4 | 3838 | 17941 | 1011 | 337 | YGL126W | 115 | 6.0(10)-15 | *Saccharomyces cerevisiae* | [ui:ygl126w] [pn:inositol phospholipid synthesis protein:scs3 protein] [gn:scs3:g2868] [gtcfc:3.4.8.1:8.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1217 | 11117665_f1_1 | 3839 | 17942 | 726 | 242 | YGL055W | 283 | 2.2(10)-24 | Saccharomyces cerevisiae | [sgdfc:1.6.1] [db:gtc-saccharomyces cerevisiae] [ui:ygl055w] [pn:stearoyl-coa desaturase:acyl-coa desaturase 1:stearoyl-coa desaturase 1:fatty acid desaturase 1] [gn:ole1] [gtcfc:3.4.8.1:8.2:12.16] [ec:1.14.99.5] [keggfc:14.1] [sgdfc:1.6.1:9.4.0] [db:gtc-saccharomyces cerevisiae] |
| CONTIG5698 | 4800011_f2_11 | 3840 | 17943 | 927 | 309 | YGL055W | 866 | 1.0(10)-86 | Saccharomyces cerevisiae | [ui:ygl055w] [pn:stearoyl-coa desaturase:acyl-coa desaturase 1:stearoyl-coa desaturase 1:fatty acid desaturase 1] [gn:ole1] [gtcfc:3.4.8.1:8.2:12.16] [ec:1.14.99.5] [keggfc:14.1] [sgdfc:1.6.1:9.4.0] [db:gtc-saccharomyces cerevisiae] |
| CONTIG5698 | 6642807_f1_1 | 3841 | 17944 | 381 | 127 | YGL055W | 304 | 1.1(10)-26 | Saccharomyces cerevisiae | [ui:ygl055w] [pn:stearoyl-coa desaturase:acyl-coa desaturase 1:stearoyl-coa desaturase 1:fatty acid desaturase 1] [gn:ole1] [gtcfc:3.4.8.1:8.2:12.16] [ec:1.14.99.5] [keggfc:14.1] [sgdfc:1.6.1:9.4.0] [db:gtc-saccharomyces cerevisiae] |
| CONTIG506 | 204700_f1_2 | 3842 | 17945 | 795 | 265 | YGL012W | 802 | 6.2(10)-80 | Saccharomyces cerevisiae | [ui:ygl012w] [pn:sterol c-24 reductase:c-24:28 sterol reductase] [gn:erg4:ygl022] [gtcfc:3.4.8.1:8.2] [ec:1.-.-.-] [keggfc:14.1] [sgdfc:1.6.1] [db:gtc-saccharomyces cerevisiae] |
| CONTIG4272 | 31336678_f2_2 | 3843 | 17946 | 903 | 301 | YGL001C | 1083 | 1.0(10)-109 | Saccharomyces cerevisiae | [ui:ygl001c] [pn:putative 3-beta-hydroxysteroid dehydrogenase:putative 3-beta-hydroxy-5-ene steroid dehydrogenase/steroid delta-isomerase:3beta-hsd:progesterone reductase] [gtcfc:3.4:3.6:3.7:8.1:8.2] [keggfc:3.6:3.7] [sgdfc:1.6.1] |
| CONTIG5167 | 22063392_c3_16 | 3844 | 17947 | 648 | 216 | YGR007W | 391 | 2.2(10)-36 | Saccharomyces cerevisiae | [ui:ygr007w] [pn:choline phosphate cytidylyltransferase:protein] [gn:muq1] [gtcfc:3.4.8.1:8.2] [keggfc:14.2] [sgdfc:1.6.1] [db:gtc-saccharomyces cerevisiae] |
| CONTIG3381 | 12506943_c2_2 | 3845 | 17948 | 960 | 320 | YGR037C | 122 | 2.6(10)-7 | Saccharomyces cerevisiae | [ui:ygr037c] [pn:acyl-coenzyme-a-binding protein:diazepam binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4951 | 6814008_f1_1 | 3846 | 17949 | 234 | 78 | YGR037C | 270 | 1.5(10)-23 | Saccharomyces cerevisiae | inhibitor:acyl-coa-binding protein;acbp] [gn:acb1:acb] [gtcfc:3.4.8.1:8.2:12.2] [keggfc:14.2] [sgdfc:1.6:1:1.6.5] [db:gtc-saccharomyces cerevisiae] [ui:ygr037c] [pn:acyl-coenzyme-a-binding protein:diazepam binding inhibitor:acyl-coa-binding protein;acbp] [gn:acb1:acb] [gtcfc:3.4.8.1:8.2:12.2] [keggfc:14.2] [sgdfc:1.6:1:1.6.5] |
| CONTIG1332 | 953392_c3_3 | 3847 | 17950 | 921 | 307 | YGR060W | 854 | 1.8(10)-85 | Saccharomyces cerevisiae | [db:gtc-saccharomyces cerevisiae] [ui:ygr060w] [pn:c-4 sterol methyl oxidase:c-4 methyl sterol oxidase] [gn:erg25:fet6] [gtcfc:3.4.8.1:8.2:12.16] [ec:1.-.-.-] [keggfc:14.1] [sgdfc:1.6.1:9.4.0] |
| CONTIG4151 | 6853437_f2_2 | 3848 | 17951 | 969 | 323 | YGR060W | 910 | 2.2(10)-91 | Saccharomyces cerevisiae | [db:gtc-saccharomyces cerevisiae] [ui:ygr060w] [pn:c-4 sterol methyl oxidase:c-4 methyl sterol oxidase] [gn:erg25:fet6] [gtcfc:3.4.8.1:8.2:12.16] [ec:1.-.-.-] [keggfc:14.1] [sgdfc:1.6.1:9.4.0] |
| CONTIG3701 | 4375802_c2_5 | 3849 | 17952 | 318 | 106 | YGR060W | 246 | 5.0(10)-21 | Saccharomyces cerevisiae | [db:gtc-saccharomyces cerevisiae] [ui:ygr060w] [pn:c-4 sterol methyl oxidase:c-4 methyl sterol oxidase] [gn:erg25:fet6] [gtcfc:3.4.8.1:8.2:12.16] [ec:1.-.-.-] [keggfc:14.1] [sgdfc:1.6.1:9.4.0] |
| CONTIG1185 | 23495718_c2_2 | 3850 | 17953 | 660 | 220 | YGR157W | 123 | 3.0(10)-13 | Saccharomyces cerevisiae | [db:gtc-saccharomyces cerevisiae] [ui:ygr157w] [pn:phosphatidylethanolamine n-methyltransferase] [gn:pem1:cho2:g6673] [gtcfc:3.4.5.3:8.1:8.2:12.16] [ec:2.1.1.17] [keggfc:5.3] [sgdfc:1.6.1:9.4.0] |
| CONTIG3467 | 171877_c3_5 | 3851 | 17954 | 672 | 224 | YGR157W | 199 | 8.8(10)-15 | Saccharomyces cerevisiae | [db:gtc-saccharomyces cerevisiae] [ui:ygr157w] [pn:phosphatidylethanolamine n-methyltransferase] [gn:pem1:cho2:g6673] [gtcfc:3.4.5.3:8.1:8.2:12.16] [ec:2.1.1.17] [keggfc:5.3] [sgdfc:1.6.1:9.4.0] |
| CONTIG5637 | 34492200_f3_7 | 3852 | 17955 | 1116 | 372 | YGR170W | 596 | 4.0(10)-57 | Saccharomyces cerevisiae | [db:gtc-saccharomyces cerevisiae] [ui:ygr170w] [pn:phosphatidylserine decarboxylase 2:phosphatidylserine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5637 | 36064812_f1_1 | 3853 | 17956 | 720 | 240 | YGR170W | 531 | 4.0(10)-50 | Saccharomyces cerevisiae | decarboxylase proenzyme 2 precursor] [gn:psd2] [gtcfc:3.4.5.3.8.1.8.2.12.16] [ec:4.1.1.65] [keggfc:5.3.8.1] [sgdfc:1.6.1.9.4.0] [db:gtc-saccharomyces cerevisiae] [ui:ygr170w] [pn:phosphatidylserine decarboxylase 2:phosphatidylserine decarboxylase proenzyme 2 precursor] [gn:psd2] |
| b2x18670.x | 2401038_f2_1 | 3854 | 17957 | 576 | 192 | YGR170W | 290 | 2.5(10)-24 | Saccharomyces cerevisiae | [gtcfc:3.4.5.3.8.1.8.2.12.16] [ec:4.1.1.65] [keggfc:5.3.8.1] [sgdfc:1.6.1.9.4.0] [db:gtc-saccharomyces cerevisiae] [ui:ygr170w] [pn:phosphatidylserine decarboxylase 2:phosphatidylserine decarboxylase proenzyme 2 precursor] [gn:psd2] |
| CONTIG5670 | 3337762_f1_5 | 3855 | 17958 | 1377 | 459 | YGR202C | 957 | 2.2(10)-96 | Saccharomyces cerevisiae | [ui:ygr202c] [pn:cholinephosphate cytidylyltransferase:phosphorylcholine transferase:cct] [gn:pct1:cct1:cct:g7729] [gtcfc:3.4.6.3.8.1.8.2.12.16] [ec:2.7.7.15] [keggfs:6.3.8.1] [sgdfc:1.6.1.9.4.0] [db:gtc-saccharomyces cerevisiae] |
| CONTIG3973 | 156567_f2_3 | 3856 | 17959 | 1455 | 485 | YGR216C | 287 | 4.9(10)-32 | Saccharomyces cerevisiae | [ui:ygr216c] [pn:required for n-acetylglucosaminyl phosphatidylinositol synthesis:hypothetical 70.4 kd protein in nab1a-cm1 intergenic region] [gn:gpi1] [gtcfc:3.4.8.1.8.2] [keggfc:14.2] [sgdfc:1.6.1] [db:gtc-saccharomyces cerevisiae] |
| CONTIG130 | 17033563_c1_4 | 3857 | 17960 | 534 | 178 | YHR001W | 486 | 1.8(10)-46 | Saccharomyces cerevisiae | [ui:yhr001w] [pn:similarity to kes1p:hypothetical 49.8 kd protein in rpl14b-gpa1 intergenic region] [gtcfc:3.4.8.1.8.2.8.5] [keggfc:14.2] [sgdfc:1.6.1.1.6.6] [db:gtc-saccharomyces cerevisiae] |
| CONTIG56 | 1723200_f2_1 | 3858 | 17961 | 642 | 214 | YHR001W | 535 | 1.2(10)-51 | Saccharomyces cerevisiae | [ui:yhr001w] [pn:similarity to kes1p:hypothetical 49.8 kd protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5249 | 14665887_f2_1 | 3859 | 17962 | 2538 | 846 | YHR073W | 982 | 4.0(10)-136 | Saccharomyces cerevisiae | in rpl14b-gpa1 intergenic region] [gtcfc:3.4.8.1:8.2:8.5] [keggfc:14.2] [sgdfc:1.6.1:1.6.6] [db-gtc-saccharomyces cerevisiae] [ui:yhr073w] [pn:similarity to osh1p, ydl019c and mammalian oxysterol-binding protei:hypothetical 113.8 kd protein in erg7-ndm2 intergenic region] [gtcfc:3.4.8.1:8.2] [keggfc:14.2] [sgdfc:1.6.1] [db-gtc-saccharomyces cerevisiae] |
| CONTIG5694 | 14250878_c2_21 | 3860 | 17963 | 699 | 233 | YIR035C | 570 | 2.3(10)-55 | Saccharomyces cerevisiae | [ui:yir035c] [pn:similarity to human corticosteroid 11-beta-dehydrogenase:hypothetical oxidoreductase in lys1-hyr1 intergenic region] [gtcfc:3.4.8.1:8.2] [ec:1.-.-.-] [deggfc:14.1] [sgdfc:1.6.1] [db-gtc-saccharomyces cerevisiae] |
| CONTIG5694 | 51342_c1_18 | 3861 | 17964 | 798 | 266 | YIR035C | 540 | 3.6(10)-52 | Saccharomyces cerevisiae | ui:yir035c] [pn:similarity to human corticosteroid 11-beta-dehydrogenase:hypothetical oxidoreductase in lys1-hyr1 intergenic region] [gtcfc:3.4.8.1:8.2] [ec:1.-.-.-] [deggfc:14.1] [sgdfc:1.6.1] [db-gtc-saccharomyces cerevisiae] |
| CONTIG3615 | 23600262_f1_1 | 3862 | 17965 | 1218 | 406 | YJL196C | 177 | 2.5(10)-11 | Saccharomyces cerevisiae | [ui:yjl196c] [pn:fatty acid elongation protein:hypothetical 36.2 kd protein in ubp12-cdc6 intergenic region] [gn:elo1:j0343] [gtcfc:3.4.8.1:8.2] [keggfc:14.2] [sgdfc:1.6.1] [db-gtc-saccharomyces cerevisiae] |
| CONTIG4808 | 2767125_c1_8 | 3863 | 17966 | 318 | 106 | YJR073C | 222 | 1.8(10)-18 | Saccharomyces cerevisiae | [ui:yjr073c] [pn:methylene-fatty-acyl-phospholipid synthase:unsaturated phospholipid methyltransferase] [gn:pem2:opi3:j1824] [gtcfc:3.4.8.1:8.2:12.16] [ec:2.1.1.16] [keggfc:14.1] [sgdfc:1.6.1:9.4.0] [db-gtc-saccharomyces cerevisiae] |
| CONTIG1917 | 16972215_c1_5 | 3864 | 17967 | 1014 | 338 | YKL203C | 1241 | 4.4(10)-125 | Saccharomyces cerevisiae | [ui:ykl203c] [pn:phosphatidylinositol 3-kinase tor2:pi3-kinase:ptdins-3-kinase:pi3k] [gn:tor2:drr2] [gtcfc:3.4.8.1:8.2:12.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG58 | 35167202_c1_1 | 3865 | 17968 | 852 | 284 | YKL203C | 778 | 9.0(10)-76 | *Saccharomyces cerevisiae* | [ec:2.7.1.137] [keggfc:8.1] [sgdfc:1.6.1:3.1.0:3.8.0] [db:gtc-saccharomyces cer [ui:ykl203c] [pn:phosphatidylinositol 3-kinase:phosphatidylinositol 3-kinase tor2:pi3-kinase:ptdins-3-kinase:pi3k] [n:tor2:drr2] [gtcfc:3.4.8.1:8.2:12.8] [ec:2.7.1.137] [keggfc:8.1] [sgdfc:1.6.1:3.1.0:3.8.0] [db:gtc-saccharomyces cer |
| CONTIG869 | 16494055_c3_2 | 3866 | 17969 | 552 | 184 | YKL203C | 311 | 4.0(10)-26 | *Saccharomyces cerevisiae* | [ui:ykl203c] [pn:phosphatidylinositol 3-kinase:phosphatidylinositol 3-kinase tor2:pi3-kinase:ptdins-3-kinase:pi3k] [gn:tor2:drr2] [gtcfc:3.4.8.1:8.2:12.8] [ec:2.7.2.137] [keggfc:8.1] [sgdfc:1.6.1:3.1.0:3.8.0] [db:gtc-saccharomyces cer |
| b9x10w65.y | 31413532_f1_1 | 3867 | 17970 | 606 | 202 | YKL203C | 775 | 1.8(10)-75 | *Saccharomyces cerevisiae* | [ui:ykl203c] [pn:phosphatidylinositol 3-kinase:phosphatidylinositol 3-kinase tor2:pi3-kinase:ptdins-3-kinase:pi3k] [gn:tor2:dn2] [gtcfc:3.4.8.1:8.2:12.8] [ec:2.7.1.137] [keggfc:8.1] [sgdfc:1.6.1:3.1.0:3.8.0] [db:gtc-saccharomyces cer |
| CONTIG2802 | 21906312_f1_1 | 3868 | 17971 | 1083 | 361 | YKR003W | 956 | 3.0(10)-96 | *Saccharomyces cerevisiae* | [ui:ykr003w] [pn:similarity to kes1p, hes1p and osh1p:hypothetical 51.6 kd protein in pap1-mrpl13 intergenic region] [gn:yk102] [gtcfc:3.4.8.1:8.2] [keggfc:14.2] [sgdfc:1.6.1] [db:gtc-saccharomyces cerevisiae] |
| CONTIG2802 | 14665632_f3_3 | 3869 | 17972 | 327 | 109 | YKR003W | 244 | 2.8(10)-20 | *Saccharomyces cerevisiae* | [ui:ykr003w] [pn:similarity to kes1p, hes1p and osh1p:hypothetical 51.6 kd protein in pap1-mrpl13 intergenic region] [gn:yk102] [gtcfc:3.4.8.1:8.2] [keggfc:14.2] [sgdfc:1.6.1] [db:gtc-saccharomyces cerevisiae] |
| CONTIG3959 | 85753_f3_5 | 3870 | 17973 | 1122 | 374 | YLR056W | 879 | 1.2(10)-93 | *Saccharomyces cerevisiae* | [ui:ylr056w] [pn:c-5 sterol desaturase] [gn:erg3:syr:l2150] [gtcfc:3.4.8.1:8.2:12.16] [ec:1.-.-.-] [keggfc:14.1] [sgdfc:1.6.1:9.4.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5660 | 14953268_f2_9 | 3871 | 17974 | 1926 | 642 | YLR133W | 648 | 6.2(10)-72 | Saccharomyces cerevisiae | [ui:ylr133w] [pn:choline kinase] [gn:cki1:cki1:l3130:l9606] [gtcfc:3.4.8.1:8.2] [ec:2.7.1.32] [keggfc:8.1] [sgdfc:1.6.1:9.2.0] [db:gtc-saccharomyces cerevisiae] |
| CONTIG5233 | 506262_c1_8 | 3872 | 17975 | 969 | 323 | YML131W | 460 | 1.1(10)-43 | Saccharomyces cerevisiae | [ui:yml131w] [pn:similarity to human leukotriene b4 12-hydroxydehydrogenase] [gtcfc:3.4.8.1:8.2] [keggfc:14.2] [sgdfc:1.6.1] [db:gtc-saccharomyces cerevisiae] |
| CONTIG3880 | 23609675_f1_1 | 3873 | 17976 | 1164 | 388 | YML008C | 1288 | 1.8(10)-131 | Saccharomyces cerevisiae | [ui:yml008c] [pn:s-adenosyl-methionine delta-24-sterol-c-methyltransferase:delta:24-sterol c-methyltransferase] [gn:erg6:sed6:ise1:lis1:ym9571] [gtcfc:3.4.8.1:8.2] [ec:2.1.1.41] [keggfc:14.1] [sgdfc:1.6.1] [db-gtc-saccharomyces cerev |
| CONTIG1458 | 1055313_f1_1 | 3874 | 17977 | 840 | 280 | YMR296C | 462 | 6.5(10)-44 | Saccharomyces cerevisiae | [ui:ymr296c] [pn:serine c-palmitoyltransferase subunit:serine patmitoyltransferase 1:long chain base biosynthesis protein 1:spt 1] [gn:lcb1] [gtcfc:3.4.8.1:8.2:8.5] [ec:2.3.1.50] [keggfc:8.5] [sgdfc:1.6.1] [db-gtc-saccharomyces cerevi |
| CONTIG3044 | 24647501_f2_3 | 3875 | 17978 | 534 | 178 | YNL280C | 270 | 3.1(10)-23 | Saccharomyces cerevisiae | [ui:ynl280c] [pn:c-14 sterol reductase] [gn:erg24:n0593] [gtcfc:3.4.8.1:8.2] [ec:1.-.-.-] [keggfc:14.1] [sgdfc:1.6.1] [db-gtc-saccharomyces cerevisiae] |
| CONTIG1381 | 242010_f2_3 | 3876 | 17979 | 726 | 242 | YNL111C | 191 | 3.3(10)-15 | Saccharomyces cerevisiae | [ui:ynl111c] [pn:cytochrome b5] [gn:cyb5:n1949] [gtcfc:3.4.8.1:8.2] [keggfc:14.2] [sgdfc:1.6.1] [db-gtc-saccharomyces cerevisiae] |
| CONTIG3299 | 12995686_f3_2 | 3877 | 17980 | 1290 | 430 | YNL045W | 1010 | 5.5(10)-102 | Saccharomyces cerevisiae | [ui:ynl045w] [pn:strong similarity to human leukotriene a-4 hydrolase:probable leukotriene a-4 hydrolase:leukotriene a:4 hydrolase] [gn:n2535] [gtcfc:3.4.8.1:8.2] [ec:3.3.2.6] [keggfc:8.6] [sgdfc:1.6.1] [db-gtc-saccharo |
| CONTIG3906 | 13953535_f2_5 | 3878 | 17981 | 357 | 119 | YNL045W | 135 | 4.2(10)-8 | Saccharomyces cerevisiae | [ui:ynl045w] [pn:strong similarity to human leukotriene a-4 hydrolase:probable leukotriene a-4 hydrolase:leukotriene a-4 hydrolase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4024 | 26432750_c3_6 | 3879 | 17982 | 1260 | 420 | YNR019W | 677 | 3.5(10)-92 | Saccharomyces cerevisiae | [ui:ynr019w] [pn:acyl-coa sterol acyltransferase:sterol o-acyltransferase 2:sterol-ester synthase 2] [gn:arc2:sat1:n3206] [gcfc:3.4.3.5:8.1:8.2:12.15] [ec:2.3.1.26] [keggfc:3.5] [sgdfc:1.6.1:3.4.0] [db:gtc-saccharomyces cerevisiae] |
| CONTIG5797 | 10582762_c3_30 | 3880 | 17983 | 1335 | 445 | YPL145C | 1191 | 3.7(10)-121 | Saccharomyces cerevisiae | [ui:ypl145c] [pn:involved in ergosterol biosynthesis:kes1 protein] [gn:kes1:lpi3:cp2614] [gcfc:3.4.8.1:8.2:12.10] [keggfc:14.2] [sgdfc:1.6.1.8.3.0:9.2.0] [db:gtc-saccharomyces cerevisiae] |
| CONTIG5810 | 4407203_c3_36 | 3881 | 17984 | 798 | 266 | YPL076W | 251 | 1.5(10)-21 | Saccharomyces cerevisiae | [ui:ypl076w] [pn:n-acetylglucosaminyl-phosphatidylinositol biosynthetic protein:n-acetylglucosaminyl-phosphatidylinositol biosynthetic protein gpi2] [gn:gpi2:gcr4:lpf9w] [gcfc:3.4.8.1:8.2] [keggfc:14.2] [sgdfc:1.6.1] [db:gtc-saccharo] |
| CONTIG2518 | 20586442_f2_2 | 3882 | 17985 | 498 | 166 | YPL069C | 223 | 1.3(10)-18 | Saccharomyces cerevisiae | [ui:ypl069c] [pn:geranylgeranyl diphosphate synthase] [gn:bts1] [gcfc:3.4.8.1:8.2] [keggfc:14.2] [sgdfc:1.6.1] [db:gtc-saccharomyces cerevisiae] |
| CONTIG4222 | 20578786_c2_13 | 3883 | 17986 | 486 | 162 | YPL069C | 148 | 5.0(10)-10 | Saccharomyces cerevisiae | [ui:ypl069c] [pn:geranylgeranyl diphosphate synthase] [gn:bts1] [gcfc:3.4.8.1:8.2] [keggfc:14.2] [sgdfc:1.6.1] [db:gtc-saccharomyces cerevisiae] |
| CONTIG3382 | 14097510_f3_4 | 3884 | 17987 | 747 | 249 | YPR113W | 550 | 3.1(10)-53 | Saccharomyces cerevisiae | [ui:ypr113w] [pn:cdp diacylglycerol--inositol 3-phosphatidyltransferase:cdp-diacylglycerol--inositol 3-phosphatidyltransferase:phosphatidylinositol synthase] [gn:pis1:pis:p8283] [gcfc:3.4.8.1:8.2:12.16] [ec:2.7.8.11] [keggfc:8.1] [s |
| CONTIG4607 | 26204657_f1_1 | 3885 | 17988 | 456 | 152 | YBR034C | 601 | 1.2(10)-58 | Saccharomyces cerevisiae | [ui:ybr034c] [pn:hnrnp methyltransferase:hnrmp arginine n- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4607 | 26441635_f1_2 | 3886 | 17989 | 591 | 197 | YBR034C | 506 | 1.3(10)-48 | Saccharomyces cerevisiae | methyltransferase:odp1 protein] [gn:hmt1:odp1:rmt1:ybr0320] [gtcfc:3.7:5.11:5.14:9.12:10.1:10.2: 10.7] [ec:2.1.1.-] [keggfc:3.7:5.11:5.14:9.13] [sgdfc:3.0:9.5.0] [db:gtc-sacch [ui:ybr034c] [pn:hnrnp methyltransferase:hnmp arginine n- methyltransferase:odp1 protein] [gn:hmt1:odp1:rmt1:ybr0320] [gtcfc:3.7:5.11:5.14:9.12:10.1:10.2: 10.7] [ec:2.1.1.-] [keggfc:3.7:5.11:5.14:9.13] |
| CONTIG5565 | 23848387_f2_6 | 3887 | 17990 | 999 | 333 | YPL266W | 1320 | 7.9(10)-135 | Saccharomyces cerevisiae | [sgdfc:6.3:0.9.5.0] [db:gtc-sacch [ui:ypl266w] [pn:rrna:adenine- n6,n6- dimethyltransferase:dimethyl- adenosine transferase:s- adenosylmethionine-6-n", n"- adenosyl:rrna dimethyltransferase:18s rrna dimethylase] [gn:dim1] [gtcfc:3.7:5.14:9.12:10.1:10.2: 10.3] [ec:2.1.1 |
| CONTIG2392 | 21989575_c1_2 | 3888 | 17991 | 948 | 316 | YAR015W | 931 | 1.3(10)-93 | Saccharomyces cerevisiae | [ui:yar015w] [pn:phosphoribosylamidoimidazole- succinocarboxamide synthase:saicar synthetase] [gn:ade1] [gtcfc:4.1] [ec:6.3.2.6] [keggfc:4.1] [sgdfc:1.3.1] [db:gtc- saccharomyces cerevisiae] |
| CONTIG5717 | 196076_c2_15 | 3889 | 17992 | 393 | 131 | YDL150W | 147 | 1.1(10)-9 | Saccharomyces cerevisiae | [ui:ydl150w] [pn:dna-directed rna polymerase iii, 47 kd subunit:dna- directed rna polymerase iii 47 kd polypeptide:c53:rna polymerase c subunit 4] [gn:rpc4:rpc53:d1557] [gtcfc:4.1.4.2:10.1:10.2:10.3] [ec:2.7.7.6] [keggfc:4.1.4.2] [sgdf |
| CONTIG2231 | 2507812_f2_1 | 3890 | 17993 | 771 | 257 | YDL140C | 904 | 1.5(10)-89 | Saccharomyces cerevisiae | [ui:ydl140c] [pn:dna-directed rna polymerase ii, 215 kd subunit:dna- directed rna polymerase ii largest subunit:b220] [gn:rpb1:rpo21:rpb220:sua8:d2150] [gtcfc:4.1.4.2:10.1:10.2] [ec:4.1.4.2] [keggfc:4.1.4.2] |
| CONTIG2835 | 11761285_c3_10 | 3891 | 17994 | 1116 | 372 | YDL140C | 1462 | 7.0(10)-150 | Saccharomyces cerevisiae | [sgdfc:4.8.1.9.5.0] [db:gtc [ui:ydl140c] [pn:dna-directed rna polymerase ii, 215 kd subunit:dna- directed rna polymerase ii largest |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2835 | 22662842_c3_9 | 3892 | 17995 | 735 | 245 | YDL140C | 1099 | 1.5(10)-110 | Saccharomyces cerevisiae | subunit:b220] [gn:rpb1:rpo21:rpb220:sua8:d2150] [ui:ydl140c] [pn:dna-directed rna polymerase ii, 215 kd subunit:dna-directed rna polymerase ii largest subunit:b220] [gtcfc:4.1.4.2:10.1:10.2] [ec:2.7.7.6] [keggfc:4.1:4.2] [sgdfc:4.8.1:9.5.0] [db:gtc |
| CONTIG5417 | 31683333_f3_6 | 3893 | 17996 | 1341 | 447 | YDL140C | 669 | 1.8(10)-64 | Saccharomyces cerevisiae | subunit:b220] [gn:rpb1:rpo21:rpb220:sua8:d2150] [ui:ydl140c] [pn:dna-directed rna polymerase ii, 215 kd subunit:dna-directed rna polymerase ii largest subunit:b220] [gtcfc:4.1.4.2:10.1:10.2] [ec:2.7.7.6] [keggfc:4.1:4.2] [sgdfc:4.8.1:9.5.0] [db:gtc |
| CONTIG810 | 10833318_f1_1 | 3894 | 17997 | 732 | 244 | YDL140C | 769 | 4.0(10)-75 | Saccharomyces cerevisiae | subunit:b220] [gn:rpb1:rpo21:rpb220:sua8:d2150] [ui:ydl140c] [pn:dna-directed rna polymerase ii, 215 kd subunit:dna-directed rna polymerase ii largest subunit:b220] [gtcfc:4.1.4.2:10.1:10.2] [ec:2.7.7.6] [keggfc:4.1:4.2] [sgdfc:4.8.1:9.5.0] [db:gtc |
| CONTIG4028 | 2347026_f1_1 | 3895 | 17998 | 2163 | 721 | YDL102W | 2301 | 8.8(10)-239 | Saccharomyces cerevisiae | [ui:ydl102w] [pn:dna-directed dna polymerase delta, catalytic 125 kd subunit:dna polymerase delta large chain:dna polymerase iii] [gn:pol3:cdc2:tex1:d2366] [gtcfc:4.1.4.2:10.1:10.10.2:10.8:12.8] [ec:2.7.7.7] [keggfc:4.1.4.2:13.3] [ |
| CONTIG5053 | 33787811_f2_4 | 3896 | 17999 | 480 | 160 | YDR156W | 90 | 0.003 | Saccharomyces cerevisiae | [ui:ydr156w] [pn:dna-directed rna polymerase i, a14 subunit:dna-directed rna polymerase i 14 kd polypeptide:a14] [gn:rpa14:yd8358] [gtcfc:4.1.4.2:10.1:10.2:10.3] [ec:2.7.7.6] [keggfc:4.1:4.2] [sgdfc:4.1.0:9.5.0] [db:gtc-saccharomyces |
| CONTIG3853 | 1214525_c3_7 | 3897 | 18000 | 675 | 225 | YDR226W | 826 | 1.8(10)-82 | Saccharomyces cerevisiae | [ui:ydr226w] [pn:adenylate kinase, cytosolic:adenylate kinase cytosolic:atp- amp |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2602 | 24792827_c1_4 | 3898 | 18001 | 819 | 273 | YDR408C | 483 | 3.8(10)-46 | Saccharomyces cerevisiae | transphosphorylase] [gn:adk1:aky1:akyraky2:yd9934] [gtcfc:4.1:12.13] [ec:2.7.4.3] [keggfc:4.1] [sgdfc:1.3.8:9.2.0] [db:gtc-saccharomyces cerevisiae] [ui:ydr408c] [pn:phosphoribosylglycinamide formyltransferase:gart:gar transformylase:5''-phosphoribosylglycinamide transformylase] [gn:ade8:d9509] [gtcfc:4.19.6] [ec:2.1.2.2] [keggfc:4.19.8] [sgdfc:1.3.1:9.2.0] [db:gtc-saccharomyces |
| CONTIG2638 | 33204635_c2_5 | 3899 | 18002 | 411 | 137 | YDR454C | 495 | 2.1(10)-47 | Saccharomyces cerevisiae | [ui:ydr454c] [pn:guanylate kinase:gmp kinase] [gn:guk1:d9461] [gtcfc:4.1:12.13] [ec:2.7.4.8] [keggfc:4.1] [sgdfc:1.3.8] [db:gtc-saccharomyces cerevisiae] |
| CONTIG1452 | 16302268_f1_1 | 3900 | 18003 | 948 | 316 | YDR530C | 266 | 4.9(10)-31 | Saccharomyces cerevisiae | [ui:ydr530c] [pn:atp adenylyltransferase ii:5'',5'''''-p-1,p-4-tetraphosphate phosphorylase ii:ap-4-a phosphorylase ii:atp adenylyltransferase:cap,a phosphorylase ii] [gn:apa2:d9719] [gtcfc:4.1] [ec:2.7.7.53] [keggfc:4.1] [sgdfc:1.3.4] |
| CONTIG5136 | 78130_c2_7 | 3901 | 18004 | 2661 | 887 | YER070W | 3253 | 0 | Saccharomyces cerevisiae | [ui:yer070w] [pn:ribonucleoside-diphosphate reductase, large subunit:ribonucleoside-diphosphate reductase large chain 1: ribonucleotide reductase] [gn:rnr1] [gtcfc:4.1:4.2:10.8:12.8] [ec:1.17.4.1] [keggfc:4.1:4.2:13.2] [sgdfc:1.3.3.6 |
| CONTIG5807 | 10548267_f2_2 | 3902 | 18005 | 2253 | 751 | YER070W | 2376 | 2.6(10)-252 | Saccharomyces cerevisiae | [ui:ycr070w] [pn:ribonucleoside-diphosphate reductase, large subunit:ribonucleoside-diphosphate reductase large chain 1:ribonucleotide reductase] [gn:rnr1] [gtcfc:4.1:4.2:10.8:12.8] [ec:1.17.4.1] [keggfc:4.1:4.2:13.2] [sgdfc:1.3.3.6 |
| CONTIG5743 | 2148252_f1_6 | 3903 | 18006 | 2493 | 831 | YGL234W | 2569 | 3.5(10)-267 | Saccharomyces cerevisiae | [ui:ygl234w] [pn:phosphoribosylamine-glycine ligase and phosphoribosylformylglycinamidine cyclo-ligase] [gn:ade5:7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4022 | 10193966_c3_4 | 3904 | 18007 | 432 | 144 | YGL070C | 383 | 1.5(10)-35 | Saccharomyces cerevisiae | [gtcfc:4.1] [keggfc:4.1] [sgdfc:1.3.1] [dbgtc-saccharomyces cerevisiae] [ui:ygl070c] [pn:dna-directed rna polymerase ii, 14.2 kd subunit:dna-directed rna polymerase ii 14.2 kd polypeptide:b12.6] [gn:rpb9] [gtcfc:4.1.4.2:10.1:10.2] [ec:2.7.7.6] [keggfc:4.1:4.2] [sgdfc:4.8.1:9.5.0] [dbgtc-saccharomyces cer |
| CONTIG2815 | 21876_c3_1 | 3905 | 18008 | 1512 | 504 | YGR061C | 1316 | 2.1(10)-134 | Saccharomyces cerevisiae | [ui:ygr061c] [pn:5''-phosphoribosylformyl glycinamidine synthetase:phosphoribosylformyl-glycinamidine synthase:fgam synthase:formylglycineamide ribotide amidotransferase:fgarat] [gn:ade6] [gtcfc:4.1] [ec:6.3.5.3] [keggfc:4.1] [sgdfc:1.3] |
| CONTIG5777 | 12947078_c1_18 | 3906 | 18009 | 618 | 206 | YGR061C | 552 | 3.5(10)-52 | Saccharomyces cerevisiae | [ui:ygr061c] [pn:5''-phosphoribosylformyl glycinamidine synthetase:phosphoribosylformyl-glycinamidine synthase:fgam synthase:formylglycineamide ribotide amidotransferase:fgarat] [gn:ade6] [gtcfc:4.1] [ec:6.3.5.3] [keggfc:4.1] [sgdfc:1.3] |
| CONTIG5777 | 16672192_c3_25 | 3907 | 18010 | 660 | 220 | YGR061C | 712 | 2.5(10)-69 | Saccharomyces cerevisiae | [ui:ygr061c] [pn:5''-phosphoribosylformyl glycinamidine synthetase:phosphoribosylformyl-glycinamidine synthase:fgam synthase:formylglycineamide ribotide amidotransferase:fgarat] [gn:ade6] [gtcfc:4.1] [ec:6.3.5.3] [keggfc:4.1] [sgdfc:1.3] |
| CONTIG5777 | 17087514_c1_16 | 3908 | 18011 | 1155 | 385 | YGR061C | 1294 | 4.5(10)-132 | Saccharomyces cerevisiae | [ui:ygr061c] [pn:5''-phosphoribosylformyl glycinamidine synthetase:phosphoribosylformyl-glycinamidine synthase:fgam synthase:formylglycineamide ribotide amidotransferase:fgarat] [gn:ade6] [gtcfc:4.1] [ec:6.3.5.3] [keggfc:4.1] [sgdfc:1.3] |
| CONTIG2819 | 7120275_c2_2 | 3909 | 18012 | 897 | 299 | YHR201C | 293 | 2.3(10)-31 | Saccharomyces cerevisiae | [ui:yhr201c] [pn:exopolyphosphatase:metaphos- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5807 | 5078401_f3_6 | 3910 | 18013 | 285 | 95 | YIL066C | 95 | 0.00119 | Saccharomyces cerevisiae | phatase] [gn:ppx1] [gcfc:4.1:3.10] [ec:3.6.1.11] [keggfc:4.1] [sgdfc:1.4.1:9.2.0] [db-gtc-saccharomyces cerevisiae] [ui:yil066c] [pn:ribonucleotide reductase, repair inducible large subunit:ribonucleoside-diphosphate reductase large chain 2:ribonucleotide reductase:ribonucleotide reductase dna damage- inducible regulatory subunit] [gn:rnr3:din1] [gt |
| CONTIG1887 | 14648437_f1_2 | 3911 | 18014 | 456 | 152 | YIL021W | 343 | 2.7(10)-31 | Saccharomyces cerevisiae | [ui:yil021w] [pn:dna-directed rna-polymerase ii, 45 kd:dna-directed rna polymerase ii 45 kd polypeptide:b44.5] [gn:rpb3] [gcfc:4.1:4.2:10.1:10.2] [ec:2.7.7.6] [keggfc:4.1:4.2] [sgdfc:4.8.1:9.5.0] [db-gtc-saccharomyces cerevisiae] |
| CONTIG5137 | 24414062_c1_9 | 3912 | 18015 | 1074 | 358 | YIL021W | 896 | 6.7(10)-90 | Saccharomyces cerevisiae | [ui:yil021w] [pn:dna-directed rna-polymerase ii, 45 kd:dna-directed rna polymerase ii 45 kd polypeptide:b44.5] [gn:rpb3] [gcfc:4.1:4.2:10.1:10.2] [ec:2.7.7.6] [keggfc:4.1:4.2] [sgdfc:4.8.1:9.5.0] [db-gtc-saccharomyces cerevisiae] |
| CONTIG2481 | 36111703_f3_3 | 3913 | 18016 | 549 | 183 | YIL140W | 194 | 1.6(10)-15 | Saccharomyces cerevisiae | [ui:yil140w] [pn:dna-directed rna polymerase ii, 32 kda subunit:dna-directed rna polymerase ii 32 kd polypeptide:b32] [gn:rpb4:j0654] [gcfc:4.1:4.2:10.1:10.2] [ec:2.7.7.6] [keggfc:4.1:4.2] [sgdfc:4.8.1:9.5.0] [db-gtc-saccharomyces ce |
| CONTIG5239 | 14640628_f1_1 | 3914 | 18017 | 1236 | 412 | YIL026W | 1401 | 2.1(10)-143 | Saccharomyces cerevisiae | [ui:yil026w] [pn:ribonucleoside-diphosphate reductase, small subunit:ribonucleoside-diphosphate reductase small chain 1:ribonucleotide reductase] [gn:rnr2:j1271] [gtcfc:4.1:4.2:10.8] [ec:1.17.4.1] [keggfc:4.1:4.2] [sgdfc:1.3.3.6.0] |
| CONTIG5714 | 22381317_c2_20 | 3915 | 18018 | 1083 | 361 | YIL026W | 1149 | 1.0(10)-116 | Saccharomyces cerevisiae | [ui:yil026w] [pn:ribonucleoside-diphosphate reductase, small subunit:ribonucleoside-diphosphate reductase small chain 1:ribonucleotide reductase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2234 | 21678181_c2_6 | 3916 | 18019 | 1059 | 353 | YJL005W | 97 | 0.20999 | Saccharomyces cerevisiae | [gn:mr2;j1271] [gtcfc:4.1:4.2:10.8] [ec:1.17.4.1] [keggfc:4.1:4.2] [sgdfc:1.3.3.3.6.0] [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] [sgdfc:1.3.4:3.8.0:9.1.0:10.4.3] [db:gtc-saccharomyces cerevisiae] |
| CONTIG3421 | 24323555_c1_7 | 3917 | 18020 | 2085 | 695 | YJL005W | 1216 | 9.4(10)-123 | Saccharomyces cerevisiae | [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] [sgdfc:1.3.4:3.8.0:9.1.0:10.4.3] [db:gtc-saccharomyces cerevisiae] |
| CONTIG3985 | 14117003_f3_7 | 3918 | 18021 | 705 | 235 | YJL005W | 377 | 3.0(10)-33 | Saccharomyces cerevisiae | [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] [sgdfc:1.3.4:3.8.0:9.1.0:10.4.3] [db:gtc-saccharomyces cerevisiae] |
| CONTIG4866 | 23531307_f2_3 | 3919 | 18022 | 1272 | 424 | YJL005W | 146 | 2.2(10)-6 | Saccharomyces cerevisiae | [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] [sgdfc:1.3.4:3.8.0:9.1.0:10.4.3] [db:gtc-saccharomyces cerevisiae] |
| CONTIG5507 | 3960080_f2_5 | 3920 | 18023 | 1902 | 634 | YJL005W | 127 | 0.00044 | Saccharomyces cerevisiae | [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] [sgdfc:1.3.4:3.8.0:9.1.0:10.4.3] [db:gtc-saccharomyces cerevisiae] |
| CONTIG5692 | 21650260_f1_1 | 3921 | 18024 | 777 | 259 | YJL005W | 102 | 0.042 | Saccharomyces cerevisiae | [ui:yjl005w] [pn:adenylate cyclase:atp pyrophosphate-lyase:adenylyl cyclase] [gn:cyr1:cdc35:hsr1:sra4;j1401] [gtcfc:4.1:11.1:12.13:12.8] [ec:4.6.1.1] [keggfc:4.1:13.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG88 | 26690930_f3_2 | 3922 | 18025 | 609 | 203 | YJL005W | 188 | 3.7(10)-13 | Saccharomyces cerevisiae | [sgdfc:1.3.4.3.8.0:9.1.0:10.4.3] [db:gtc-saccharomyces cerevisiae] [ui:yjl005w] [pn:adenylate cyclase:atp pyrophosphate-lyase:adenylyl cyclase] [gn:cyr1:cdc35:hsr1:sra4:j1401] [gtcfc:4.1.11.1:12.13:12.8] [ec:4.6.1.1] [keggfc:4.1.13.1] [sgdfc:1.3.4.3.8.0:9.1.0:10.4.3] |
| CONTIG5230 | 4490806_f2_11 | 3923 | 18026 | 381 | 127 | YJR063W | 481 | 6.4(10)-46 | Saccharomyces cerevisiae | [ui:yjr063w] [pn:rna-directed rna polymerase i, 13.7 kd subunit:dna-directed rna polymerase i 13.7 kd polypeptide:a12.2] [gn:rpa12:rrn4:j1747] [gtcfc:4.1.4.2:10.1:10.2:10.3] [ec:2.7.7.6] [keggfc:4.1.4.2] [sgdfc:4.1.0:9.5.0] [db:gtc-sa |
| CONTIG5131 | 31447187_c1_4 | 3924 | 18027 | 1098 | 366 | YJR105W | 735 | 7.7(10)-73 | Saccharomyces cerevisiae | [ui:yjr105w] [pn:strong similarity to human adenosine kinase:putative adenosine kinase] [gn:j1973] [gtcfc:4.1] [ec:2.7.1.20] [keggfc:4.1] [sgdfc:1.3.1] [db:gtc-saccharomyces cerevisiae] |
| CONTIG3012 | 5863775_f1_1 | 3925 | 18028 | 519 | 173 | YKL144C | 476 | 2.2(10)-45 | Saccharomyces cerevisiae | [ui:ykl144c] [pn:dna-directed rna polymerase iii, 25 kd subunit:dna-directed rna polymerase iii 25 kd polypeptide:c25] [gn:rpc2s:ykl1:unf1] [gtcfc:4.1.4.2:10.1:10.2:10.3] [ec:2.7.7.6] [keggfc:4.1.4.2] [sgdfc:4.1.0:4.4.0:9.5.0] [db:gtc |
| CONTIG5212 | 10975300_c3_18 | 3926 | 18029 | 462 | 154 | YKL067W | 571 | 1.8(10)-55 | Saccharomyces cerevisiae | [ui:ykl067w] [pn:nucleoside diphosphate kinase:ndp kinase] [gn:ndk1:ynk1:ynk:ykl333] [gtcfc:4.1.4.2:12.13] [ec:2.7.4.6] [keggfc:4.1.4.2] [sgdfc:1.3.8:9.2.0] [db:gtc-saccharomyces cerevisiae] |
| CONTIG2321 | 20709436_c3_9 | 3927 | 18030 | 516 | 172 | YLR432W | 585 | 6.0(10)-57 | Saccharomyces cerevisiae | [ui:ylr432w] [pn:strong similarity to imp dehydrogenases, pur5p and yml056c:probable inosine-5'-monophosphate dehydrogenase:impd] [gn:l9753] [gtcfc:4.1] [ec:1.1.1.205] [keggfc:4.1] |
| CONTIG2321 | 35189768_c2_7 | 3928 | 18031 | 195 | 65 | YLR432W | 238 | 2.2(10)-19 | Saccharomyces cerevisiae | [sgdfc:1.3.1] [db:gtc-sacchar [ui:ylr432w] [pn:strong similarity to imp dehydrogenases, pur5p and |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2321 | 10553150_c2_6 | 3929 | 18032 | 348 | 116 | YML056C | 264 | 3.1(10)-22 | Saccharomyces cerevisiae | yml056c:probable inosine-5"-monophosphate dehydrogenase:imp dehydrogenase:impdb:impd [gn:19753] [gtcfc:4.1] [ec:1.1.1.205] [keggfc:4.1] [sgdfc:1.3.1] [db:gtc-sacchar [ui:yml056c] [pn:strong similarity to imp dehydrogenases:probable inosine-5"-monophosphate dehydrogenase:imp dehydrogenase:impdb:impd [gn:ym9958] [gtcfc:4.1] [ec:1.1.1.205] [keggfc:4.1] [sgdfc:1.3.1] [db:gtc-saccharomyces cerevisiae] |
| CONTIG5734 | 21879412_f2_3 | 3930 | 18033 | 600 | 200 | YML022W | 616 | 3.2(10)-60 | Saccharomyces cerevisiae | [ui:yml022w] [pn:adenine phosphoribosyltransferase:adenine phosphoribosyltransferase 1:apt1] [gn:apt1] [gtcfc:4.1] [ec:2.4.2.7] [keggfc:4.1] [sgdfc:1.3.1] [db:gtc-saccharomyces cerevisiae] |
| CONTIG2652 | 24220307_f2_3 | 3931 | 18034 | 252 | 84 | YMR120C | 342 | 1.3(10)-30 | Saccharomyces cerevisiae | [ui:ymr120c] [pn:strong similarity to chicken purh bifunctional enzyme:phosphoribosylaminoimid azolecarboxamide formyltransferase 2:aicar transformylase/imp cyclohydrolase:inosinicase:imp synthetase:atic] [gn:ade17:ym8564] [gtcfc:4.1] |
| CONTIG5413 | 5292599_c1_13 | 3932 | 18035 | 1314 | 438 | YMR120C | 1757 | 3.8(10)-181 | Saccharomyces cerevisiae | [ui:ymr120c] [pn:strong similarity to chicken purh bifunctional enzyme:phosphoribosylaminoimid azolecarboxamide formyltransferase 2:aicar transformylase/imp cyclohydrolase:inosinicase:imp synthetase:atic] |
| CONTIG3970 | 29961567_c3_13 | 3933 | 18036 | 633 | 211 | YMR217W | 860 | 4.4(10)-86 | Saccharomyces cerevisiae | [gn:ade17:ym8564] [gtcfc:4.1: [ui:ymr217w] [pn:glutamine-hydrolyzing:gmp synthase:glutamine-hydrolysing:glutamine amidotransferase:gmp synthetase [gn:gua1:ym8261] [keggfc:4.1:5.1] [ec:6.3.5.2] [keggfc:4.1:5.1] [sgdfc:1.3.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3970 | 4725875_c1_10 | 3934 | 18037 | 987 | 329 | YMR217W | 1214 | 1.3(10)-123 | *Saccharomyces cerevisiae* | [ui:ymr217w] [pn:glutamine-hydrolyzing:gmp synthase:glutamine-hydrolysing:glutamine amidotransferase:gmp synthetase] [gn:gua1:ym8261] [keggfc:4.1:5.1] [ec:6.3.5.2] [keggfc:4.1:5.1] [sgdfc:1.3.1] [db:gtc-*saccharomyces cerevisiae*] |
| CONTIG4054 | 19534511_f3_2 | 3935 | 18038 | 1629 | 543 | YMR300C | 1726 | 7.2(10)-182 | *Saccharomyces cerevisiae* | [ui:ymr300c] [pn:amidophosphoribosyltransferase:glutamine phosphoribosylpyrophosphate amidotransferase:atase] [gn:ade4:ym99s2] [gtcfc:4.1:5.1] [ec:2.4.2.14] [keggfc:4.1:5.1] [sgdfc:1.3.1] [db:gtc-*saccharomyces cerevisiae*] |
| CONTIG1807 | 23945782_c1_1 | 3936 | 18039 | 576 | 192 | YNL262W | 179 | 2.0(10)-15 | *Saccharomyces cerevisiae* | [ui:ynl262w] [pn:dna-directed dna polymerase epsilon, catalytic subunit a:dna polymerase epsilon, catalytic subunit a:dna polymerase ii subunit a] [gn:pol2:dun2:n0825] [gtcfc:4.1:4.2:10.1:10.10:10.2:10.8:12.8] [ec:2.7.7.7] [keggfc:4.1] |
| CONTIG3404 | 10198957_f2_1 | 3937 | 18040 | 1839 | 613 | YNL262W | 1408 | 3.5(10)-143 | *Saccharomyces cerevisiae* | [ui:ynl262w] [pn:dna-directed dna polymerase epsilon, catalytic subunit a:dna polymerase epsilon, catalytic subunit a:dna polymerase ii subunit a] [gn:pol2:dun2:n0825] [gtcfc:4.1:4.2:10.1:10.10:10.2:10.8:12.8] [ec:2.7.7.7] [keggfc:4.1] |
| CONTIG650 | 255192_f1_1 | 3938 | 18041 | 699 | 233 | YNL262W | 1076 | 1.3(10)-107 | *Saccharomyces cerevisiae* | [ui:ynl262w] [pn:dna-directed dna polymerase epsilon, catalytic subunit a:dna polymerase epsilon, catalytic subunit a:dna polymerase ii subunit a] [gn:pol2:dun2:n0825] [gtcfc:4.1:4.2:10.1:10.10:10.2:10.8:12.8] [ec:2.7.7.7] [keggfc:4.1] |
| CONTIG650 | 781538_f1_2 | 3939 | 18042 | 459 | 153 | YNL262W | 539 | 2.0(10)-50 | *Saccharomyces cerevisiae* | [ui:ynl262w] [pn:dna-directed dna polymerase epsilon, catalytic subunit a:dna polymerase epsilon, catalytic subunit a:dna polymerase ii subunit a] [gn:pol2:dun2:n0825] [gtcfc:4.1:4.2:10.1:10.10:10.2:10.8:12.8] [ec:2.7.7.7] [keggfc:4.1] |
| blx18543.y | 21519057_c3_2 | 3940 | 18043 | 525 | 175 | YNL262W | 701 | 1.2(10)-67 | *Saccharomyces cerevisiae* | [ui:ynl262w] [pn:dna-directed dna polymerase epsilon, catalytic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| blx18984.y | 19689090_c1_2 | 3941 | 18044 | 522 | 174 | YNL262W | 355 | 7.5(10)-31 | Saccharomyces cerevisiae | catalytic subunit a:dna polymerase ii subunit a] [gn:pol2:dun2:n0825] [gtcfc:4.1.4.2:10.1:10.10:10.2:10.8:12.8] [ec:2.7.7.7] [keggfc:4.1 [ui:ynl262w] [pn:dna-directed dna polymerase epsilon, catalytic subunit a:dna polymerase epsilon, catalytic subunit a:dna polymerase ii subunit a] [gn:pol2:dun2:n0825] [gtcfc:4.1.4.2:10.1:10.10:10.2:10.8:12.8] [ec:2.7.7.7] [keggfc:4.1 |
| CONTIG5289 | 33618885_c3_14 | 3942 | 18045 | 1197 | 399 | YNL248C | 1049 | 4.0(10)-106 | Saccharomyces cerevisiae | [ui:ynl248c] [pn:dna-directed rna polymerase a:i chain, 46 kda:dna-directed rna polymerase i 49 kd polypeptide:a49] [gn:rpa49:rrn 13:n0880] [gtcfc:4.1.4.2:10.1:10.2:10.3] [ec:2.7.7.6] [keggfc:4.1:4.2] |
| CONTIG5615 | 34064057_f2_9 | 3943 | 18046 | 1302 | 434 | YNL220W | 1553 | 1.6(10)-159 | Saccharomyces cerevisiae | [ui:ynl220w] [pn:adenylosuccinate synthetase:imp-aspartate ligase] [gn:ade12:n1290] [gtcfc:4.1:5.2:10.1:10.2] [ec:6.3.4.4] [keggfc:4.1:5.2] [sgdfc:1.3.1:9.5.0] [db:gtc-saccharomyces cerevisiae] |
| CONTIG4968 | 21619037_c2_3 | 3944 | 18047 | 1074 | 358 | YNL141W | 1117 | 2.6(10)-113 | Saccharomyces cerevisiae | [ui:ynl141w] [pn:similarity to adenosine deaminase;probable adenosine deaminase:adenosine aminohydrolase] [gn:n1208:n1825] [gtcfc:4.1] [ec:3.5.4.4] [keggfc:4.1] [sgdfc:1.3.1] [db:gtc-saccharomyces cerevisiae] |
| CONTIG4701 | 815686_c2_11 | 3945 | 18048 | 195 | 65 | YNL113W | 116 | 3.0(10)-7 | Saccharomyces cerevisiae | [ui:ynl113w] [pn:dna-directed rna polymerase i,ii 16 kd subunit:dna-directed rna polymerases i and iii 16 kd polypeptide:ac19] [gn:rpc19:n1937] [gtcfc:4.1.4.2:10.1:10.2:10.3] [ec:2.7.7.6] [keggfc:4.1.4.2] |
| CONTIG320 | 6835817_f2_1 | 3946 | 18049 | 711 | 237 | YNL102W | 626 | 5.0(10)-60 | Saccharomyces cerevisiae | [ui:ynl102w] [pn:dna-directed dna polymerase alpha, 180 kd subunit:dna polymerase alpha:dna polymerase i] [gn:pol1:cdc17:n2181] [gtcfc:4.1.4.2:10.1:10.2:10.8] [ec:2.7.7.7] [sgdfc:4.1.0:4.4.0:9.5.0] [d |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3485 | 10962757_c2_4 | 3947 | 18050 | 417 | 139 | YNL102W | 216 | 2.7(10)-16 | *Saccharomyces cerevisiae* | *saccharomyces cer* [ui:ynl102w] [pn:dna-directed dna polymerase alpha, 180 kd subunit:dna polymerase alpha:dna polymerase i] [gn:pol1:cdc17:n2181] [gtcfc:4.1.4.2:10.1:10.2:10.8] [ec:2.7.7.7] [keggfc:4.1:4.2] [sgdfc:3.6.0:9.5.0] [db:gtc- |
| CONTIG4421 | 11737878_c2_2 | 3948 | 18051 | 1956 | 652 | YNL102W | 1983 | 4.4(10)-205 | *Saccharomyces cerevisiae* | *saccharomyces cer* [ui:ynl102w] [pn:dna-directed dna polymerase alpha, 180 kd subunit:dna polymerase alpha:dna polymerase i] [gn:pol1:cdc17:n2181] [gtcfc:4.1.4.2:10.1:10.2:10.8] [ec:2.7.7.7] [keggfc:4.1:4.2] [sgdfc:3.6.0:9.5.0] [db:gtc- |
| CONTIG921 | 5110343_f2_2 | 3949 | 18052 | 759 | 253 | YNL102W | 298 | 5.0(10)-25 | *Saccharomyces cerevisiae* | *saccharomyces cer* [ui:ynl102w] [pn:dna-directed dna polymerase alpha, 180 kd subunit:dna polymerase alpha:dna polymerase i] [gn:pol1:cdc17:n2181] [gtcfc:4.1.4.2:10.1:10.2:10.8] [ec:2.7.7.7] [keggfc:4.1:4.2] [sgdfc:3.6.0:9.5.0] [db:gtc- |
| b3x16086.y | 6301575_c3_4 | 3950 | 18053 | 756 | 252 | YNL102W | 456 | 7.2(10)-42 | *Saccharomyces cerevisiae* | *saccharomyces cer* [ui:ynl102w] [pn:dna-directed dna polymerase alpha, 180 kd subunit:dna polymerase alpha:dna polymerase i] [gn:pol1:cdc17:n2181] [gtcfc:4.1.4.2:10.1:10.2:10.8] [ec:2.7.7.7] [keggfc:4.1:4.2] [sgdfc:3.6.0:9.5.0] [db:gtc- |
| CONTIG5595 | 85067_f2_3 | 3951 | 18054 | 1080 | 360 | YNR003C | 618 | 1.8(10)-60 | *Saccharomyces cerevisiae* | *saccharomyces cer* [ui:ynr003c] [pn:dna-directed rna polymerase iii, 34 kd subunit:dna-directed rna polymerase iii 36 kd polypeptide:c34] [gn:rpc34:n2031] [gtcfc:4.1.4.2:10.1:10.2:10.3] [ec:2.7.7.6] [keggfc:4.1:4.2] [sgdfc:4.10:4.4.0:9.5.0] [db:gtc- |
| CONTIG4369 | 4881567_f2_5 | 3952 | 18055 | 324 | 108 | YOL005C | 316 | 1.8(10)-28 | *Saccharomyces cerevisiae* | *saccharomyces sac* [ui:yol005c] [pn:dna-directed rna polymerase ii subunit, 13.6 kd:dna-directed rna polymerase ii 13.6 kd polypeptide:b13.6] [gn:rpb11] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3996 | 16663306_f3_5 | 3953 | 18056 | 531 | 177 | YOR116C | 653 | 6.5(10)-63 | Saccharomyces cerevisiae | [ui:yor116c] [pn:dna-directed rna polymerase iii, 160 kd subunit:dna-directed rna polymerase iii largest subunit:c160] [gn:rpc1:rpo31:rpc160:o3254:yor3254c] [gtcfc:4.1.4.2:10.1:10.2:10.3] [ec:2.7.7.6] [keggfc:4.1.4.2] [sgdfc:4.1.0:4.4 |
| CONTIG5508 | 4507817_c1_20 | 3954 | 18057 | 3771 | 1257 | YOR116C | 4914 | 0 | Saccharomyces cerevisiae | [ui:yor116c] [pn:dna-directed rna polymerase iii, 160 kd subunit:dna-directed rna polymerase iii largest subunit:c160] [gn:rpc1:rpo31:rpc160:o3254:yor3254c] [gtcfc:4.1.4.2:10.1:10.2:10.3] [ec:2.7.7.6] [keggfc:4.1.4.2] [sgdfc:4.1.0:4.4 |
| CONTIG3224 | 22158568_c1_5 | 3955 | 18058 | 1680 | 560 | YOR128C | 2004 | 2.6(10)-207 | Saccharomyces cerevisiae | [ui:yor128c] [pn:phosphoribosylaminoimidazole carboxylase:air carboxylase:aire] [gn:ade2:o3293:yor3293c] [gtcfc:4.1] [ec:4.1.1.21] [keggfc:4.1] [sgdfc:1.3.1] [db:gtc-saccharomyces cerevisiae |
| CONTIG2733 | 20585037_c3_4 | 3956 | 18059 | 1230 | 410 | YOR151C | 1658 | 1.2(10)-170 | Saccharomyces cerevisiae | [ui:yor151c] [pn:dna-directed rna polymerase ii, 140 kda chain:dna-directed rna polymerase ii 140 kd polypeptide:b150:rna polymerase ii subunit 2] [gn:rpb2:rpo22:rpb150] [gtcfc:4.1.4.2:10.1:10.2] [ec:2.7.7.6] [keggfc:4.1.4.2] [sgdfc:4 |
| CONTIG425 | 21564188_c3_4 | 3957 | 18060 | 993 | 331 | YOR151C | 1180 | 5.4(10)-120 | Saccharomyces cerevisiae | [ui:yor151c] [pn:dna-directed rna polymerase ii, 140 kda chain:dna-directed rna polymerase ii 140 kd polypeptide:b150:rna polymerase ii subunit 2] [gn:rpb2:rpo22:rpb150] [gtcfc:4.1.4.2:10.1:10.2] [ec:2.7.7.6] [keggfc:4.1.4.2] [sgdfc:4 |
| CONTIG5807 | 14500763_f2_3 | 3958 | 18061 | 198 | 66 | YOR207C | 137 | 5.2(10)-8 | Saccharomyces cerevisiae | [ui:yor207c] [pn:dna-directed rna polymerase iii, 130 kd subunit:dna-directed rna polymerase iii 130 kd polypeptide:c128:rna polymerase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5807 | 10738878_f3_8 | 3959 | 18062 | 3183 | 1061 | YOR207C | 4483 | 0 | Saccharomyces cerevisiae | iii subunit 2] [gn:rpc2:rpc128:ret1] [gtcfc:4.1:4.2:10.1:10.2:10.3] [ec:2.7.7.6] [kegg fc:4.1:4.2] [ui:yor207c] [pn:dna-directed rna polymerase iii, 130 kd subunit:dna-directed rna polymerase iii 130 kd polypeptide:c128:rna polymerase iii subunit 2] [gn:rpc2:rpc128:ret1] [gtcfc:4.1:4.2:10.1:10.2:10.3] [ec:2.7.7.6] [keggfc:4.1:4.2] |
| CONTIG1069 | 2751432_f2_1 | 3960 | 18063 | 375 | 125 | YOR224C | 322 | 4.5(10)-29 | Saccharomyces cerevisiae | [ui:yor224c] [pn:dna-directed rna polymerase i, ii, iii 16 kd subunit:dna-directed rna polymerases i, ii, and iii 14.5 kd polypeptide:abc14.4] [gn:rpb8:yor50-14] [gtcfc:4.1:4.2:10.1:10.2:10.3] [ec:2.7.7.6] [keggfc:4.1:4.2] [sgdfc:4.1. |
| CONTIG5560 | 24251575_c3_21 | 3961 | 18064 | 942 | 314 | YOR340C | 400 | 3.7(10)-52 | Saccharomyces cerevisiae | [ui:yor340c] [pn:dna-directed rna polymerase i, 36 kd subunit:dna-dependent rna polymerase 36 kd polypeptide:a43] [gn:rpa43:rrn12:o6271] [gtcfc:4.1:4.2:10.1:10.2:10.3] [ec:2.7.7.6] [keggfc:4.1:4.2] [sgdfc:4.1.0:9.5.0] [dbgtc-saccharo |
| CONTIG4460 | 6344192_f1_1 | 3962 | 18065 | 1389 | 463 | YOR341W | 1367 | 8.0(10)-144 | Saccharomyces cerevisiae | [ui:yor341w] [pn:dna-directed rna polymerase i, 190 kd alpha subunit:dna-directed rna polymerase i 190 kd polypeptide:a 190] [gn:rpa1:rpa190:rrn1:o6276] [gtcfc:4.1:4.2:10.1:10.2:10.3] [ec:2.7.7.6] [keggfc:4.1:4.2] [sgdfc:4.1.0:9.5.0] [ |
| CONTIG4563 | 15126042_f2_1 | 3963 | 18066 | 2337 | 779 | YOR341W | 2455 | 4.2(10)-255 | Saccharomyces cerevisiae | [ui:yor341w] [pn:dna-directed rna polymerase i, 190 kd alpha subunit:dna-directed rna polymerase i 190 kd polypeptide:a190] [gn:rpa1:rpa190:rrn1:o6276] [gtcfc:4.1:4.2:10.1:10.2:10.3] [ec:2.7.7.6] [keggfc:4.1:4.2] [sgdfc:4.1.0:9.5.0] [ |
| CONTIG4776 | 33854637_c2_7 | 3964 | 18067 | 477 | 159 | YOR341W | 583 | 2.6(10)-55 | Saccharomyces cerevisiae | [ui:yor341w] [pn:dna-directed rna polymerase i, 190 kd alpha subunit:dna-directed rna polymerase i 190 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4468 | 25587567_f3_4 | 3965 | 18068 | 963 | 321 | YOR360C | 325 | 30(10)-37 | Saccharomyces cerevisiae | polypeptide:a190] [gn:rpa1:rpa190:rrn1:o6276] [gtcfc:4.1.4.2:10.1:10.2:10.3] [ec:2.7.7.6] [keggfc:4.14.2] [sgdfc:4.1.0:9.5.0] [ui:yor360c] [pn:high affinity 3",5"-cyclic-nucleotide phosphodiesterase:3',5"-cyclic-nucleotide phosphodiesterase 2:high-affinity camp phosphodiesterase] [gn:pde2:sra5] [gtcfc:4.1] [ec:3.1.4.17] [keggfc:4.1] [sgdfc:1.3.4.9.2] |
| CONTIG1317 | 14652037_f2_2 | 3966 | 18069 | 825 | 275 | YPL167C | 304 | 1.2(10)-25 | Saccharomyces cerevisiae | [ui:ypl167c] [pn:dna-directed dna polymerase zeta:probable dna polymerase] [gn:rev3:pso1:p2535] [gtcfc:4.1.4.2:10.1:10:10.2:10.8] [ec:2.7.7.7] [keggfc:4.1.4.2] [sgdfc:3.6.0:3.7.0:9.5.0:11.2.1] [db-gtc-saccharomyces cerevisiae] |
| CONTIG3778 | 11047833_f3_4 | 3967 | 18070 | 1380 | 460 | YPL167C | 1047 | 1.7(10)-105 | Saccharomyces cerevisiae | [ui:ypl167c] [pn:dna-directed dna polymerase zeta:probable dna polymerase] [gn:rev3:pso1:p2535] [gtcfc:4.1.4.2:10.1:10:10.2:10.8] [ec:2.7.7.7] [keggfc:4.1.4.2] [sgdfc:3.6.0:3.7.0:9.5.0:11.2.1] [db-gtc-saccharomyces cerevisiae] |
| CONTIG4564 | 11893778_f1_1 | 3968 | 18071 | 2013 | 671 | YPR010C | 2859 | 6.5(10)-298 | Saccharomyces cerevisiae | [ui:ypr010c] [pn:dna-directed rna polymerase i, 135 kd subunit:dna-directed rna polymerase i 135 kd polypeptide:a135:rna polymerase subunit 2] [gn:rpa2:rpa135:srp3:rrn2:yp9531] [gtcfc:4.1.4.2:10.1:10.2:10.3] [ec:2.7.7.6] [keggfc:4.1] |
| CONTIG4759 | 35830216_c3_15 | 3969 | 18072 | 1029 | 343 | YPR010C | 1479 | 1.1(10)-151 | Saccharomyces cerevisiae | [ui:ypr010c] [pn:dna-directed rna polymerase i, 135 kd subunit:dna-directed rna polymerase i 135 kd polypeptide:a135:rna polymerase i subunit 2] [gn:rpa2:rpa135:srp3:rrn2:yp9531] [gtcfc:4.1.4.2:10.1:10.2:10.3] [ec:2.7.7.6] [keggfc:4.1] |
| CONTIG2746 | 26854067_f2_3 | 3970 | 18073 | 291 | 97 | YPR110C | 379 | 4.0(10)-35 | Saccharomyces cerevisiae | [ui:ypr110c] [pn:dna-directed rna polymerase i, iii 40 kd subunit:dna-directed rna polymerases i and iii 40 kd polypeptide:ac40] [gn:rpc5:rpc40:p8283] [gtcfc:4.1.4.2:10.1:10.2:10.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x18990.y | 29332812_c3_2 | 3971 | 18074 | 780 | 260 | YPR110C | 772 | 9.3(10)-77 | Saccharomyces cerevisiae | [ec:2.7.7.6] [kegg:fc:4.1:4.2] [sgd:fc:4.1.0:4.4.0:9.5] [ui:ypr110c] [pn:dna-directed rna polymerase i, iii 40 kd subunit:dna-directed rna polymerases i and iii 40 kd polypeptide:ac40] [gn:rpc5:rpc40:rp8283] [gt:cfc:4.1.4.2:10.1:10.2:10.3] [ec:2.7.7.6] [kegg:fc:4.1:4.2] [sgd:fc:4.1.0:4.4.0:9.5 |
| CONTIG5261 | 16226437_f1_2 | 3972 | 18075 | 2196 | 732 | YPR175W | 613 | 3.1(10)-112 | Saccharomyces cerevisiae | [ui:ypr175w] [pn:dna-directed dna polymerase epsilon, subunit b:dna polymerase epsilon, subunit b:dna polymerase ii subunit b] [gn:dpb2:p9705] [gt:cfc:4.1.4.2:10.1:10.2:10.8] [ec:2.7.7.7] [kegg:fc:4.1:4.2] [sgd:fc:3.6.0:9.5.0] [db:gtc-sa |
| b3x16016.y | 24120192_f1_1 | 3973 | 18076 | 744 | 248 | YPR175W | 170 | 8.0(10)-12 | Saccharomyces cerevisiae | [ui:ypr175w] [pn:dna-directed dna polymerase epsilon, subunit b:dna polymerase epsilon, subunit b:dna polymerase ii subunit b] [gn:dpb2:p9705] [gt:cfc:4.1.4.2:10.1:10.2:10.8] [ec:2.7.7.7] [kegg:fc:4.1:4.2] [sgd:fc:3.6.0:9.5.0] [db:gtc-sa |
| CONTIG3838 | 23992000_c3_5 | 3974 | 18077 | 414 | 138 | YPR187W | 375 | 1.1(10)-34 | Saccharomyces cerevisiae | [ui:ypr187w] [pn:dna-directed rna polymerase i, ii, iii 18 kd subunit:dna-directed rna polymerases i, ii, and iii 23 kd polypeptide:abc23] [gn:rpb6:rpo26:p9677] [gt:cfc:4.1.4.2:10.1:10.2:10.3] [ec:2.7.7.6] [kegg:fc:4.1:4.2] [sgd:fc:4.1.0 |
| CONTIG2927 | 11933333_c2_3 | 3975 | 18078 | 435 | 145 | YPR190C | 190 | 5.2(10)-14 | Saccharomyces cerevisiae | [ui:ypr190c] [pn:dna-directed rna polymerase iii, 82 kd subunit:dna-directed rna polymerase iii 74 kd polypeptide:c74] [gn:rpc3:rpc82] [gt:cfc:4.1.4.2:10.1:10.2:10.3] [ec:2.7.7.6] [kegg:fc:4.1:4.2] [sgd:fc:4.1.0:4.4.0:9.5.0] [db:gtc-sacc |
| b3x16424.x | 26256451_f3_1 | 3976 | 18079 | 501 | 167 | YPR190C | 217 | 6.5(10)-17 | Saccharomyces cerevisiae | [ui:ypr190c] [pn:dna-directed rna polymerase iii, 82 kd subunit:dna-directed rna polymerase iii 74 kd polypeptide:c74] [gn:rpc3:rpc82] [gt:cfc:4.1.4.2:10.1:10.2:10.3] [ec:2.7.7.6] [kegg:fc:4.1:4.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x10245.x | 36613775_f3_1 | 3977 | | 528 | 176 | YPR190C | 170 | 7.2(10)-12 | Saccharomyces cerevisiae | [ui:ypr190c] [pn:dna-directed rna polymerase iii, 82 kd subunit:dna-directed rna polymerase iii 74 kd polypeptide:c74] [gn:rpc3:rpc82] [gtcfc:4.1.4.2:10.1:10.2:10.3] [ec:2.7.7.6] [keggfc:4.1.4.2] [sgdfc:4.1.0:4.4.0:9.5.0] [db:gtc-sacc |
| CONTIG5421 | 10722537_f1_3 | 3978 | 18080 | 807 | 269 | YDR020C | 227 | 5.2(10)-19 | Saccharomyces cerevisiae | [ui:ydr020c] [pn:weak similarity to uridine kinases and phosphoribulokinases] [gtcfc:4.1] [keggfc:14.2] [sgdfc:1.3.1] [db:gtc-saccharomyces cerevisiae] |
| CONTIG4793 | 34063317_c3_12 | 3979 | 18081 | 738 | 246 | YLR017W | 598 | 2.5(10)-58 | Saccharomyces cerevisiae | [ui:ylr017w] [pn:multiple enhancer of uas2] [gtcfc:4.1] [keggfc:14.2] [sgdfc:1.3.1] [db:gtc-saccharomyces cerevisiae] |
| CONTIG5059 | 11719632_c2_12 | 3980 | 18082 | 600 | 200 | YLR209C | 573 | 1.1(10)-55 | Saccharomyces cerevisiae | [ui:ylr209c] [pn:strong similarity to purine-nucleoside phosphorylases] [gtcfc:4.1] [keggfc:14.2] [sgdfc:1.3.1] [db:gtc-saccharomyces cerevisiae] |
| CONTIG4096 | 13173365_f1_1 | 3981 | 18083 | 1200 | 400 | YLR359W | 1657 | 1.5(10)-170 | Saccharomyces cerevisiae | [ui:ylr359w] [pn:strong similarity to adenylosuccinate lyase] [gtcfc:4.1] [keggfc:14.2] [sgdfc:1.3.1] [db:gtc-saccharomyces cerevisiae] |
| CONTIG4096 | 5191511_f2_2 | 3982 | 18084 | 297 | 99 | YLR359W | 344 | 2.1(10)-31 | Saccharomyces cerevisiae | [ui:ylr359w] [pn:strong similarity to adenylosuccinate lyase] [gtcfc:4.1] [keggfc:14.2] [sgdfc:1.3.1] [db:gtc-saccharomyces cerevisiae] |
| CONTIG5658 | 24413962_f3_10 | 3983 | 18085 | 1419 | 473 | YOL061W | 746 | 7.7(10)-118 | Saccharomyces cerevisiae | [ui:yol061w] [pn:similarity to ribose-phosphate pyrophosphokinases] [gtcfc:4.1:4.2] [keggfc:14.2] [sgdfc:1.3.1:1.3.2] [db:gtc-saccharomyces cerevisiae] |
| CONTIG1898 | 25600913_c3_6 | 3984 | 18086 | 636 | 212 | YOR280C | 223 | 1.3(10)-18 | Saccharomyces cerevisiae | [ui:yor280c] [pn:similarity to s. pombe dihydrofolate reductase] [gtcfc:10.7:9.6] [keggfc:14.2] [sgdfc:1.1.1:1.3.1:1.3.2] [db:gtc-saccharomyces cerevisiae] |
| CONTIG5650 | 9773432_c2_20 | 3985 | 18087 | 822 | 274 | YOR280C | 199 | 4.9(10)-16 | Saccharomyces cerevisiae | [ui:yor280c] [pn:similarity to s. pombe dihydrofolate reductase] [gtcfc:10.7:9.6] [keggfc:14.2] [sgdfc:1.1.1:1.3.1:1.3.2] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2843 | 24228192_c1_4 | 3986 | 18089 | 1200 | 400 | YOL081W | 478 | 9.6(10)-44 | *Saccharomyces cerevisiae* | *saccharomyces cerevisiae* [ui:yol081w] [pn:gtpase-activating protein for ras proteins:inhibitory regulator protein ira2] [gn:ira2;glc4:ccs1:o0985] [gtcfc:4.1:10.2:11.1] [kegg fc:14.2] [sgdfc:1.3.4:1.3.5:9.1.0] [db:gtc- |
| CONTIG4914 | 35369027_c3_10 | 3987 | 18090 | 2235 | 745 | YOL081W | 468 | 4.7(10)-41 | *Saccharomyces cerevisiae* | *saccharomyces cerevisiae* [ui:yol081w] [pn:gtpase-activating protein for ras proteins:inhibitory regulator protein ira2] [gn:ira2;glc4:ccs1:o0985] [gtcfc:4.1:10.2:11.1] [keggfc:14.2] [sgdfc:1.3.4:1.3.5:9.1.0] [db:gtc- |
| CONTIG5564 | 4696963_f2_5 | 3988 | 18091 | 3849 | 1283 | YOL081W | 287 | 3.0(10)-25 | *Saccharomyces cerevisiae* | *saccharomyces cerevisiae* [ui:yol081w] [pn:gtpase-activating protein for ras proteins:inhibitory regulator protein ira2] [gn:ira2;glc4:ccs1:o0985] [gtcfc:4.1:10.2:11.1] [keggfc:14.2] [sgdfc:1.3.4:1.3.5:9.1.0] [db:gtc- *saccharomyces cerevisiae* |
| CONTIG3161 | 33204375_c1_2 | 3989 | 18092 | 1236 | 412 | YPL212C | 960 | 1.1(10)-96 | *Saccharomyces cerevisiae* | [ui:ypl212c] [pn:pseudouridine synthase 1] [gn:pus1] [gtcfc:4.1:10.1:10.2:10.6] [keggfc:14.2] [sgdfc:1.3.4:4.6:0.9.5.0] [db:gtc- *saccharomyces cerevisiae* |
| CONTIG5516 | 563187_c3_22 | 3990 | 18093 | 519 | 173 | YDL125C | 412 | 1.3(10)-38 | *Saccharomyces cerevisiae* | [ui:ydl125c] [pn:similarity to protein kinase c inhibitor-i] [gn:hnt1] [gtcfc:4.1:12.13] [keggfc:14.2] [sgdfc:1.3.8] [db:gtc- *saccharomyces cerevisiae* |
| CONTIG5744 | 9817542_f3_12 | 3991 | 18094 | 654 | 218 | YDR305C | 374 | 1.3(10)-34 | *Saccharomyces cerevisiae* | [ui:ydr305c] [pn:similarity to *s. pombe* diadenosine 5",5"" p1,p4-tetraphosphate asymmetrical hydrolase:hypothetical 24.8 kd hit-like protein] [gn:hnt2:d9740] [gtcfc:4.1:12.13] [keggfc:14.2] [sgdfc:1.3.8] [db:gtc- *saccharomyces cerevisi* |
| CONTIG5324 | 4334811_f1_1 | 3992 | 18095 | 981 | 327 | YBL039C | 1161 | 5.5(10)-118 | *Saccharomyces cerevisiae* | [ui:ybl039c] [pn:ctp synthase 1:utp--ammonia ligase 1:ctp synthetase 1] [gn:ura7;ybl0410] [gtcfc:4.2] [ec:6.3.4.2] [keggfc:4.2]] [sgdfc:1.3.2] [db:gtc- *saccharomyces cerevisiae* |
| CONTIG5324 | 20095662_f3_7 | 3993 | 18096 | 822 | 274 | YBL039C | 865 | 1.3(10)-86 | *Saccharomyces cerevisiae* | [ui:ybl039c] [pn:ctp synthase 1:utp--ammonia ligase 1:ctp synthetase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | 1] [gn:ura7;ybl0410] [gtcfc:4.2] [ec:6.3.4.2] [keggfc:4.2] [sgdfc:1.3.2] [db:gtc-saccharomyces cerevisiae] |
| CONTIG1971 | 26366561_c2_7 | 3994 | 18097 | 267 | 89 | YEL021W | 256 | 4.4(10)-22 | Saccharomyces cerevisiae | [ui:yel021w] [pn:orotidine-5'-phosphate decarboxylase:orotidine 5''-phosphate decarboxylase:omp decarboxylase] [gn:ura3] [gtcfc:4.2] [ec:4.1.1.23] [keggfc:4.2] [sgdfc:1.3.2] [db:gtc-saccharomyces cerevisiae] |
| CONTIG698 | 25681512_f3_1 | 3995 | 18098 | 243 | 81 | YEL021W | 267 | 3.0(10)-23 | Saccharomyces cerevisiae | [ui:yel021w] [pn:orotidine-5'-phosphate decarboxylase:orotidine 5''-phosphate decarboxylase:omp decarboxylase] [gn:ura3] [gtcfc:4.2] [ec:4.1.1.23] [keggfc:4.2] [sgdfc:1.3.2] [db:gtc-saccharomyces cerevisiae] |
| CONTIG5721 | 15672577_f2_9 | 3996 | 18099 | 657 | 219 | YHR128W | 833 | 3.2(10)-83 | Saccharomyces cerevisiae | [ui:yhr128w] [pn:uracil phosphoribosyltransferase:ump pyrophosphorylase:uprtase] [gn:fur1] [gtcfc:4.2] [ec:2.4.2.9] [keggfc:4.2] [sgdfc:1.3.2:9.2.0] [db:gtc-saccharomyces cerevisiae] |
| CONTIG5552 | 26370762_c2_14 | 3997 | 18100 | 1074 | 358 | YHR144C | 701 | 3.1(10)-69 | Saccharomyces cerevisiae | [ui:yhr144c] [pn:deoxycytidylate deaminase:dcmp deaminase] [gn:dcd1] [gtcfc:4.2] [ec:3.5.4.12] [keggfc:4.2] [sgdfc:1.3.2] [db:gtc-saccharomyces cerevisiae] |
| CONTIG3304 | 402082_f2_1 | 3998 | 18101 | 1587 | 529 | YJL130C | 1122 | 1.6(10)-112 | Saccharomyces cerevisiae | [ui:yjl130c] [pn:multifunctional pyrimidine biosynthesis protein:ura2 protein:contains:glutamine-dependent carbamoyl- phosphate synthase, aspartate carbamoyltransferase] [gn:ura2;j0686] [gtcfc:4.2:5.1.5.2:10.1:10.2] [keggfc:4.2.5.1.5] |
| CONTIG3364 | 550776_c3_5 | 3999 | 18102 | 1026 | 342 | YJL130C | 1199 | 9.1(10)-121 | Saccharomyces cerevisiae | [ui:yjl130c] [pn:multifunctional pyrimidine biosynthesis protein:ura2 protein:contains:glutamine-dependent carbamoyl- phosphate synthase, aspartate carbamoyltransferase] [gn:ura2;j0686] [gtcfc:4.2:5.1.5.2:10.1:10.2] [keggfc:4.2.5.1.5] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4851 | 24620282_f3_7 | 4000 | 18103 | 4215 | 1405 | YJL130C | 5189 | 0 | *Saccharomyces cerevisiae* | [ui:yjl130c] [pn:multifunctional pyrimidine biosynthesis protein:ura2 protein:contains:glutamine-dependent carbamoyl- phosphate synthase, aspartate carbamoyltransferase] [gn:ura2;j0686] [gtcfc:4.2:5.1:5.2:10.1:10.2] [keggfc:4.2:5.1:5 |
| CONTIG4854 | 24031654_c2_5 | 4001 | 18104 | 183 | 61 | YJL130C | 249 | 1.3(10)-19 | *Saccharomyces cerevisiae* | [ui:yjl130c] [pn:multifunctional pyrimidine biosynthesis protein:ura2 protein:contains:glutamine-dependent carbamoyl- phosphate synthase, aspartate carbamoyltransferase] [gn:ura2;j0686] [gtcfc:4.2:5.1:5.2:10.1:10.2] [keggfc:4.2:5.1:5 |
| CONTIG5482 | 29303127_f1_4 | 4002 | 18105 | 756 | 252 | YJR057W | 471 | 7.2(10)-45 | *Saccharomyces cerevisiae* | [ui:yjr057w] [pn:thymidylate kinase:dtmp kinase] [gn:cdc8;j1715] [gtcfc:4.2] [ec:2.7.4.9] [keggfc:4.2] [sgdfc:1.3.2:9.2.0] [db:gtc-saccharomyces cerevisiae] |
| CONTIG4597 | 14551501_f2_4 | 4003 | 18106 | 1098 | 366 | YLR420W | 1186 | 1.3(10)-120 | *Saccharomyces cerevisiae* | [ui:ylr420w] [pn:dihydroorotase:dhoase] [gn:ura4;19931] [gtcfc:4.2] [ec:3.5.2.3] [keggfc:4.2] [sgdfc:1.3.2] [db:gtc-saccharomyces cerevisiae] |
| b9x10d12.y | 20100776_f2_1 | 4004 | 18107 | 636 | 212 | YML106W | 538 | 5.7(10)-52 | *Saccharomyces cerevisiae* | [ui:yml106w] [pn:orotate phosphoribosyltransferase:orotate phosphoribosyltransferase 1:oprt] [gn:ura5;pyr5;ym8339] [gtcfc:4.2] [ec:2.4.2.10] [keggfc:4.2] [sgdfc:1.3.2] [db:gtc-saccharomyces cerevisiae] |
| CONTIG5672 | 21953277_f2_7 | 4005 | 18108 | 1734 | 578 | YNR012W | 1128 | 1.8(10)-114 | *Saccharomyces cerevisiae* | [ui:ynr012w] [pn:uridine kinase:uridine monophosphokinase] [gn:urk1;n2050] [gtcfc:4.2] [ec:2.7.1.48] [keggfc:4.2] [sgdfc:1.3.2] [db:gtc-saccharomyces cerevisiae] |
| CONTIG2626 | 4297525_f3_2 | 4006 | 18109 | 870 | 290 | YOR074C | 768 | 5.0(10)-87 | *Saccharomyces cerevisiae* | [ui:yor074c] [pn:thymidylate synthase:ts] [gn:tmp1:cdc21] [gtcfc:4.2:9.6:10.1:10.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2698 | 21675305_f3_2 | 4007 | 18110 | 1044 | 348 | YDL244W | 1391 | 2.3(10)-142 | Saccharomyces cerevisiae | [ec:2.1.1.45] [keggfc:4.2:9.7:9.8] [sgdfc:1.3.3:9.5.0] [db:gtc-saccharomyces cerevisiae] [ui:ydl244w] [pn:strong similarity to thi5p, yjr156c, ynl332w and a. parasiticus, s. pombe nmt1 protein] [gtcfc:4.2] [keggfc:14.2] [sgdfc:1.3.2] [db-gtc-saccharomyces cerevisiae] |
| CONTIG4457 | 24276687_c2_8 | 4008 | 18111 | 198 | 66 | YKL024C | 142 | 5.2(10)-10 | Saccharomyces cerevisiae | [ui:ykl024c] [pn:uridine-monophosphate kinase:uridylate kinase:ump:uridine monophosphate kinase:ump kinase] [gn:ura6:soc8] [gtcfc:4.2:10.1:10.2:14.1] [ec:2.7.4.-] [keggfc:14.1] [sgdfc:1.3.2:9.5.0] [db-gtc-saccharomyces cerevisiae] |
| CONTIG5694 | 9775308_c2_22 | 4009 | 18112 | 558 | 186 | YKL024C | 350 | 4.9(10)-32 | Saccharomyces cerevisiae | [ui:ykl024c] [pn:uridine-monophosphate kinase:uridylate kinase:ukuridine monophosphate kinase:ump kinase] [gn:ura6:soc8] [gtcfc:4.2:10.1:10.2:14.1] [ec:2.7.4.-] [keggfc:14.1] [sgdfc:1.3.2:9.5.0] [db-gtc-saccharomyces cerevisiae] |
| CONTIG4935 | 29922786_c3_7 | 4010 | 18113 | 414 | 138 | YPR062W | 379 | 4.0(10)-35 | Saccharomyces cerevisiae | [ui:ypr062w] [pn:cytosine deaminase] [gn:fcy1] [gtcfc:4.2] [keggfc:14.2] [sgdfc:1.3.2] [db-gtc-saccharomyces cerevisiae] |
| CONTIG3827 | 1988817_f1_1 | 4011 | 18114 | 183 | 61 | YDR513W | 174 | 2.2(10)-13 | Saccharomyces cerevisiae | [ui:ydr513w] [pn:glutaredoxin:thioltransferase] [gn:ttr1:ttr:d9719] [gtcfc:4.2:12.12] [keggfc:14.2] [sgdfc:1.3.3:9.2.0:11.3.0] [db-gtc-saccharomyces cerevisiae] |
| CONTIG3812 | 4407680_f2_3 | 4012 | 18115 | 582 | 194 | YDR513W | 250 | 1.8(10)-21 | Saccharomyces cerevisiae | [ui:ydr513w] [pn:glutaredoxin:thioltransferase] [gn:ttr1:ttr:d9719] [gtcfc:4.2:12.12] [keggfc:4.2] [sgdfc:1.3.3:9.2.0:11.3.0] [db-gtc-saccharomyces cerevisiae] |
| CONTIG5781 | 4541257_f1_2 | 4013 | 18116 | 1485 | 495 | YOR269W | 363 | 2.0(10)-33 | Saccharomyces cerevisiae | [ui:yor269w] [pn:similarity to human lis-1 protein:protein] [gn:pac1] [gtcfc:4.2] [keggfc:14.2] [sgdfc:1.3.3] [db-gtc-saccharomyces cerevisiae] |
| CONTIG1871 | 394062_c2_3 | 4014 | 18117 | 591 | 197 | YPL059W | 424 | 7.0(10)-40 | Saccharomyces cerevisiae | [ui:ypl059w] [pn:similarity to glutaredoxins] [gtcfc:4.2] [keggfc:14.2] [sgdfc:1.3.3] [db-gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x15471.y | 35806566_f1_1 | 4015 | 18118 | 462 | 154 | YJR062C | 96 | 5.0(10)-10 | Saccharomyces cerevisiae | saccharomyces cerevisiae] [ui:yjf062c] [pn:amino-terminal amidase:n-terminal amidase] [gn:nta1:j1742] [gtcfc:4.3.7.1:10.11:10.7] [ec:3.2.1.-] [keggfc:4.3:4.4] [sgdfc:6.3.0:6.5.1.9.2.0] [db:gtc-saccharomyces cerevisiae] |
| CONTIG5489 | 24803387_f2_1 | 4016 | 18119 | 3015 | 1005 | YGL173C | 1767 | 3.3(10)-182 | Saccharomyces cerevisiae | [ui:ygl173c] [pn:multifunctional nuclease:strand exchange protein 1:kar:- enhancing mutation protein:5"-3" exoribonuclease:dna strand transfer protein beta:stp-beta] [gn:kem1:sep1:xrn1:dst2:rar5:g1645] [gtcfc:4.4:10.10:10.3:12.8] [keg |
| CONTIG5671 | 4881511_f2_8 | 4017 | 18120 | 1206 | 402 | YGL173C | 1332 | 4.2(10)-136 | Saccharomyces cerevisiae | [ui:ygl173c] [pn:multifunctional nuclease:strand exchange protein 1:kar:- enhancing mutation protein:5"-3" exoribonuclease:dna strand transfer protein beta:stp-beta] [gn:kem1:sep1:xrn1:dst2:rar5:g1645] [gtcfc:4.4:10.10:10.3:12.8] [keg |
| CONTIG2986 | 994087_f3_3 | 4018 | 18121 | 378 | 126 | YGR195W | 328 | 1.0(10)-29 | Saccharomyces cerevisiae | [ui:ygr195w] [pn:weak similarity to p. aeruginosa rnase ph:hypothetical 27.6 kd protein in pdx1-sng1 intergenic region] [gn:g7587] [gtcfc:4.4:10.10] [keggfc:14.2] [sgdfc:1.3.6] [db:gtc-saccharomyces cerevisiae] |
| CONTIG1992 | 35807777_f1_1 | 4019 | 18122 | 1203 | 401 | YHR077C | 516 | 1.5(10)-48 | Saccharomyces cerevisiae | [ui:yhr077c] [pn:nonsense-mediated mma decay protein 2:up-frameshift suppressor 2] [gn:nmd2:upf2:ifs1:sua1] [gtcfc:4.4:10.10:10.7] [keggfc:14.2] [sgdfc:1.3.6:5.3.0:9.2.0] [db:gtc-saccharomyces cerevisiae] |
| CONTIG3143 | 23634465_c1_5 | 4020 | 18123 | 879 | 293 | YHR077C | 108 | 6.4(10)-10 | Saccharomyces cerevisiae | [ui:yhr077c] [pn:nonsense-mediated mma decay protein 2:up-frameshift suppressor 2] [gn:nmd2:upf2:ifs1:sua1] [gtcfc:4.4:10.10:10.7] [keggfc:14.2] [sgdfc:1.3.6:5.3.0:9.2.0] [db:gtc-saccharomyces cerevisiae] |
| b1x11358.y | 915627_c2_4 | 4021 | 18124 | 756 | 252 | YHR077C | 92 | 0.32 | Saccharomyces cerevisiae | [ui:yhr077c] [pn:nonsense-mediated mma decay protein 2:up- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | frameshift suppressor 2] [gn:nmd2:upf2:ifs1:sua1] [gtcfc:4.4:10:10.7] [sgdfc:1.3.6:5.3.0:9.2.0] [db:gtc-keggfc:14.2] |
| CONTIG2001 | 235451_c2_2 | 4022 | 18125 | 909 | 303 | YJR132W | 289 | 2.7(10)-24 | Saccharomyces cerevisiae | [ui:yjr132w] [pn:nam7p/upf1p-interacting protein:nonsense-mediated mrna decay protein 5] [gn:nmd5j2112] [gtcfc:4.4:10:10] [keggfc:14.2] [sgdfc:1.3.6] [db:gtc-saccharomyces cerevisiae] |
| CONTIG4962 | 9776538_f1_1 | 4023 | 18126 | 1212 | 404 | YJR132W | 344 | 3.7(10)-30 | Saccharomyces cerevisiae | [ui:yjr132w] [pn:nam7p/upf1p-interacting protein:nonsense-mediated mrna decay protein 5] [gn:nmd5j2112] [gtcfc:4.4:10:10] [keggfc:14.2] [sgdfc:1.3.6] [db:gtc-saccharomyces cerevisiae] |
| CONTIG4998 | 36371075_c2_13 | 4024 | 18127 | 1623 | 541 | YJR132W | 848 | 8.1(10)-85 | Saccharomyces cerevisiae | [ui:yjr132w] [pn:nam7p/upf1p-interacting protein:nonsense-mediated mrna decay protein 5] [gn:nmd5j2112] [gtcfc:4.4:10:10] [keggfc:14.2] [sgdfc:1.3.6] [db:gtc-saccharomyces cerevisiae] |
| CONTIG4998 | 4335001_c3_15 | 4025 | 18128 | 522 | 174 | YJR132W | 200 | 8.9(10)-15 | Saccharomyces cerevisiae | [ui:yjr132w] [pn:nam7p/upf1p-interacting protein:nonsense-mediated mrna decay protein 5] [gn:nmd5j2112] [gtcfc:4.4:10:10] [keggfc:14.2] [sgdfc:1.3.6] [db:gtc-saccharomyces cerevisiae] |
| CONTIG5085 | 23650312_c1_8 | 4026 | 18129 | 1335 | 445 | YJR132W | 546 | 7.5(10)-52 | Saccharomyces cerevisiae | [ui:yjr132w] [pn:nam7p/upf1p-interacting protein:nonsense-mediated mrna decay protein 5] [gn:nmd5j2112] [gtcfc:4.4:10:10] [keggfc:14.2] [sgdfc:1.3.6] [db:gtc-saccharomyces cerevisiae] |
| CONTIG5757 | 4879063_f3_5 | 4027 | 18130 | 1458 | 486 | YKL149C | 597 | 1.8(10)-64 | Saccharomyces cerevisiae | [ui:ykl149c] [pn:lariat-debranching enzyme:lariat.debranching enzyme] [gn:dbr1:prp26:ykl604] [gtcfc:4.4:10.1:1.10:10.2:14.1] [ec:3.1.-.-] [keggfc:14.1] [sgdfc:1.3.6:9.5.0] [db:gtc-saccharomyces cerevisiae] |
| CONTIG5776 | 14244436_f2_12 | 4028 | 18131 | 1242 | 414 | YLR363C | 139 | 9.6(10)-15 | Saccharomyces cerevisiae | [ui:ylr363c] [pn:nam7p/upf1p-interacting protein] [gn:nmd4] [gtcfc:4.4:10:10] [keggfc:14.2] [sgdfc:1.3.6] [db:gtc-saccharomyces cerevisiae] |
| CONTIG5769 | 23612501_c3_20 | 4029 | 18132 | 1155 | 385 | YMR080C | 1115 | 4.2(10)-113 | Saccharomyces | [ui:ymr080c] [pn:nonsense- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | mediated mrna decay protein:nam7 protein:nonsense-mediated mrna decay protein 1:up-frameshift suppressor 1 [gn:nam7:upf1:ifs2:mof4:ym9582] [gtcfc:4.4:10.10:10.7] [keggfc:14.2] |
| CONTIG628 | 35937828_f3_1 | 4030 | 18133 | 537 | 179 | YMR080C | 196 | 2.1(10)-14 | Saccharomyces cerevisiae | [sgdfc:1.3.6:5.3.0:9.2.0] [dbg ui:ymr080c] [pn:nonsense-mediated mrna decay protein:nam7 protein:nonsense-mediated mrna decay protein 1:up-frameshift suppressor 1 [gn:nam7:upf1:ifs2:mof4:ym9582] [gtcfc:4.4:10.10:10.7] [keggfc:14.2] |
| CONTIG819 | 15838508_c3_2 | 4031 | 18134 | 321 | 107 | YMR080C | 355 | 2.1(10)-31 | Saccharomyces cerevisiae | [sgdfc:1.3.6:5.3.0:9.2.0] [dbg ui:ymr080c] [pn:nonsense-mediated mrna decay protein:nam7 protein:nonsense-mediated mrna decay protein 1:up-frameshift suppressor 1 [gn:nam7:upf1:ifs2:mof4:ym9582] [gtcfc:4.4:10.10:10.7] [keggfc:14.2] |
| CONTIG819 | 5985882_c3_1 | 4032 | 18135 | 594 | 198 | YMR080C | 744 | 8.5(10)-74 | Saccharomyces cerevisiae | [sgdfc:1.3.6:5.3.0:9.2.0] [dbg ui:ymr080c] [pn:nonsense-mediated mrna decay protein:nam7 protein:nonsense-mediated mrna decay protein 1:up-frameshift suppressor 1 [gn:nam7:upf1:ifs2:mof4:ym9582] [gtcfc:4.4:10.10:10.7] [keggfc:14.2] |
| CONTIG3369 | 15078550_c1_5 | 4033 | 18136 | 288 | 96 | YMR234W | 116 | 4.2(10)-11 | Saccharomyces cerevisiae | [ui:ymr234w] [pn:ribonuclease h:rnase h] [gn:rnh1:ym9959] [gtcfc:4.4:10.10] [sgdfc:14.1] [dbgtc-saccharomyces cerevisiae] |
| CONTIG3369 | 4103127_c2_6 | 4034 | 18137 | 723 | 241 | YMR234W | 151 | 1.8(10)-17 | Saccharomyces cerevisiae | [ui:ymr234w] [pn:ribonuclease h:rnase h] [gn:rnh1:ym9959] [gtcfc:4.4:10.10] [sgdfc:14.1] [dbgtc-saccharomyces cerevisiae] |
| CONTIG5034 | 581250_f3_8 | 4035 | 18138 | 960 | 320 | YMR234W | 217 | 6.0(10)-31 | Saccharomyces cerevisiae | [ui:ymr234w] [pn:ribonuclease h:rnase h] [gn:rnh1:ym9959] [gtcfc:4.4:10.10] [sgdfc:14.1] [dbgtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1638 | 33478461_c3_3 | 4036 | 18139 | 759 | 253 | YOR033C | 329 | 6.2(10)-29 | *Saccharomyces cerevisiae* | *saccharomyces cerevisiae* [ui:yor033c] [pn:exo1 encodes an exonuclease which interacts with msh2p:dhs1 protein] [gn:dhs1:or26] [gtcfc:4.4:10.10:10.8] [kegfc:14.2] [sgdfc:1.3.6:3.7.0] [db:gtc-saccharomyces cerevisiae] |
| CONTIG3402 | 1375_f1_1 | 4037 | 18140 | 822 | 274 | YPL123C | 491 | 5.5(10)-47 | *Saccharomyces cerevisiae* | [ui:ypl123c] [pn:similarity to ribonucleases] [gtcfc:4.4:10.10] [kegfc:14.2] [sgdfc:1.3.6] [dbgtc-saccharomyces cerevisiae] |
| CONTIG4791 | 35158411_c3_8 | 4038 | 18141 | 1047 | 349 | YPL123C | 546 | 8.3(10)-53 | *Saccharomyces cerevisiae* | [ui:ypl123c] [pn:similarity to ribonucleases] [gtcfc:4.4:10.10] [kegfc:14.2] [sgdfc:1.3.6] [dbgtc-saccharomyces cerevisiae] |
| CONTIG4791 | 4490937_c2_6 | 4039 | 18142 | 291 | 97 | YPL123C | 92 | 0.00097 | *Saccharomyces cerevisiae* | [ui:ypl123c] [pn:similarity to ribonucleases] [gtcfc:4.4:10.10] [kegfc:14.2] [sgdfc:1.3.6] [dbgtc-saccharomyces cerevisiae] |
| CONTIG5758 | 20119703_c3_24 | 4040 | 18143 | 999 | 333 | YPL123C | 430 | 1.6(10)-40 | *Saccharomyces cerevisiae* | [ui:ypl123c] [pn:similarity to ribonucleases] [gtcfc:4.4:10.10] [kegfc:14.2] [sgdfc:1.3.6] [dbgtc-saccharomyces cerevisiae] |
| CONTIG1117 | 13867916_f3_1 | 4041 | 18144 | 660 | 220 | YGL245W | 931 | 1.3(10)-93 | *Saccharomyces cerevisiae* | [ui:ygl245w] [pn:strong similarity to glutamine--trna ligase:glutamyl-trna synthetase, cytoplasmic:glutamate-- trna ligase:glurs:p85] [gn:g0583:hrb724] [gtcfc:5.1:9.10:10.6] [ec:6.1.1.17] [kegfc:5.1.9.10:10.1:10.2] [sgdfc:5.4.0] [db: |
| CONTIG1607 | 4507691_f1_1 | 4042 | 18145 | 633 | 211 | YGL245W | 648 | 1.3(10)-63 | *Saccharomyces cerevisiae* | [ui:ygl245w] [pn:strong similarity to glutamine--trna ligase:glutamyl-- trna synthetase, cytoplasmic:glutamate-- trna ligase:glurs:p85] [gn:g0583:hrb724] [gtcfc:5.1:9.10:10.6] [ec:6.1.1.17] [kegfc:5.1.9.10:10.1:10.2] [sgdfc:5.4.0] [db: |
| CONTIG2711 | 9876292_c2_4 | 4043 | 18146 | 666 | 222 | YGL245W | 288 | 1.8(10)-24 | *Saccharomyces cerevisiae* | [ui:ygl245w] [pn:strong similarity to glutamine--trna ligase:glutamyl-trna synthetase, cytoplasmic:glutamate-- trna ligase:glurs:p85] [gn:g0583:hrb724] [gtcfc:5.1:9.10:10.6] [ec:6.1.1.17] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3361 | 4969505_f2_1 | 4044 | 18147 | 894 | 298 | YJL101C | 493 | 3.3(10)-47 | Saccharomyces cerevisiae | [keggfc:5.1.9.10.1:10.2] [sgdfc:5.4.0] [db:][ui:yjl101c] [pn:glutamate--cysteine ligase:gamma-glutamylcysteine synthetase:gamma-ecs:gcs] [gn:gsh1;j0832] [gtcfc:5.1.16.16.12.12] [ec:6.3.2.2] [keggfc:5.1.6.9] [sgdfc:11.3.0] |
| CONTIG3361 | 23944202_f3_2 | 4045 | 18148 | 609 | 203 | YJL101C | 200 | 4.5(10)-15 | Saccharomyces cerevisiae | [db:gtc-saccharomyces cerevisiae] [ui:yjl101c] [pn:glutamate--cysteine ligase:gamma-glutamylcysteine synthetase:gamma-ecs:gcs] [gn:gsh1;j0832] [gtcfc:5.1.16.16.12.12] [ec:6.3.2.2] [keggfc:5.1.6.9] [sgdfc:11.3.0] |
| CONTIG780 | 34570275_c3_1 | 4046 | 18149 | 528 | 176 | YJL101C | 374 | 7.0(10)-34 | Saccharomyces cerevisiae | [db:gtc-saccharomyces cerevisiae] [ui:yjl101c] [pn:glutamate--cysteine ligase:gamma-glutamylcysteine synthetase:gamma-ecs:gcs] [gn:gsh1;j0832] [gtcfc:5.1.16.16.12.12] [ec:6.3.2.2] [keggfc:5.1.6.9] [sgdfc:11.3.0] |
| CONTIG1307 | 25634793_c3_2 | 4047 | 18150 | 498 | 166 | YJR109C | 443 | 1.1(10)-40 | Saccharomyces cerevisiae | [ui:yjr109c] [pn:arginine-specific carbamoylphosphate synthase, large chain:carbamoyl-phosphate synthase, arginine-specific, large chain:arginine-specific carbamoyl-phosphate synthetase, ammonia chain] [gn:cpa2;j2002] [gtcfc:5.1.6.6] |
| CONTIG4268 | 47250_f2_4 | 4048 | 18151 | 1263 | 421 | YJR109C | 1449 | 1.7(10)-148 | Saccharomyces cerevisiae | [ui:yjr109c] [pn:arginine-specific carbamoylphosphate synthase, large chain:carbamoyl-phosphate synthase, arginine-specific, large chain:arginine-specific carbamoyl-phosphate synthetase, ammonia chain] [gn:cpa2;j2002] [gtcfc:5.1.6.6] |
| CONTIG4268 | 7032513_f3_5 | 4049 | 18152 | 915 | 305 | YJR109C | 1108 | 2.2(10)-112 | Saccharomyces cerevisiae | [ui:yjr109c] [pn:arginine-specific carbamoylphosphate synthase, large chain:carbamoyl-phosphate synthase, arginine-specific, large chain:arginine-specific carbamoyl-phosphate synthetase, ammonia chain] [gn:cpa2;j2002] [gtcfc:5.1.6.6] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4268 | 25489007_f3_6 | 4050 | 18153 | 567 | 189 | YJR109C | 648 | 9.1(10)-63 | *Saccharomyces cerevisiae* | [gtcfc:5.1.6.6] [ui:yjr109c] [pn:arginine-specific carbamoylphosphate synthase, large chain:carbamoyl-phosphate synthase, arginine-specific, large chain:arginine-specific carbamoyl-phosphate synthetase, ammonia chain] [gn:cpa2;j2002] |
| CONTIG2939 | 24414187_c1_6 | 4051 | 18154 | 1056 | 352 | YOR168W | 702 | 2.3(10)-69 | *Saccharomyces cerevisiae* | [gtcfc:5.1.6.6] [ui:yor168w] [pn:glutaminyl-trna synthetase:glutamine-trna ligase:glns] [gn:gln4:o3601] [gtcfc:5.1.10.6] [ec:6.1.1.18] [keggfc:5.1:10.1:10.2] [sgdfc:5.4.0:9.2.0] [db:gtc-*saccharomyces cerevisiae*] |
| CONTIG5381 | 16097902_f1_1 | 4052 | 18155 | 1104 | 368 | YOR168W | 1165 | 2.1(10)-118 | *Saccharomyces cerevisiae* | [ui:yor168w] [pn:glutaminyl-trna synthetase:glutamine-trna ligase:glns] [gn:gln4:o3601] [gtcfc:5.1.10.6] [ec:6.1.1.18] [keggfc:5.1:10.1:10.2] [sgdfc:5.4.0:9.2.0] [db:gtc-*saccharomyces cerevisiae*] |
| CONTIG1083 | 93792_f1_1 | 4053 | 18156 | 417 | 139 | YOR303W | 387 | 5.7(10)-36 | *Saccharomyces cerevisiae* | [ui:yor303w] [pn:arginine-specific carbamoylphosphate synthase, small chain:carbamoyl-phosphate synthase, arginine-specific, small chain:arginine-specific carbamoyl-phosphate synthetase, glutamine chain:cps-a] [gn:cpa1] |
| CONTIG75 | 14273513_f3_1 | 4054 | 18157 | 726 | 242 | YOR303W | 787 | 2.3(10)-78 | *Saccharomyces cerevisiae* | [gtcfc:5.1.6.6] [ui:yor303w] [pn:arginine-specific carbamoylphosphate synthase, small chain:carbamoyl-phosphate synthase, arginine-specific, small chain:arginine-specific carbamoyl-phosphate synthetase, glutamine chain:cps-a] [gn:cpa1] |
| CONTIG4941 | 26692285_f2_2 | 4055 | 18158 | 1452 | 484 | YPL091W | 1521 | 4.0(10)-156 | *Saccharomyces cerevisiae* | [ui:ypl091w] [pn:madph:glutathione reductase:gr:grase] [gn:glr1:lpg17w] [gtcfc:5 1.6.16.12.12] [ec:1.6.4.2] [keggfc:5.1.6.9] [sgdfc:11.3.0] [db:gtc-*saccharomyces cerevisiae*] |
| CONTIG908 | 32460831_f2_1 | 4056 | 18159 | 897 | 299 | YGL017W | 479 | 1.0(10)-45 | *Saccharomyces cerevisiae* | [ui:ygl017w] [pn:arginyl trna transferase:arginyl-trna-protein transferase:arginyltransferase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x13k22.x | 488281_f1_1 | 4057 | 18160 | 729 | 243 | YKL157W | 826 | 1.8(10)-82 | Saccharomyces cerevisiae | [gn:ate1] [gtcfc:5.1.10.11:10.7:14.1] [ec:2.3.2.8] [keggfc:14.1] [sgdfc:1.1.5:6.3.0:6.5.1:9.2.0] [db:gtc-saccharomyces cerevisiae] [ui:ykl157w] [pn:aminopeptidase yscii:aminopeptidase ii:yscii] [gn:ape2:lap1:ykl611] [gtcfc:5.1:10.7] [ec:3.4.11.-] [keggfc:14.1] [sgdfc:1.1.5:6.3.0] [db:gtc-saccharomyces cerevisiae] |
| CONTIG3633 | 11760287_f1_1 | 4058 | 18161 | 573 | 191 | YPR069C | 699 | 5.0(10)-69 | Saccharomyces cerevisiae | [ui:ypr069c] [pn:putrescine aminopropyltransferase:spermidine synthase] [gn:spe3] [gtcfc:5.1] [keggfc:14.2] [sgdfc:1.1.5] [db:gtc-saccharomyces cerevisiae] |
| CONTIG4615 | 34179753_f3_8 | 4059 | 18162 | 453 | 151 | YPR069C | 519 | 6.0(10)-50 | Saccharomyces cerevisiae | [ui:ypr069c] [pn:putrescine aminopropyltransferase:spermidine synthase] [gn:spe3] [gtcfc:5.1] [keggfc:14.2] [sgdfc:1.1.5] [db:gtc-saccharomyces cerevisiae] |
| CONTIG5281 | 4098375_f1_2 | 4060 | 18163 | 1044 | 348 | YPR069C | 767 | 3.1(10)-76 | Saccharomyces cerevisiae | [ui:ypr069c] [pn:putrescine aminopropyltransferase:spermidine synthase] [gn:spe3] [gtcfc:5.1] [keggfc:14.2] [sgdfc:1.1.5] [db:gtc-saccharomyces cerevisiae] |
| CONTIG5804 | 3212575_c2_53 | 4061 | 18164 | 996 | 332 | YER023W | 580 | 2.1(10)-56 | Saccharomyces cerevisiae | [ui:yer023w] [pn:delta 1-pyrroline-5-carboxylate reductase:pyrroline-5-carboxylate reductase:p5crp5c reductase] [gn:pro3:ore2] [gtcfc:5.10:5.16:6.6] [ec:1.5.1.2] [keggfc:5.10:5.16] [sgdfc:1.1.1:9.2.0] [db:gtc-saccharomyces cerevisiae] |
| b9x11y87.y | 36367205_c2_1 | 4062 | 18165 | 546 | 182 | YER087W | 465 | 3.2(10)-44 | Saccharomyces cerevisiae | [ui:yer087w] [pn:similarity to e. coli prolyl-trna synthetase:putative prolyl-trna synthetase yer087w:proline-trna ligase:prors] [gtcfc:5.10:10.6] [ec:6.1.1.15] [keggfc:5.10:10.1:10.2] [sgdfc:5.4.0] [db:gtc-saccharomyces cerevisiae] |
| CONTIG5287 | 24411686_c1_5 | 4063 | 18166 | 1503 | 501 | YHR018C | 1811 | 7.4(10)-187 | Saccharomyces cerevisiae | [ui:yhr018c] [pn:arginosuccinate lyase:argininosuccinate lyase:argininosuccinase:asal] [gn:arg4] [gtcfc:5.10:5.16:5.2:6.6] [ec:4.3.2.1] [keggfc:5.2:5.10:5.16] [sgdfc:1.1.1:9.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5186 | 16836660_c3_18 | 4064 | 18167 | 2082 | 694 | YHR020W | 2134 | 4.4(10)-221 | *Saccharomyces cerevisiae* | *saccharomyces cerevisiae* [ui:yhr020w] [pn:strong similarity to human glutamyl-prolyl-trna synthetase and fruit fly multifunctional aminoacyl-trna synthetase:putative prolyl-trna synthetase yhr020w:proline--trna ligase:prors] [gtcfc:5.10:10.6] [ec:6.1.1.15] [k |
| CONTIG5595 | 4068753_c3_15 | 4065 | 18168 | 1062 | 354 | YJL088W | 1062 | 1.7(10)-107 | *Saccharomyces cerevisiae* | [ui:yjl088w] [pn:ornithine carbamoyltransferase:otc] [gn:arg3:j0924] [gtcfc:5.10:5.16:6.6] [ec:2.1.3.3] [keggfc:5.10:5.16] [sgdfc:1.1.1.9.2.0] [db:gtc-*saccharomyces cerevisiae* |
| CONTIG5176 | 12141552_f3_4 | 4066 | 18169 | 1275 | 425 | YOL052C | 694 | 1.7(10)-68 | *Saccharomyces cerevisiae* | [ui:yol052c] [pn:adenosylmethionine decarboxylase precursor:s-adenosylmethionine decarboxylase proenzyme:adometdc] [gn:spe2:o1275] [gtcfc:5.10.12.12:12.15:12.8] [ec:4.1.1.50] [keggfc:5.10] [sgdfc:3.1.0:3.4.0:11.3.0] [db:gtc-saccharomy |
| CONTIG3628 | 4961801_c1_2 | 4067 | 18170 | 1017 | 339 | YBR248C | 903 | 1.2(10)-90 | *Saccharomyces cerevisiae* | [ui:ybr248c] [pn:glutamine amidotransferase/cyclase:histidine biosynthesis bifunctional amidotransferase/cyclase] [gn:his7:ybr1640] [gtcfc:5.11:6.6] [ec:2.4.2.-] [keggfc:5.11] [sgdfc:1.1.1] [db:gtc-*saccharomyces cerevisiae* |
| CONTIG11 | 14267186_c3_3 | 4068 | 18171 | 645 | 215 | YCL030C | 777 | 2.7(10)-77 | *Saccharomyces cerevisiae* | [ui:ycl030c] [pn:phosphoribosyl-amp cyclohydrolase/phosphoribosyl-atp pyrophosphatase:phosphoribosyl dehydrogenase:phosphoribosyl-amp cyclohydrolase/phosphoribosyl-atp pyrophosphohydrolase/histidinol dehydrogenase:hdh] [gn:his4:ycl30c: |
| CONTIG39 | 11727013_f1_1 | 4069 | 18172 | 549 | 183 | YCL030C | 590 | 1.8(10)-57 | *Saccharomyces cerevisiae* | [ui:ycl030c] [pn:phosphoribosyl-amp cyclohydrolase/phosphoribosyl-atp pyrophosphatase:phosphoribosyl dehydrogenase:phosphoribosyl |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | amp cyclohydrolase/ phosphoribosyl-atp pyrophosphohydrolase/histidinol dehydrogenase:hdh [gn:his4:ycl30c: |
| CONTIG640 | 20117067_f2_1 | 4070 | 18173 | 603 | 201 | YCL030C | 335 | 1.8(10)-29 | *Saccharomyces cerevisiae* | [ui:ycl030c] [pn:phosphoribosyl-amp cyclohydrolase/phosphoribosyl-atp pyrophosphatase:phosphoribosyl-atp pyrophosphohydrolase/histidinol dehydrogenase:hdh [gn:his4:ycl30c: |
| CONTIG640 | 24245950_f3_2 | 4071 | 18174 | 486 | 162 | YCL030C | 397 | 4.0(10)-36 | *Saccharomyces cerevisiae* | [ui:ycl030c] [pn:phosphoribosyl-amp cyclohydrolase/phosphoribosyl-atp pyrophosphatase:phosphoribosyl amp cyclohydrolase/ phosphoribosyl-atp pyrophosphohydrolase/histidinol dehydrogenase:hdh [gn:his4:ycl30c: |
| CONTIG1055 | 21603188_f3_3 | 4072 | 18175 | 396 | 132 | YER055C | 338 | 9.0(10)-31 | *Saccharomyces cerevisiae* | [ui:yer055c] [pn:atp phosphoribosyltransferase] [gn:his1] [gtcfc:5.11:6.6:10.2] [ec:2.4.2.17] [keggfc:5.11] [sgdfc:1.1.1.1.2] [db:gtc-*saccharomyces cerevisiae*] |
| CONTIG5523 | 268482[_f3_11 | 4073 | 18176 | 471 | 157 | YER055C | 427 | 3.3(10)-40 | *Saccharomyces cerevisiae* | [ui:yer055c] [pn:atp phosphoribosyltransferase] [gn:his1] [gtcfc:5.11:6.6:10.2] [ec:2.4.2.17] [keggfc:5.11] [sgdfc:1.1.1.1.2] [db:gtc-*saccharomyces cerevisiae*] |
| CONTIG5186 | 22379577_f2_2 | 4074 | 18177 | 957 | 319 | YFR025C | 609 | 1.7(10)-59 | *Saccharomyces cerevisiae* | [ui:yfr025c] [pn:histidinol phosphatase:histidinol-phosphatase] [gn:his2] [gtcfc:5.11:6.6] [ec:3.1.3.15] [keggfc:5.11] [sgdfc:1.1.1] [db:gtc-*saccharomyces cerevisiae*] |
| CONTIG3249 | 21492151_c3_6 | 4075 | 18178 | 474 | 158 | YIL116W | 346 | 1.3(10)-31 | *Saccharomyces cerevisiae* | [ui:yil116w] [pn:histidinol-phosphate aminotransferase:imidazole acetol-phosphate transaminase] [gn:his5] [gtcfc:5.11:6.6] [ec:2.6.1.9] [keggfc:1.1.1] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x10611.y | 3944090_f2_1 | 4076 | 18179 | 324 | 108 | YIL116W | 205 | 3.6(10)-16 | Saccharomyces cerevisiae | [ui:yil116w] [pn:histidinol-phosphate aminotransferase:imidazole acetol-phosphate transaminase] [gn:his5] [gtcfc:5.11:6.6] [ec:2.6.1.9] [keggfc:5.11] [sgdfc:1.1.1] [db:gtc-saccharomyces cerevisiae] |
| CONTIG691 | 23831588_c2_2 | 4077 | 18180 | 432 | 144 | YMR283C | 143 | 4.0(10)-9 | Saccharomyces cerevisiae | [ui:ymr283c] [pn:trna a64-2''-o-ribosylphosphate transferase:initiator trna phosphoribosyl-transferase] [gn:rit1:ym8021] [gtcfc:5.11:10.6] [ec:2.4.2.-] [keggfc:5.11] [sgdfc:4.6.0] [db:gtc-saccharomyces cerevisiae] |
| b3x16442.x | 29955088_f2_1 | 4078 | 18181 | 216 | 72 | YMR283C | 172 | 3.0(10)-12 | Saccharomyces cerevisiae | [ui:ymr283c] [pn:trna a64-2''-o-ribosylphosphate transferase:initiator trna phosphoribosyl-transferase] [gn:rit1:ym8021] [gtcfc:5.11:10.6] [ec:2.4.2.-] [keggfc:5.11] [sgdfc:4.6.0] [db:gtc-saccharomyces cerevisiae] |
| b3x16442.x | 4804701_f2_2 | 4079 | 18182 | 408 | 136 | YMR283C | 116 | 3.2(10)-6 | Saccharomyces cerevisiae | [ui:ymr283c] [pn:trna a64-2''-o-ribosylphosphate transferase:initiator trna phosphoribosyl-transferase] [gn:rit1:ym8021] [gtcfc:5.11:10.6] [ec:2.4.2.-] [keggfc:5.11] [sgdfc:4.6.0] [db:gtc-saccharomyces cerevisiae] |
| CONTIG3477 | 10742187_f3_5 | 4080 | 18183 | 1545 | 515 | YPR033C | 1727 | 5.9(10)-178 | Saccharomyces cerevisiae | [ui:ypr033c] [pn:histidine--trna ligase, mitochondrial:histidyl-trna synthetase, mitochondrial precursor:histidine--trna ligase:hisrs] [gn:hts1:yp9367] [gtcfc:5.11:10.1:10.2:10.6] [ec:6.1.1.21] [keggfc:5.11:10.1:10.2] [sgdfc:5.4.0:9.2 |
| CONTIG1853 | 33383541_f3_1 | 4081 | 18184 | 1074 | 358 | YER125W | 387 | 5.0(10)-35 | Saccharomyces cerevisiae | [ui:yer125w] [pn:ubiquitin-protein ligase:rsp5 protein] [gn:rsp5:npl1:sygp-orf41] [gtcfc:5.14:5.9:10.11:10.7:11.1:12.15:13.2] [ec:6.3.2.-] [keggfc:5.9:5.14] [sgdfc:3.4.0:6.3:0:6.5.1.9.10:11.1.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3384 | 11853377_f3_6 | 4082 | 18185 | 702 | 234 | YER125W | 373 | 1.6(10)-33 | Saccharomyces cerevisiae | [ui:yer125w] [pn:ubiquitin-protein ligase:rsp5 protein] [gn:rsp5:npl1:sygp-orf41] [gtcfc:5.14:5.9:10.11:10.7:11.1:12.15:13.2] [ec:6.3.2.-] [keggfc:5.9.5.14] [sgdfc:3.4.0:6.3.0:6.5.1:9.1.0:11.1.0] [db:gtc-saccharomyces cerevisiae] |
| CONTIG3384 | 14276538_f1_2 | 4083 | 18186 | 267 | 89 | YER125W | 272 | 1.2(10)-22 | Saccharomyces cerevisiae | [ui:yer125w] [pn:ubiquitin-protein ligase:rsp5 protein] [gn:rsp5:npl1:sygp-orf41] [gtcfc:5.14:5.9:10.11:10.7:11.1:12.15:13.2] [ec:6.3.2.-] [keggfc:5.9.5.14] [sgdfc:3.4.0:6.3.0:6.5.1:9.1.0:11.1.0] [db:gtc-saccharomyces cerevisiae] |
| CONTIG4226 | 20798943_c3_11 | 4084 | 18187 | 1395 | 465 | YER125W | 2064 | 4.9(10)-218 | Saccharomyces cerevisiae | [ui:yer125w] [pn:ubiquitin-protein ligase:rsp5 protein] [gn:rsp5:npl1:sygp-orf41] [gtcfc:5.14:5.9:10.11:10.7:11.1:12.15:13.2] [ec:6.3.2.-] [keggfc:5.9.5.14] [sgdfc:3.4.0:6.3.0:6.5.1:9.1.0:11.1.0] [db:gtc-saccharomyces cerevisiae] |
| CONTIG901 | 597177_f3_3 | 4085 | 18188 | 333 | 111 | YER125W | 207 | 1.1(10)-15 | Saccharomyces cerevisiae | [ui:yer125w] [pn:ubiquitin-protein ligase:rsp5 protein] [gn:rsp5:npl1:sygp-orf41] [gtcfc:5.14:5.9:10.11:10.7:11.1:12.15:13.2] [ec:6.3.2.-] [keggfc:5.9.5.14] [sgdfc:3.4.0:6.3.0:6.5.1:9.1.0:11.1.0] [db:gtc-saccharomyces cerevisiae] |
| CONTIG3410 | 21882942_c1_8 | 4086 | 18189 | 465 | 155 | YHR068W | 509 | 6.9(10)-49 | Saccharomyces cerevisiae | [ui:yhr068w] [pn:deoxyhypusine synthase] [gn:dys1] [gtcfc:5.14:6.6] [ec:1.5.1.-] [keggfc:5.14] [sgdfc:1.1.1] [db:gtc-saccharomyces cerevisiae] |
| CONTIG4466 | 7073431_f2_3 | 4087 | 18190 | 630 | 210 | YHR068W | 662 | 4.2(10)-65 | Saccharomyces cerevisiae | [ui:yhr068w] [pn:deoxyhypusine synthase] [gn:dys1] [gtcfc:5.14:6.6] [ec:1.5.1.-] [keggfc:5.14] [sgdfc:1.1.1] [db:gtc-saccharomyces cerevisiae] |
| CONTIG5378 | 24417330_f1_1 | 4088 | 18191 | 1527 | 509 | YBR166C | 1480 | 8.8(10)-152 | Saccharomyces cerevisiae | [ui:ybr166c] [pn:prephenate dehydrogenase:nadp+:prdh] [gn:tyr1:ybr1218] [gtcfc:5.15:6.6] [ec:1.3.1.13] [keggfc:5.15] [sgdfc:1.1.1:9.2.0] [db:gtc-saccharomyces cerevisiae] |
| CONTIG3412 | 14642827_c2_4 | 4089 | 18192 | 1113 | 371 | YBR249C | 1135 | 3.2(10)-115 | Saccharomyces cerevisiae | [ui:ybr249c] [pn:2-dehydro-3- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | deoxyphosphoheptonate aldolase, tyrosine-inhibited:phospho-2-dehydro-3-deoxyheptonate aldolase, tyrosine-inhibited:phospho-2-keto-3-deoxyheptonate aldolase:dahp synthetase:3-deoxy-d-arabino-heptulosonate 7- |
| CONTIG245 | 867061_f2_1 | 4090 | 18193 | 537 | 179 | YDR035W | 694 | 1.7(10)-68 | Saccharomyces cerevisiae | [ui:ydr035w] [pn:2-dehydro-3-deoxyphosphoheptonate aldolase, phenylalanine- inhibited:phospho-2-dehydro-3-deoxyheptonate aldolase, phenylalanine-inhibited:phospho-2-keto-3-deoxyheptonate aldolase:dahp synthetase:3-deoxy-d-arabino-heptu |
| b9x11u19.y | 12324218_c1_3 | 4091 | 18194 | 435 | 145 | YDR035W | 156 | 8.3(10)-11 | Saccharomyces cerevisiae | [ui:ydr035w] [pn:2-dehydro-3-deoxyphosphoheptonate aldolase, phenylalanine- inhibited:phospho-2-dehydro-3-deoxyheptonate aldolase, phenylalanine-inhibited:phospho-2-keto-3-deoxyheptonate aldolase:dahp synthetase:3-deoxy-d-arabino-heptu |
| CONTIG2409 | 31878755_f1_1 | 4092 | 18195 | 828 | 276 | YDR127W | 695 | 2.6(10)-67 | Saccharomyces cerevisiae | [ui:ydr127w] [pn:arom pentafunctional enzyme:pentafunctional arom polypeptide:contains:3-dehydroquinate synthase, 3-dehydroquinate dehydratase:3-dehydroquinase, shikimate 5-dehydrogenase, shikimate kinase, and epsp synthase] [gn:ar |
| CONTIG539 | 16281957_f3_1 | 4093 | 18196 | 801 | 267 | YDR127W | 663 | 6.7(10)-64 | Saccharomyces cerevisiae | [ui:ydr127w] [pn:arom pentafunctional enzyme:pentafunctional arom polypeptide:contains:3-dehydroquinate synthase, 3-dehydroquinate dehydratase:3-dehydroquinase, shikimate 5-dehydrogenase, shikimate kinase, and epsp synthase] [gn:ar |
| CONTIG359 | 20437904_c2_3 | 4094 | 18197 | 1266 | 422 | YDR127W | 1384 | 1.3(10)-141 | Saccharomyces cerevisiae | [ui:ydr127w] [pn:arom pentafunctional enzyme:pentafunctional arom polypeptide:contains:3-dehydroquinate synthase, 3- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2181 | 20833425_c2_5 | 4095 | 18198 | 1140 | 380 | YDR354W | 539 | 1.7(10)-61 | Saccharomyces cerevisiae | dehydroquinate dehydratase:3-dehydroquinase, shikimate 5-dehydrogenase, shikimate kinase, and epsp synthase] [gn:ar [ui:ydr354w] [pn:anthranilate phosphoribosyltransferase] [gn:trp4:d9476] [gtcfc:5.1 5:6.6] [ec:2.4.2.18] [keggfc:5.15] [sgdfc:1.1.1:9.2.0] [db:gtc-saccharomyces cerevisiae] |
| CONTIG3009 | 10392192_c3_7 | 4096 | 18199 | 906 | 302 | YER090W | 1123 | 5.9(10)-114 | Saccharomyces cerevisiae | [ui:yer090w] [pn:anthranilate synthase component i] [gn:trp2] [gtcfc:5.15:6.6.9.12] [ec:4.1.3.27] [keggfc:5.15:9.13] [sgdfc:1.1.1:9.2.0] [db:gtc-saccharomyces cerevisiae] |
| CONTIG5248 | 14647587_c3_10 | 4097 | 18200 | 651 | 217 | YER090W | 471 | 7.2(10)-45 | Saccharomyces cerevisiae | [ui:yer090w] [pn:anthranilate synthase component i] [gn:trp2] [gtcfc:5.15:6.6.9.12] [ec:4.1.3.27] [keggfc:5.15:9.13] [sgdfc:1.1.1:9.2.0] [db:gtc-saccharomyces cerevisiae] |
| CONTIG724 | 35194191_c2_3 | 4098 | 18201 | 942 | 314 | YFL022C | 652 | 4.7(10)-64 | Saccharomyces cerevisiae | [ui:yfl022c] [pn:phenylalanine--trna ligase beta chain, cytosolic:phenylalanyl-trna synthetase beta chain cytoplasmic:phenylalanine--trna ligase beta chain] [gn:frs2] [gtcfc:5.15:10.6] [ec:6.1.1.20] [keggfc:5.15:10.1:10.2] [sgdfc:5.4. |
| CONTIG5535 | 129161_c2_15 | 4099 | 18202 | 1080 | 360 | YGL148W | 1135 | 3.2(10)-115 | Saccharomyces cerevisiae | [ui:ygl148w] [pn:chorismate synthase:5-enolpyruvylshikimate-3-phosphate phospholyase] [gn:aro2] [gtcfc:5.15:6.6] [ec:4.6.1.4] [keggfc:5.15] [sgdfc:1.1.1:9.2.0] [db:gtc-saccharomyces cerevisiae] |
| CONTIG5464 | 24033510_f2_7 | 4100 | 18203 | 288 | 96 | YGL148W | 146 | 1.1(10)-9 | Saccharomyces cerevisiae | [ui:ygl148w] [pn:chorismate synthase:5-enolpyruvylshikimate-3-phosphate phospholyase] [gn:aro2] [gtcfc:5.15:6.6] [ec:4.6.1.4] [keggfc:5.15] [sgdfc:1.1.1:9.2.0] [db:gtc-saccharomyces cerevisiae] |
| CONTIG5088 | 14188317_f2_1 | 4101 | 18204 | 1644 | 548 | YGL026C | 2224 | 1.3(10)-230 | Saccharomyces cerevisiae | [ui:ygl026c] [pn:tryptophan synthase] [gn:trp5] [gtcfc:5.15:6.6] [ec:4.2.1.20] [keggfc:5.15] [sgdfc:1.1.1:9.2.0] [db:gtc-saccharomyces cerevisiae] |
| CONTIG3493 | 24331527_f3_2 | 4102 | 18205 | 1038 | 346 | YGR185C | 1228 | 4.4(10)-125 | Saccharomyces cerevisiae | [ui:ygr185c] [pn:tyrosyl-trna synthetase:tyrosyl-trna synthetase, |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG712 | 197291_c3_5 | 4103 | 18206 | 324 | 108 | YGR185C | 148 | 7.2(10)-10 | *Saccharomyces cerevisiae* | cytoplasmic:tyrosyl--trna ligase:tyrrs [gn:tys1:mgm104:g7522] [gtcfc:5.15:10.6] [ec:6.1.1.1] [keggfc:5.15:10.1:10.2] [sgdfc:5.4.0:9.2.0] [dbgtc-*saccharomyces cerevisi* [ui:ygr185c] [pn:tyrosyl-trna synthetase:tyrosyl-trna synthetase, cytoplasmic:tyrosyl--trna ligase:tyrrs [gn:tys1:mgm104:g7522] [gtcfc:5.15:10.6] [ec:6.1.1.1] [keggfc:5.15:10.1:10.2] [sgdfc:5.4.0:9.2.0] [dbgtc-*saccharomyces cerevisi* |
| CONTIG2552 | 195312_f3_4 | 4104 | 18207 | 1050 | 350 | YKL211C | 799 | 1.3(10)-79 | *Saccharomyces cerevisiae* | [ui:ykl211c] [pn:anthranilate synthase component ii:contains:glutamine amidotransferase:indole-3-glycerol phosphate synthase:prai] [gn:trp3] [gtcfc:5.15:6.6:9.12] [keggfc:5.15:9.13] [sgdfc:1.1.1:9.2.0] [dbgtc-*saccharomyces cerevisiae* |
| CONTIG735 | 2914843_c1_3 | 4105 | 18208 | 285 | 95 | YKL211C | 203 | 1.1(10)-15 | *Saccharomyces cerevisiae* | [ui:ykl211c] [pn:anthranilate synthase component ii:contains:glutamine amidotransferase:indole-3-glycerol phosphate synthase:prai] [gn:trp3] [gtcfc:5.15:6.6:9.12] [keggfc:5.15:9.13] [sgdfc:1.1.1:9.2.0] [dbgtc-*saccharomyces cerevisiae* |
| CONTIG2916 | 9877291_f2_1 | 4106 | 18209 | 723 | 241 | YLR060W | 781 | 1.0(10)-77 | *Saccharomyces cerevisiae* | [ui:ylr060w] [pn:phenylalanyl-trna synthetase, alpha subunit, cytosolic:phenylalanyl-trna synthetase alpha chain cytoplasmic:phenylalanine--trna ligase alpha chain:phers] [gn:frs1:12165] [gtcfc:5.15:10.6] [ec:6.1.1.20] [keggfc:5.15:15:10 |
| CONTIG2916 | 22690962_f2_2 | 4107 | 18210 | 258 | 86 | YLR060W | 278 | 1.3(10)-23 | *Saccharomyces cerevisiae* | [ui:ylr060w] ] pn:phenylalanyl-trna synthetase, alpha subunit, cytosolic:phenylalanyl-trna synthetase alpha chain cytoplasmic:phenylalanine--trna ligase alpha chain:phers] [gn:frs1:12165] [gtcfc:5.15:10.6] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5007 | 9879376_f3_5 | 4108 | 18211 | 807 | 269 | YLR060W | 879 | 4.2(10)-88 | *Saccharomyces cerevisiae* | [ec:6.1.1.20] [ui:ylf060w] [pn:phenylalanyl-trna synthetase, alpha subunit, cytosolic:phenylalanyl-trna synthetase alpha chain cytoplasmic:phenylalanine--trna ligase alpha chain:phers] [gn:frs1:12165] [gtcfc:5.15:10.6] [ec:6.1.1.20] [keggfc:5.15:10 |
| CONTIG5142 | 24398452_f3_3 | 4109 | 18212 | 801 | 267 | YNL316C | 237 | 8.0(10)-30 | *Saccharomyces cerevisiae* | [ui:ynl316c] [pn:prephenate dehydratase:pdt] [gn:pha2:n0351] [gtcfc:5.15:6.6] [ec:4.2.1.51] [keggfc:5.15] [sgdfc:1.1.1.9.2.0] [db:gtc-*saccharomyces cerevisiae* |
| CONTIG5677 | 16582932_c3_27 | 4110 | 18213 | 948 | 316 | YPR060C | 807 | 1.8(10)-80 | *Saccharomyces cerevisiae* | [ui:ypt060c] [pn:chorismate mutase:cm] [gn:aro7:osm2:yp9499] [gtcfc:5.15:6.6] [ec:5.4.99.5] [keggfc:5.15] [sgdfc:1.1.1.9.2.0] [db:gtc-*saccharomyces cerevisiae* |
| CONTIG5792 | 4788128_f1_4 | 4111 | 18214 | 1281 | 427 | YDR300C | 1190 | 4.7(10)-121 | *Saccharomyces cerevisiae* | [ui:ydr300c] [pn:glutamate 5-kinase:gamma-glutamyl kinase:g:k kinase] [gn:pro1:d9740] [gtcfc:5.16:6.6] [ec:2.7.2.11] [keggfc:5.16] [sgdfc:1.1.1.9.2.0] [db:gtc-*saccharomyces cerevisiae* |
| CONTIG1365 | 789078_c3_2 | 4112 | 18215 | 849 | 283 | YOR323C | 781 | 1.0(10)-77 | *Saccharomyces cerevisiae* | [ui:yor323c] [pn:gamma-glutamyl phosphate reductase:gpr:glutamate-5-semialdehyde dehydrogenase:glutamyl-gamma semialdehyde dehydrogenase] [gn:pro2:o6155] [gtcfc:5.16:6.6:9.10] [ec:1.2.1.41] [keggfc:5.16:9.10] [sgdfc:1.1.1] [db:gtc-sa |
| CONTIG3268 | 21675425_f3_4 | 4113 | 18216 | 327 | 109 | YOR323C | 150 | 5.7(10)-10 | *Saccharomyces cerevisiae* | [ui:yor323c] [pn:gamma-glutamyl phosphate reductase:gpr:glutamate-5-semialdehyde dehydrogenase:glutamyl-gamma-semialdehyde dehydrogenase] [gn:pro2:o6155] [gtcfc:5.16:6.6:9.10] [ec:1.2.1.41] [keggfc:5.16:9.10] [sgdfc:1.1.1] [db:gtc-sa |
| CONTIG4888 | 36516688_f1_1 | 4114 | 18217 | 963 | 321 | YHR019C | 836 | 9.3(10)-90 | *Saccharomyces cerevisiae* | [ui:yhr019c] [pn:asparaginyl-trna synthetase:putative asparaginyl-trna synthetase:asparagine--trna ligase:asnrs] [gn:ded81] [gtcfc:5.2:10.6] [ec:6.1.1.22] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4888 | 2766578_f3_3 | 4115 | 18218 | 654 | 218 | YHR019C | 887 | 6.0(10)-89 | *Saccharomyces cerevisiae* | [keggfc:5.2:10.1:10.2] [sgdfc:5.4.0] [db:gtc-saccharomyces cerevisiae] [ui:yhr019c] [pn:asparaginyl-trna synthetase;putative asparaginyl-trna synthetase:asparagine--trna ligase:asnrs] [gn:ded81] [gcfc:5.2:10.6] [ec:6.1.1.22] [keggfc:5.2:10.1:10.2] [sgdfc:5.4.0] [db:gtc-saccharomyces cerevisiae] |
| CONTIG4106 | 53942_c1_5 | 4116 | 18219 | 564 | 188 | YLL018C | 741 | 1.8(10)-73 | *Saccharomyces cerevisiae* | [ui:yll018c] [pn:aspartyl-trna synthetase, cytosolic:aspartyl-trna synthetase, cytoplasmic:aspartate--trna ligase:asprs] [gn:dps1:aps1:aps:11295] [gcfc:5.2:10.6] [ec:6.1.1.12] [keggfc:5.2:10.6] [ec:6.1.1.12] [sgdfc:5.4.0:9.2.0] [db:gtc-saccha |
| CONTIG4495 | 21751587_f2_2 | 4117 | 18220 | 1221 | 407 | YLL018C | 741 | 1.8(10)-73 | *Saccharomyces cerevisiae* | [ui:yll018c] [pn:aspartyl-trna synthetase, cytosolic:aspartyl-trna synthetase, cytoplasmic:aspartate--trna ligase:asprs] [gn:dps1:aps1:aps:11295] [gcfc:5.2:10.6] [ec:6.1.1.12] [keggfc:5.2:10.1:10.2] [sgdfc:5.4.0:9.2.0] [db:gtc-saccha |
| CONTIG2325 | 26172812_c3_4 | 4118 | 18221 | 372 | 124 | YOR335C | 327 | 2.0(10)-28 | *Saccharomyces cerevisiae* | [ui:yor335c] [pn:alanyl-trna synthetase, cytosolic:alanyl-trna synthetase, cytoplasmic:alanine--trna ligase:alars] [gn:ala1] [gcfc:5.2:10.6:11.1] [ec:6.11.7] [keggfc:5.2:10.1:10.2] [sgdfc:5.4.0:9.1.0] [db:gtc-saccharomyces cerevisia |
| CONTIG2325 | 25656942_c3_3 | 4119 | 18222 | 300 | 100 | YOR335C | 180 | 1.1(10)-12 | *Saccharomyces cerevisiae* | [ui:yor335c] [pn:alanyl-trna synthetase, cytosolic:alanyl-trna synthetase, cytoplasmic:alanine--trna ligase:alars] [gn:ala1] [gcfc:5.2:10.6:11.1] [ec:6.1.1.7] [keggfc:5.2:10.1:10.2] [sgdfc:5.4.0:9.1.0] [db:gtc-saccharomyces cerevisia |
| CONTIG4725 | 25572577_c2_5 | 4120 | 18223 | 1452 | 484 | YOR335C | 1566 | 6.7(10)-161 | *Saccharomyces cerevisiae* | [ui:yor335c] [pn:alanyl-trna synthetase, cytosolic:alanyl-trna synthetase, cytoplasmic:alanine--trna ligase:alars] [gn:ala1] [gcfc:5.2:10.6:11.1] [ec:6.1.1.7] [keggfc:5.2:10.1:10.2] |

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x12989.y | 11751013_c3_3 | 4121 | 18224 | 531 | 177 | YOR335C | 621 | 3.2(10)-60 | *Saccharomyces cerevisiae* | [sgdfc:5.4.0:9.1.0] [db-gtc-*saccharomyces cerevisia* [ui:yor335c] [pn:alanyl-trna synthetase, cytosolic:alanyl-trna synthetase, cytoplasmic:alanine--trna ligase:alars] [gn:ala1] [gtcfc:5.2:10.6:11.1] [ec:6.1.1.7] [keggfc:5.2:10.1:10.2] [sgdfc:5.4.0:9.1.0] [db-gtc-*saccharomyces cerevisia* |
| b2x13837.x | 20912902_c3_2 | 4122 | 18225 | 444 | 148 | YBR121C | 408 | 1.2(10)-37 | *Saccharomyces cerevisiae* | [ui:ybr121c] [pn:glycyl-trna synthetase:glycine--trna ligase:glyrs] [gn:grs1:ybr0917] [gtcfc:5.3:10.6] [ec:6.1.1.14] [keggfc:5.3:10.1:10.2] [sgdfc:5.4.0:9.2.0] [db-gtc-*saccharomyces cerevisiae*] |
| CONTIG2090 | 5870969_c1_4 | 4123 | 18226 | 1386 | 462 | YBR121C | 1357 | 9.5(10)-139 | *Saccharomyces cerevisiae* | [ui:ybr121c] [pn:glycyl-trna synthetase:glycine--trna ligase:glyrs] [gn:grs1:ybr0917] [gtcfc:5.3:10.6] [ec:6.1.1.14] [keggfc:5.3:10.1:10.2] [sgdfc:5.4.0:9.2.0] [db-gtc-*saccharomyces cerevisiae*] |
| CONTIG4690 | 34398402_f3_3 | 4124 | 18227 | 1122 | 374 | YCL064C | 520 | 4.7(10)-50 | *Saccharomyces cerevisiae* | [ui:ycl064c] [pn:1-serine/1-threonine deaminase:catabolic 1-serine dehydratase:1-threonine deaminase/1-threonine dehydratase] [gn:cha1:ycl64c] [gtcfc:5.3:5.5] [keggfc:5.3:5.5] [sgdfc:1.1.4] [db:gtc-*saccharomyces c*] |
| CONTIG5213 | 4687875_f2_6 | 4125 | 18228 | 1164 | 388 | YCL064C | 435 | 4.7(10)-41 | *Saccharomyces cerevisiae* | [ui:ycl064c] [pn:1-serine/1-threonine deaminase:catabolic 1-serine dehydratase:1-threonine deaminase/1-threonine dehydratase] [gn:cha1:ycl64c] [gtcfc:5.3:5.5] [keggfc:5.3:5.5] [sgdfc:1.1.4] [db:gtc-*saccharomyces c*] |
| CONTIG1064 | 12926676_f2_1 | 4126 | 18229 | 531 | 177 | YCR053W | 530 | 4.0(10)-51 | *Saccharomyces cerevisiae* | [ui:ycr053w] [pn:o-p-homoserine p-lyase:threonine synthase] [gn:thr4:ycr53w] [gtcfc:5.3:6.6:9.3] [ec:4.2.99.2] [keggfc:5.3:9.3] [sgdfc:1.1.1:9.2.0] [db-gtc-*saccharomyces cerevisiae*] |
| CONTIG3063 | 12926676_f3_2 | 4127 | 18230 | 303 | 101 | YCR053W | 243 | 5.7(10)-20 | *Saccharomyces cerevisiae* | [ui:ycr053w] [pn:o-p-homoserine p-lyase:threonine synthase] [gn:thr4:ycr53w] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5366 | 30603762_f1_1 | 4128 | 18231 | 1071 | 357 | YCR053W | 1123 | 5.9(10)-114 | *Saccharomyces cerevisiae* | [gtcfc:5.3.6.6;9.3] [ec:4.2.99.2] [keggfc:5.3.9.3] [sgdfc:1.1.1:9.2.0] [db:gtc-*saccharomyces cerevisiae*] [ui:ycr053w] [pn:o-p-homoserine p-lyase:threonine synthase] [gn:thr4;ycr53w] [gtcfc:5.3.6.9;9.3] [ec:4.2.99.2] [keggfc:5.3.9.3] [sgdfc:1.1.1:9.2.0] [db:gtc-*saccharomyces cerevisiae*] |
| CONTIG1772 | 1562_f2_2 | 4129 | 18232 | 1077 | 359 | YDR023W | 1242 | 1.5(10)-126 | *Saccharomyces cerevisiae* | [ui:ydr023w] [pn:seryl-trna synthetase, cytosolic:seryl-trna synthetase, cytoplasmic:serine--trna ligase:serrs] [gn:ses1;sers:yd9813] [gtcfc:5.3:10.6] [ec:6.1.1.11] [keggfc:5.3:10.1:10.2] [sgdfc:5.4.0:9.2.0] [db:gtc-*saccharomyces cer*] |
| CONTIG4014 | 34197502_c2_9 | 4130 | 18233 | 774 | 258 | YDR158W | 878 | 5.4(10)-88 | *Saccharomyces cerevisiae* | [ui:ydr158w] [pn:aspartate-semialdehyde dehydrogenase:asa dehydrogenase:asa dh] [gn:hom2;yd8358] [gtcfc:5.3:5.8;6.6] [ec:1.2.1.11] [keggfc:5.3.5.8] [sgdfc:1.1.1] [db:gtc-*saccharomyces cerevisiae*] |
| CONTIG533 | 859627_f1_1 | 4131 | 18234 | 324 | 108 | YDR158W | 295 | 3.2(10)-26 | *Saccharomyces cerevisiae* | [ui:ydr158w] [pn:aspartate-semialdehyde dehydrogenase:asa dehydrogenase:asa dh] [gn:hom2;yd8358] [gtcfc:5.3:5.8;6.6] [ec:1.2.1.11] [keggfc:5.3.5.8] [sgdfc:1.1.1] [db:gtc-*saccharomyces cerevisiae*] |
| CONTIG4049 | 10548137_c1_3 | 4132 | 18235 | 1647 | 549 | YER052C | 1470 | 1.0(10)-150 | *Saccharomyces cerevisiae* | [ui:yer052c] [pn:1-aspartate 4-p-transferase:aspartokinase:aspartate kinase] [gn:hom3] [gtcfc:5.3:5.8;6.6] [ec:2.7.2.4] [keggfc:5.3.5.8] [sgdfc:1.1.1] [db:gtc-*saccharomyces cerevisiae*] |
| CONTIG2043 | 14563786_c2_4 | 4133 | 18236 | 633 | 211 | YER081W | 787 | 2.3(10)-78 | *Saccharomyces cerevisiae* | [ui:yer081w] [pn:strong similarity to phosphoglycerate dehydrogenases:putative d-3-phosphoglycerate dehydrogenase yer081w:pgdh] [gtcfc:5.3:6.6] [ec:1.1.1.95] [keggfc:5.3] [sgdfc:1.1.1] [db:gtc-*saccharomyces cerevisiae*] |
| CONTIG4919 | 2930192_f3_5 | 4134 | 18237 | 183 | 61 | YER081W | 119 | 1.3(10)-6 | *Saccharomyces cerevisiae* | [ui:yer081w] [pn:strong similarity to phosphoglycerate dehydrogenases:putative d-3- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5749 | 24414063_c3_24 | 4135 | 18238 | 1557 | 519 | YGR155W | 981 | 65(10)-99 | Saccharomyces cerevisiae | phosphoglycerate dehydrogenase yer081w:pgdh] [gtcfc:5.3:6.6] [ec:1.1.1.95] [keggfc:5.3] [sgdfc:1.1.1] [db:gtc-saccharomyces cerevisiae [ui:ygr155w] [pn:cystathionine beta-synthase:serine sulfhydrase:beta-thionase] [gn:cys4:str4:g6667] [gtcfc:5.3:5.4:6.4:6.6] [ec:4.2.1.22] [keggfc:5.3:5.4:6.4] [sgdfc:1.1.1] [db:gtc-saccharomyces cerevisiae |
| CONTIG4612 | 3960825_f1_1 | 4136 | 18239 | 603 | 201 | YGR208W | 532 | 2.5(10)-51 | Saccharomyces cerevisiae | [ui:ygr208w] [pn:phosphoserine phosphatase:o-phosphoserine phosphohydrolase:psp] [gn:ser2:g7744] [gtcfc:5.3:6.3:6.6] [ec:3.1.3.3] [keggfc:5.3] [sgdfc:1.1.1:16.0.0] [db:gtc-saccharomyces cerevisiae |
| b3x16033.y | 11855379_c2_4 | 4137 | 18240 | 738 | 246 | YGR208W | 118 | 6.4(10)-5 | Saccharomyces cerevisiae | [ui:ygr208w] [pn:phosphoserine phosphatase:o-phosphoserine phosphohydrolase:psp] [gn:ser2:g7744] [gtcfc:5.3:6.3:6.6] [ec:3.1.3.3] [keggfc:5.3] [sgdfc:1.1.1:16.0.0] [db:gtc-saccharomyces cerevisiae |
| CONTIG5780 | 14876562_c3_38 | 4138 | 18241 | 288 | 96 | YHR011W | 227 | 2.2(10)-18 | Saccharomyces cerevisiae | [ui:yhr011w] [pn:seryl-trna synthetase:putative seryl-trna synthetase yhr011w:serine–trna ligase:serrs] [gtcfc:5.3:10.6] [ec:6.1.1.11] [keggfc:5.3:10:10.2] [sgdfc:5.4.0] [db:gtc-saccharomyces cerevisiae |
| CONTIG5780 | 25635056_c2_32 | 4139 | 18242 | 1296 | 432 | YHR011W | 768 | 2.5(10)-76 | Saccharomyces cerevisiae | [ui:yhr011w] [pn:seryl-trna synthetase:putative seryl-trna synthetase yhr011w:serine–trna ligase:serrs] [gtcfc:5.3:10.6] [ec:6.1.1.11] [keggfc:5.3:10:10.2] [sgdfc:5.4.0] [db:gtc-saccharomyces cerevisiae |
| CONTIG3817 | 10937590_f1_1 | 4140 | 18243 | 1194 | 398 | YHR025W | 981 | 6.5(10)-99 | Saccharomyces cerevisiae | [ui:yhr025w] [pn:homoserine kinase:hk] [gn:thr1] [gtcfc:5.3:6.6] [ec:2.7.1.39] [keggfc:5.3] [sgdfc:1.1.1] [db:gtc-saccharomyces cerevisiae |
| CONTIG1776 | 4803801_f1_1 | 4141 | 18244 | 312 | 104 | YIL078W | 219 | 4.7(10)-17 | Saccharomyces cerevisiae | [ui:yil078w] [pn:threonyl trna |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | synthetase, cytosolic:threonyl-trna synthetase, cytoplasmic:threonine--trna ligase:thrrs1 [gn:ths1] [gtcfc:5.3:10.6] [ec:6.1.1.3] [keggfc:5.3:10.1:10.2] [sgdfc:5.4.0:9.2.0] [db:gtc-saccharomyces cerevisi |
| CONTIG3658 | 16972257_c2_11 | 4142 | 18245 | 813 | 271 | YIL078W | 865 | 1.3(10)-86 | Saccharomyces cerevisiae | [ui:yil078w] [pn:threonyl trna synthetase, cytosolic:threonyl-trna synthetase, cytoplasmic:threonine--trna ligase:thrrs1 [gn:ths1] [gtcfc:5.3:10.6] [ec:6.1.1.3] [keggfc:5.3:10.1:10.2] [sgdfc:5.4.0:9.2.0] [db:gtc-saccharomyces cerevisi |
| CONTIG3658 | 35429656_c1_9 | 4143 | 18246 | 1068 | 356 | YIL078W | 1331 | 5.4(10)-136 | Saccharomyces cerevisiae | [ui:yil078w] [pn:threonyl trna synthetase, cytosolic:threonyl-trna synthetase, cytoplasmic:threonine--trna ligase:thrrs1 [gn:ths1] [gtcfc:5.3:10.6] [ec:6.1.1.3] [keggfc:5.3:10.1:10.2] [sgdfc:5.4.0:9.2.0] [db:gtc-saccharomyces cerevisi |
| CONTIG5160 | 24306512_f1_2 | 4144 | 18247 | 1083 | 361 | YJR139C | 1083 | 1.0(10)-109 | Saccharomyces cerevisiae | [ui:yjr139c] [pn:homoserine dehydrogenase:hdh] [gn:hom6j2132] [gtcfc:5.3:5.8:6.6] [ec:1.1.1.3] [keggfc:5.3:5.8] [sgdfc:1.1.1] [db:gtc-saccharomyces cerevisiae] |
| CONTIG3353 | 33382660_f2_1 | 4145 | 18248 | 1197 | 399 | YOR184W | 1140 | 9.4(10)-116 | Saccharomyces cerevisiae | [ui:yor184w] [pn:phosphoserine aminotransferase] [gn:ser1:serc] [gtcfc:5.3:6.6:9.10:9.11:9.3] [ec:2.6.1.52] [keggfc:5.3:9.3] [sgdfc:1.1.1:7.1] [db:gtc-saccharomyces cerevisiae] |
| CONTIG3295 | 782752_f3_4 | 4146 | 18249 | 582 | 194 | YAL044C | 351 | 3.7(10)-32 | Saccharomyces cerevisiae | [ui:yal044c] [pn:strong similarity to human glycine cleavage system protein h:glycine cleavage system protein h precursor] [gn:gcv3:fun40] [gtcfc:5.3] [keggfc:14.2] [sgdfc-saccharomyces cerevisiae] |
| CONTIG2235 | 16287662_f1_1 | 4147 | 18250 | 1284 | 428 | YBR006W | 1007 | 1.2(10)-101 | Saccharomyces cerevisiae | [ui:ybr006w] [pn:strong similarity to e. coli succinate semialdehyde dehydrogenase:hypothetical aldehyde-dehydrogenase like protein in coq1-hhf1 intergenic region] [gn:ybr0112] [gtcfc:5.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4997 | 15041078_c3_4 | 4148 | 18251 | 1464 | 488 | YBR006W | 1251 | 1.6(10)-127 | Saccharomyces cerevisiae | [keggfc:14.2] [sgdfc:1.1.4] [dbgtc-saccharom [ui:ybr006w] [pn:strong similarity to e. coli succinate semialdehyde dehydrogenase:hypothetical aldehyde-dehydrogenase like protein in coq1-hhf1 intergenic region] [gn:ybr0112] [gtcfc:5.3] [keggfc:14.2] [sgdfc:1.1.4] [dbgtc-saccharom |
| CONTIG5770 | 33985702_f3_12 | 4149 | 18252 | 807 | 269 | YDR272W | 665 | 2.0(10)-65 | Saccharomyces cerevisiae | [ui:ydr272w] [pn:glyoxalase ii:hydroxyacylglutathione hydrolase] [gn:glo2] [gtcfc:5.3] [keggfc:14.2] [sgdfc:1.1.4] [dbgtc-saccharomyces cerevisiae] |
| CONTIG4221 | 16829635_c3_5 | 4150 | 18253 | 579 | 193 | YDR294C | 473 | 4.5(10)-45 | Saccharomyces cerevisiae | [ui:ydr294c] [pn:similarity to glutamate decarboxylases] [gtcfc:5.3] [keggfc:14.2] [sgdfc:1.1.4] [dbgtc-saccharomyces cerevisiae] |
| CONTIG4387 | 3937762_f3_3 | 4151 | 18254 | 1263 | 421 | YDR294C | 1007 | 1.2(10)-101 | Saccharomyces cerevisiae | [ui:ydr294c] [pn:similarity to glutamate decarboxylases] [gtcfc:5.3] [keggfc:14.2] [sgdfc:1.1.4] [dbgtc-saccharomyces cerevisiae] |
| CONTIG5700 | 9940637_f2_6 | 4152 | 18255 | 1173 | 391 | YDR502C | 1390 | 3.0(10)-142 | Saccharomyces cerevisiae | [ui:ydr502c] [pn:s-adenosylmethionine synthetase 2:methionine adenosyltransferase 2:adomet synthetase 2] [gn:sam2:eth2:d9719] [gtcfc:5.3:5.4:6.4] [ec:2.5.1.6] [keggfc:5.4:6.4] [sgdfc:1.1.4] [dbgtc-saccharomyces cerevisiae] |
| CONTIG3645 | 35156338_f3_2 | 4153 | 18256 | 267 | 89 | YGL202W | 100 | 0.00016 | Saccharomyces cerevisiae | [ui:ygl202w] [pn:similarity to rat kynurenine/alpha-aminoadipate aminotransferase:hypothetical 56.2 kd protein in kex1-mcm6 intergenic region] [gtcfc:5.3] [keggfc:14.2] [sgdfc:1.1.4] [dbgtc-saccharomyces cerevisiae] |
| CONTIG5645 | 6250_f3_13 | 4154 | 18257 | 1200 | 400 | YGL202W | 1076 | 5.7(10)-109 | Saccharomyces cerevisiae | [ui:ygl202w] [pn:similarity to rat kynurenine/alpha-aminoadipate aminotransferase:hypothetical 56.2 kd protein in kex1-mcm6 intergenic region] [gtcfc:5.3] [keggfc:14.2] [sgdfc:1.1.4] [dbgtc-saccharomyces cerevisiae] |
| CONTIG4646 | 19765817_f1_1 | 4155 | 18258 | 1524 | 508 | YHR137W | 758 | 5.2(10)-81 | Saccharomyces cerevisiae | [ui:yhr137w] [pn:similarity to rat kynurenine/alpha-aminoadipate |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | aminotransferase:hypothetical 58.5 kd protein in yck1-sps100 intergenic region] [gtcfc:5.3] [keggfc:14.2] [sgdfc:1.1.4] [db:gtc-saccharomyces cerevisiae] |
| CONTIG5291 | 24666030_f3_8 | 4156 | 18259 | 624 | 208 | YIL042C | 145 | 4.9(10)-12 | Saccharomyces cerevisiae | [ui:yil042c] [pn:similarity to rat branched-chain alpha-ketoacid dehydrogenase kinase:hypothetical 45.4 kd protein in cbr5-not3 intergenic region] [gtcfc:5.3] [keggfc:14.2] [sgdfc:1.1.4] [db:gtc-saccharomyces cerevisiae] |
| CONTIG4157 | 26618825_c3_5 | 4157 | 18260 | 414 | 138 | YIR025C | 434 | 6.0(10)-41 | Saccharomyces cerevisiae | [ui:yir025c] [pn:3-hydroxyanthranilic acid dioxygenase:hypothetical 20.2 kd protein in mer2-cpr7 intergenic region] [gn:had1;j1550] [gtcfc:5.3;9.10:9.11] [keggfc:14.2] [sgdfc:1.1.4:1.7.1] [db:gtc-saccharomyces cerevisiae] |
| CONTIG5793 | 24068887_c1_16 | 4158 | 18261 | 1470 | 490 | YJR078W | 923 | 9.3(10)-93 | Saccharomyces cerevisiae | [ui:yjr078w] [pn:similarity to mammalian indoleamine 2,3-dioxygenase:hypothetical 50.8 kd protein in mir1-ste18 intergenic region] [gn:j1840] [gtcfc:5.3;9.10:9.11] [keggfc:14.2] [sgdfc:1.1.4:1.7.1] [db:gtc-saccharomyces cerevisiae] |
| CONTIG2892 | 32657886_f1_1 | 4159 | 18262 | 666 | 222 | YLR231C | 570 | 2.3(10)-55 | Saccharomyces cerevisiae | [ui:ylr231c] [pn:strong similarity to rat kynureninase] [gtcfc:5.3;9.10:9.11] [keggfc:14.2] [sgdfc:1.1.4:1.7.1] [db:gtc-saccharomyces cerevisiae] |
| CONTIG3178 | 29503250_f1_1 | 4160 | 18263 | 894 | 298 | YLR231C | 575 | 7.0(10)-56 | Saccharomyces cerevisiae | [ui:ylr231c] [pn:strong similarity to rat kynureninase] [gtcfc:5.3;9.10:9.11] [keggfc:14.2] [sgdfc:1.1.4:1.7.1] [db:gtc-saccharomyces cerevisiae] |
| CONTIG3512 | 2197892_f3_6 | 4161 | 18264 | 1548 | 516 | YER043C | 1943 | 7.5(10)-201 | Saccharomyces cerevisiae | [ui:yer043c] [pn:s-adenosyl-1-homocysteine hydrolase:adenosylhomocysteinase: s-adenosyl-1-homocysteine hydrolase:adohcyase] [gn:sah1] [gtcfc:5.4;6.4;9.10:9.11] [ec:3.3.1.1] [keggfc:5.4:6.4] [sgdfc:1.7.1] [db:gtc-saccharomyces cerevisiae] |
| CONTIG5537 | 7070306_f2_2 | 4162 | 18265 | 2310 | 770 | YER091C | 3015 | 0 | Saccharomyces cerevisiae | [ui:yer091c] [pn:5-methyltetrahydropteroyltriglutamate-- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | homocysteine methyltransferase:5-methyltetrahydropteroyltriglutamate--homocysteine s-methyltransferase:methionine synthase, vitamin-b12 independent isozyme:delta-p8 protein) [gn: |
| CONTIG5637 | 14954837_c2_22 | 4163 | 18266 | 957 | 319 | YGR264C | 1136 | 2.5(10)-115 | *Saccharomyces cerevisiae* | [ui:ygr264c] [pn:methionyl-trna synthetase:methionyl-trna synthetase, cytoplasmic:methionine-trna ligase:metrs] [gn:mes1] [gtcfc:5.4:6.4:10.6] [ec:6.1.1.10] [keggfc:5.4:6.4:10.1:10.2] [sgdfc:5.4.0:9.2.0] [db:gtc-*saccharomyces cerevis* |
| CONTIG5637 | 34189130_c1_17 | 4164 | 18267 | 813 | 271 | YGR264C | 1049 | 4.0(10)-106 | *Saccharomyces cerevisiae* | [ui:ygr264c] [pn:methionyl-trna synthetase:methionyl-trna synthetase, cytoplasmic:methionine-trna ligase:metrs] [gn:mes1] [gtcfc:5.4:6.4:10.6] [ec:6.1.1.10] [keggfc:5.4:6.4:10.1:10.2] [sgdfc:5.4.0:9.2.0] [db:gtc-*saccharomyces cerevis* |
| CONTIG5637 | 21991557_c3_27 | 4165 | 18268 | 528 | 176 | YGR264C | 90 | 0.12 | *Saccharomyces cerevisiae* | [ui:ygr264c] [pn:methionyl-trna synthetase:methionyl-trna synthetase, cytoplasmic:methionine-trna ligase:metrs] [gn:mes1] [gtcfc:5.4:6.4:10.6] [ec:6.1.1.10] [keggfc:5.4:6.4:10.1:10.2] [sgdfc:5.4.0:9.2.0] [db:gtc-*saccharomyces cerevis* |
| CONTIG3549 | 25507778_f3_4 | 4166 | 18269 | 468 | 156 | YNL247W | 319 | 9.4(10)-28 | *Saccharomyces cerevisiae* | [ui:ynl247w] [pn:similarity to cysteinyl-trna synthetases:putative cysteinyl-trna synthetase c29e6.06:cysteine-- trna ligase:cysrs] [gn:n0885] [gtcfc:5.5:10.6] [ec:6.1.1.16] [keggfc:5.5:10.1:10.2] [sgdfc:5.4.0] [db:gtc-*saccharomyces* |
| CONTIG3792 | 34195290_c1_9 | 4167 | 18270 | 225 | 75 | YNL247W | 137 | 3.2(10)-8 | *Saccharomyces cerevisiae* | [ui:ynl247w] [pn:similarity to cysteinyl-trna synthetases:putative cysteinyl-trna synthetase c29e6.06:cysteine-- trna ligase:cysrs] [gn:n0885] [gtcfc:5.5:10.6] [ec:6.1.1.16] [keggfc:5.5:10.1:10.2] [sgdfc:5.4.0] [db:gtc-*saccharomyces* |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3792 | 34616436_c2_12 | 4168 | 18271 | 1152 | 384 | YNL247W | 1083 | 1.0(10)-109 | *Saccharomyces cerevisiae* | [ui:ynl247w] [pn:similarity to cysteinyl-trna synthetases:putative cysteinyl-trna synthetase c29e6.06c:cysteine-- trna ligase:cysrs] [gn:n0885] [gtcfc:5.5:10.6] [ec:6.1.1.16] [keggfc:5.5:10.1:10.2] [sgdfc:5.4.0] [db:gtc-saccharomyces |
| CONTIG3792 | 35807828_c2_11 | 4169 | 18272 | 348 | 116 | YNL247W | 359 | 4.5(10)-32 | *Saccharomyces cerevisiae* | [ui:ynl247w] [pn:similarity to cysteinyl-trna synthetases:putative cysteinyl-trna synthetase c29e6.06c:cysteine-- trna ligase:cysrs] [gn:n0885] [gtcfc:5.5:10.6] [ec:6.1.1.16] [keggfc:5.5:10.1:10.2] [sgdfc:5.4.0] [db:gtc-saccharomyces |
| CONTIG5164 | 14470311_f3_5 | 4170 | 18273 | 1194 | 398 | YJR148W | 1260 | 1.8(10)-128 | *Saccharomyces cerevisiae* | [ui:yjr148w] [pn:branched chain amino acid aminotransferase, cytosolic:putative branched-chain amino acid aminotransferase, cytosolic:bcat] [gn:twt2;j2209] [gtcfc:5.6:5.7:6.6:9.5] [ec:2.6.1.42] [keggfc:5.6:5.7:9.5] [sgdfc:1.1.1:9.2.0] |
| CONTIG3500 | 22710078_c2_12 | 4171 | 18274 | 648 | 216 | YJR148W | 589 | 2.2(10)-57 | *Saccharomyces cerevisiae* | [ui:yjr148w] [pn:branched chain amino acid aminotransferase, cytosolic:putative branched-chain amino acid aminotransferase, cytosolic:bcat] [gn:twt2;j2209] [gtcfc:5.6:5.7:6.6:9.5] [ec:2.6.1.42] [keggfc:5.6:5.7:9.5] [sgdfc:1.1.1:9.2.0] |
| CONTIG1669 | 214583_c2_6 | 4172 | 18275 | 1008 | 336 | YBL076C | 1222 | 1.8(10)-124 | *Saccharomyces cerevisiae* | [ui:ybl076c] [pn:isoleucyl-trna synthetase, cytoplasmic:isoleucine--trna ligase:ilers] [gn:ils1:ybl0734] [gtcfc:5.7:10.6] [ec:6.1.1.5] [keggfc:5.7:10.1:10.2] [sgdfc:5.4.0:9.2.0] [db:gtc-saccharomyces cerevis |
| b1x15324.x | 34179687_c2_2 | 4173 | 18276 | 624 | 208 | YBL076C | 615 | 2.8(10)-59 | *Saccharomyces cerevisiae* | [ui:ybl076c] [pn:isoleucyl-trna synthetase, cytoplasmic:isoleucine--trna ligase:ilers] [gn:ils1:ybl0734] [gtcfc:5.7:10.6] [ec:6.1.1.5] [keggfc:5.7:10.1:10.2] [sgdfc:5.4.0:9.2.0] [db:gtc-saccharomyces cerevis |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4072 | 11882662_f2_2 | 4174 | 18277 | 1137 | 379 | YCL018W | 1315 | 2.7(10)-134 | Saccharomyces cerevisiae | *saccharomyces cerevis* [ui:ycl018w] [pn:beta-isopropyl-malate dehydrogenase:3-isopropylmalate dehydrogenase:beta-ipm dehydrogenase:imdh:3-ipm-dh] [gn:leu2:ycl18w] [gtcfc:5.7:6.6] [ec:1.1.1.85] [keggfc:5.7] [sgdfc:1.1.1:9.2.0] [db:gtc-*saccharomyces cerevisia* |
| CONTIG3855 | 19553175_c2_5 | 4175 | 18278 | 879 | 293 | YGL009C | 1136 | 2.5(10)-115 | Saccharomyces cerevisiae | [ui:ygl009c] [pn:3-isopropylmalate dehydratase:isopropylmalate isomerase:alpha-ipm isomerase:ipmi] [gn:leu1] [gtcfc:5.7:6.6] [ec:4.2.1.33] [keggfc:5.7] [sgdfc:1.1.1:9.2.0] [db:gtc-*saccharomyces cerevisiae*] |
| CONTIG4886 | 2197192_f1_1 | 4176 | 18279 | 1086 | 362 | YGL009C | 1146 | 2.2(10)-116 | Saccharomyces cerevisiae | [ui:ygl009c] [pn:3-isopropylmalate dehydratase:isopropylmalate isomerase:alpha-ipm isomerase:ipmi] [gn:leu1] [gtcfc:5.7:6.6] [ec:4.2.1.33] [keggfc:5.7] [sgdfc:1.1.1:9.2.0] [db:gtc-*saccharomyces cerevisiae*] |
| CONTIG5739 | 33757812_f2_11 | 4177 | 18280 | 705 | 235 | YPL160W | 533 | 2.2(10)-50 | Saccharomyces cerevisiae | [ui:ypl160w] [pn:leucine--trna ligase, cytosolic:leucyl-trna synthetase, cytoplasmic:leucine--trna ligase:leurs] [gn:cdc60:p2564] [gtcfc:5.7:10.6] [ec:6.1.1.4] [keggfc:5.7:10.1:10.2] [sgdfc:5.4.0:9.2.0] [db:gtc-*saccharomyces cerevisia* |
| CONTIG5382 | 11074_c1_12 | 4178 | 18281 | 2703 | 901 | YPL160W | 3034 | 0 | Saccharomyces cerevisiae | [ui:ypl160w] [pn:leucine--trna ligase, cytosolic:leucyl-trna synthetase, cytoplasmic:leucine--trna ligase:leurs] [gn:cdc60:p2564] [gtcfc:5.7:10.6] [ec:6.1.1.4] [keggfc:5.7:10.1:10.2] [sgdfc:5.4.0:9.2.0] [db:gtc-*saccharomyces cerevisia* |
| CONTIG3798 | 35203425_f1_1 | 4179 | 18282 | 462 | 154 | YBR115C | 375 | 2.8(10)-33 | Saccharomyces cerevisiae | [ui:ybr115c] [pn:1-aminoadipate-semialdehyde dehydrogenase, large subunit:aminoadipate-semialdehyde dehydrogenase large subunit:alpha-aminoadipate reductase:alpha-ar] [gn:lys2:ybr0910] [gtcfc:5.8:5.9.6.6] [ec:1.2.1.31] [keggfc:5.8:5.9 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5782 | 898450_c2_23 | 4180 | 18283 | 1524 | 508 | YBR115C | 1484 | 3.2(10)-152 | *Saccharomyces cerevisiae* | [ui:ybr115c] [pn:1-aminoadipate-semialdehyde dehydrogenase, large subunit:aminoadipate-semialdehyde dehydrogenase large subunit:alpha-aminoadipate reductase:alpha-ar] [gn:lys2:ybr0910] [gtcfc:5.8:5.9.6.6] [ec:1.2.1.31] [keggfc:5.8:5.9 |
| CONTIG5782 | 34657062_c2_22 | 4181 | 18284 | 270 | 90 | YBR115C | 344 | 5.7(10)-30 | *Saccharomyces cerevisiae* | [ui:ybr115c] [pn:1-aminoadipate-semialdehyde dehydrogenase, large subunit:aminoadipate-semialdehyde dehydrogenase large subunit:alpha-aminoadipate reductase:alpha-ar] [gn:lys2:ybr0910] [gtcfc:5.8:5.9.6.6] [ec:1.2.1.31] [keggfc:5.8:5.9 |
| CONTIG5782 | 4766436_c3_27 | 4182 | 18285 | 2040 | 680 | YBR115C | 2034 | 1.7(10)-210 | *Saccharomyces cerevisiae* | [ui:ybr115c] [pn:1-aminoadipate-semialdehyde dehydrogenase, large subunit:aminoadipate-semialdehyde dehydrogenase large subunit:alpha-aminoadipate reductase:alpha-ar] [gn:lys2:ybr0910] [gtcfc:5.8:5.9.6.6] [ec:1.2.1.31] [keggfc:5.8:5.9 |
| CONTIG5253 | 10160038_c3_15 | 4183 | 18286 | 1824 | 608 | YDR037W | 2301 | 8.8(10)-239 | *Saccharomyces cerevisiae* | [ui:ydr037w] [pn:lysyl-trna synthetase, cytosolic:lysyl-trna synthetase, cytoplasmic:lysine--trna ligase:lysrs] [gn:krs1.gcd5:yd9673] [gtcfc:5.8:10.6] [ec:6.1.1.6] [keggfc:5.8:10.1:10.2] [sgdfc:5.4.0:9.2.0] [db:gtc-saccharomyces cere |
| CONTIG5512 | 4079051_c3_13 | 4184 | 18287 | 1167 | 389 | YIR034C | 1310 | 9.0(10)-134 | *Saccharomyces cerevisiae* | [ui:yir034c] [pn:saccharopine dehydrogenase:nad+, 1-lysine forming:lysine-- 2-oxoglutarate reductase:sdh] [gn:lys1] [gtcfc:5.8:5.9.6.6] [ec:1.5.1.7] [keggfc:5.8:5.9] [sgdfc:1.1.1:9.2.0] [db:gtc-saccharomyces cerevisiae] |
| CONTIG5497 | 953431_c2_8 | 4185 | 18288 | 1362 | 454 | YNR050C | 1651 | 6.5(10)-170 | *Saccharomyces cerevisiae* | [ui:ynr050c] [pn:saccharopine dehydrogenase:nadp+, 1-glutamate forming] [gn:lys9:lys13:n3461] [gtcfc:5.8:6.6] [ec:1.5.1.10] [keggfc:5.8] [sgdfc:1.1.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4907 | 25_f2_3 | 4186 | 18289 | 1380 | 460 | YER078C | 984 | 3.2(10)-99 | Saccharomyces cerevisiae | [ui:yer078c] [pn:hypothetical 58.0 kd peptidase in arg5,6-ilv1 intergenic region] [gtcfc:5.9] [ec:3.4.-.-] [keggfc:5.9] [db-gtc-saccharomyces cerevisiae] |
| CONTIG4907 | 14880002_f3_6 | 4187 | 18290 | 234 | 78 | YER078C | 150 | 7.0(10)-10 | Saccharomyces cerevisiae | [ui:yer078c] [pn:hypothetical 58.0 kd peptidase in arg5,6-ilv1 intergenic region] [gtcfc:5.9] [ec:3.4.-.-] [keggfc:5.9] [db-gtc-saccharomyces cerevisiae] |
| CONTIG2338 | 565888_f3_5 | 4188 | 18291 | 495 | 165 | YFR006W | 496 | 1.6(10)-47 | Saccharomyces cerevisiae | [ui:yfr006w] [pn:similarity to x-pro dipeptidases:hypothetical 61.8 kd peptidase in mpr1-gcn20 intergenic region] [gtcfc:5.9.10.11] [ec:3.4.-.-] [keggfc:5.9] [sgdfc:6.5.3] [db-gtc-saccharomyces cerevisiae] |
| CONTIG4924 | 24238407_f3_7 | 4189 | 18292 | 534 | 178 | YIR022W | 522 | 2.8(10)-50 | Saccharomyces cerevisiae | [ui:yir022w] [pn:signal sequence processing protein:signal sequence processing protein precursor] [gn:sec11] [gtcfc:11.1:5.9:10.7] [ec:3.4.-.-] [keggfc:5.9] [sgdfc:6.3.0:9.4.0] [db-gtc-saccharomyces cerevisiae] |
| CONTIG5159 | 10600952_c3_8 | 4190 | 18293 | 951 | 317 | YIL145C | 711 | 2.7(10)-70 | Saccharomyces cerevisiae | [ui:yil145c] [pn:similarity to e. coli pantothenate synthetase:putative pantoate--beta-alanine ligase:pantothenate synthetase:pantoate activating enzyme] [gtcfc:6.1:9.10:9.11.9.5] [ec:6.3.2.1] [keggfc:6.1:9.5] [sgdfc:1.7.1] [db-gtc-sac |
| CONTIG4551 | 19723132_c1_11 | 4191 | 18294 | 540 | 180 | YBR244W | 461 | 8.4(10)-44 | Saccharomyces cerevisiae | [ui:ybr244w] [pn:strong similarity to glutathione peroxidases:glutathione peroxidase homolog yb244w] [gn:ybr1632] [gtcfc:6.16.12.12] [ec:1.11.1.9] [keggfc:6.9] [sgdfc:11.3.0] [db-gtc-saccharomyces cerevisiae] |
| CONTIG3600 | 1379006_f2_1 | 4192 | 18295 | 282 | 94 | YIR037W | 260 | 1.7(10)-22 | Saccharomyces cerevisiae | [ui:yir037w] [pn:glutathione peroxidase] [gn:hyr1] [gtcfc:6.16.13.2] [ec:1.11.1.9] [keggfc:6.9] [sgdfc:11.1.0] [db-gtc-saccharomyces cerevisiae] |
| CONTIG5098 | 4100133_c1_10 | 4193 | 18296 | 699 | 233 | YIR037W | 480 | 8.0(10)-46 | Saccharomyces cerevisiae | [ui:yir037w] [pn:glutathione peroxidase] [gn:hyr1] [gtcfc:6.16.13.2] [ec:1.11.1.9] [keggfc:6.9] [sgdfc:11.1.0] [db-gtc-saccharomyces cerevisiae] |
| CONTIG5098 | 1953502_c3_11 | 4194 | 18297 | 579 | 193 | YIR037W | 644 | 3.3(10)-63 | Saccharomyces cerevisiae | [ui:yir037w] [pn:glutathione peroxidase] [gn:hyr1] [gtcfc:6.16.13.2] [ec:1.11.1.9] [keggfc:6.9] [sgdfc:11.1.0] [db-gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | peroxidase] [gn:hyr1] [gtcfc:6.16:13.2] [ec:1.11.1.9] [keggfc:6.9] [sgdfc:1.1.0] [db:gtc-saccharomyces cerevisiae] |
| CONTIG5401 | 812932_c1_11 | 4195 | 18298 | 474 | 158 | YAL016W | 197 | 9.6(10)-19 | Saccharomyces cerevisiae | [ui:yal016w] [pn:ser/thr protein phosphatase 2a, regulatory chain a:protein phosphatase pp2a regulatory subunit a:pr65] [gn:tpd3:fun32] [gtcfc:6.3:10.2:12.8] [keggfc:14.2] [sgdfc:3.1.0:3.2.0:3.8.0:3.9.0:4.12.0:16.0.0] [db:gtc-saccharo] |
| CONTIG5401 | 24806578_c1_10 | 4196 | 18299 | 1104 | 368 | YAL016W | 965 | 3.2(10)-97 | Saccharomyces cerevisiae | [ui:yal016w] [pn:ser/thr protein phosphatase 2a, regulatory chain a:protein phosphatase pp2a regulatory subunit a:pr65] [gn:tpd3:fun32] [gtcfc:6.3:10.2:12.8] [keggfc:14.2] [sgdfc:3.1.0:3.2.0:3.8.0:3.9.0:4.12.0:16.0.0] [db:gtc-saccharo] |
| CONTIG5401 | 24495287_c3_16 | 4197 | 18300 | 447 | 149 | YAL016W | 439 | 2.1(10)-41 | Saccharomyces cerevisiae | [ui:yal016w] [pn:ser/thr protein phosphatase 2a, regulatory chain a:protein phosphatase pp2a regulatory subunit a:pr65] [gn:tpd3:fun32] [gtcfc:6.3:10.2:12.8] [keggfc:14.2] [sgdfc:3.1.0:3.2.0:3.8.0:3.9.0:4.12.0:16.0.0] [db:gtc-saccharo] |
| b1x17840.x | 25867876_f2_1 | 4198 | 18301 | 753 | 251 | YBL056W | 296 | 5.0(10)-26 | Saccharomyces cerevisiae | [ui:ybl056w] [pn:ser/thr protein phosphatase pp2:cputative 51.4 kd phosphatase 2c in shp1-sec17 intergenic region] [gn:ptc3:ybl0511:ybl0513] [gtcfc:6.3:14.3] [ec:3.1.3.16] [keggfc:14.1] [sgdfc:16.0.0:13.0.0] [db:gtc-saccharomyces cere] |
| CONTIG1970 | 4771931_c1_3 | 4199 | 18302 | 297 | 99 | YBR125C | 171 | 2.2(10)-12 | Saccharomyces cerevisiae | [ui:ybr125c] [pn:similarity to protein phosphatase 2c:putative 44.2 kd phosphatase 2c in tfc1-cif1 intergenic region] [gn:ybr0921] [gtcfc:6.3:14.3] [ec:3.1.3.16] [keggfc:14.1] [sgdfc:16.0.0:13.0.0] [db:gtc-saccharomyces cerevisiae] |
| b3x10869.x | 14973516_f3_1 | 4200 | 18303 | 504 | 168 | YBR125C | 266 | 3.8(10)-23 | Saccharomyces cerevisiae | [ui:ybr125c] [pn:similarity to protein phosphatase 2c:putative 44.2 kd phosphatase 2c in tfc1-cif1 intergenic region] [gn:ybr0921] [gtcfc:6.3:14.3] [ec:3.1.3.16] [keggfc:14.1] [sgdfc:16.0.0:13.0.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1257 | 23629675_f1_1 | 4201 | 18304 | 807 | 269 | YBR276C | 117 | 0.00042 | Saccharomyces cerevisiae | [db:gtc-saccharomyces cerevisiae] [ui:ybr276c] [pn:protein tyrosine phosphatase:probable protein-tyrosine phosphatase ybr276c] [gn:pps1:ybr2013] [gtcfc:6.3:12.8] [ec:3.1.3.48] [keggfc:14.1] [sgdfc:3.8.0:16.0.0] [db:gtc-saccharomyces cerevisiae] |
| CONTIG4090 | 23609443_c2_3 | 4202 | 18305 | 2202 | 734 | YBR276C | 326 | 6.7(10)-44 | Saccharomyces cerevisiae | [ui:ybr276c] [pn:protein tyrosine phosphatase:probable protein-tyrosine phosphatase ybr276c] [gn:pps1:ybr2013] [gtcfc:6.3:12.8] [ec:3.1.3.48] [keggfc:14.1] [sgdfc:3.8.0:16.0.0] [db:gtc-saccharomyces cerevisiae] |
| CONTIG2457 | 4881312_f3_2 | 4203 | 18306 | 597 | 199 | YBR276C | 177 | 1.8(10)-12 | Saccharomyces cerevisiae | [ui:ybr276c] [pn:protein tyrosine phosphatase:probable protein-tyrosine phosphatase ybr276c] [gn:pps1:ybr2013] [gtcfc:6.3:12.8] [ec:3.1.3.48] [keggfc:14.1] [sgdfc:3.8.0:16.0.0] [db:gtc-saccharomyces cerevisiae] |
| CONTIG5770 | 14502005_f1_7 | 4204 | 18307 | 1122 | 374 | YDL230W | 432 | 9.9(10)-41 | Saccharomyces cerevisiae | [ui:ydl230w] [pn:protein tyrosine phosphatase:protein-tyrosine phosphatase 1:ptp1] [gn:ptp1] [gtcfc:6.3:12.8:14.3] [ec:3.1.3.48] [keggfc:13.3] [sgdfc:9.2.0:16.0.0:13.0.0] [db:gtc-saccharomyces cerevisiae] |
| CONTIG2672 | 29338333_f3_3 | 4205 | 18308 | 324 | 108 | YDL188C | 507 | 1.1(10)-48 | Saccharomyces cerevisiae | [ui:ydl188c] [pn:protein ser/thr phosphatase pp2a-2:serine/threonine protein phosphatase pp2a-2 catalytic subunit] [gn:pph22:sis4:d1271] [gtcfc:6.3:12.13:12.8] [ec:3.1.3.16] [keggfc:14.1] [sgdfc:1.5.2:3.1.0:3.2.0:3.8.0:16.0.0] [db:gtc-saccharomyces cerevisiae] |
| CONTIG108 | 26600307_f3_1 | 4206 | 18309 | 816 | 272 | YDL134C | 978 | 1.3(10)-98 | Saccharomyces cerevisiae | [ui:ydl134c] [pn:protein ser/thr phosphatase pp2a-1:serine/threonine protein phosphatase pp2a-1 catalytic subunit] [gn:pph21:d2180] [gtcfc:6.3:12.13:12.8] [ec:3.1.3.16] [keggfc:13.3] [sgdfc:1.5.2:3.1.0:3.2.0:3.8.0:16.0.0] [db:gtc-sacc |
| CONTIG4167 | 4870177_f3_5 | 4207 | 18310 | 957 | 319 | YDL047W | 1415 | 6.7(10)-145 | Saccharomyces cerevisiae | [ui:ydl047w] [pnsser/thr protein phosphatase:serine/threonine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1118 | 24110300_c1_5 | 4208 | 18311 | 558 | 186 | YDL006W | 263 | 8.0(10)-23 | *Saccharomyces cerevisiae* | protein phosphatase pp1-1 [gn:pph1:sit4:d2693] [gtcfc:6.3:12.8] [ec:3.1.3.16] [keggfc:13.3] [sgdfc:3.2.0:3.8.0:16.0.0] [db:gtc-saccharomyces cerevisiae] [ui:ydl006w] [pn:protein serine/threonine phosphatase 2c;protein phosphatase 2c homolog:pp2c] [gn:ptc1:tpd1:d2925] [gtcfc:6.3:12.13:12.8:13.2] [ec:3.1.3.16] [keggfc:14.1] [sgdfc:1.5.2:3.1.0:3.2.0:10.3.4:11.1.0:16.0.0] [db:gtc-saccharo] |
| CONTIG5206 | 24110300_c3_14 | 4209 | 18312 | 1161 | 387 | YDL006W | 506 | 1.3(10)-48 | *Saccharomyces cerevisiae* | [ui:ydl006w] [pn:protein serine/threonine phosphatase 2c;protein phosphatase 2c homolog:pp2c] [gn:ptc1:tpd1:d2925] [gtcfc:6.3:12.13:12.8:13.2] [ec:3.1.3.16] [keggfc:14.1] [sgdfc:1.5.2:3.1.0:3.2.0:10.3.4:11.1.0:16.0.0] [db:gtc-saccharo] |
| b3x15922.x | 25432192_f1_1 | 4210 | 18313 | 552 | 184 | YDR075W | 702 | 2.3(10)-69 | *Saccharomyces cerevisiae* | [ui:ydr075w] [pn:protein set/thr phosphatase:serine/threonine protein phosphatase pph3] [gn:pph3:d4421] [gtcfc:6.3:12.8] [ec:3.1.3.16] [keggfc:14.1] [sgdfc:3.1.0:16.0.0] [db:gtc-saccharomyces cerevisiae] |
| CONTIG4514 | 4784651_f1_1 | 4211 | 18314 | 1257 | 419 | YDR481C | 681 | 4.0(10)-67 | *Saccharomyces cerevisiae* | [ui:ydr481c] [pn:repressible alkaline phosphatase vacuolar:repressible alkaline phosphatase precursor] [gn:pho8] [gtcfc:6.3:8.1:9.13:9.6:12.16] [ec:3.1.3.1] [keggfc:8.1.9.7:9.12] [sgdfc:9.10.0:16.0.0] [db:gtc-saccharomyces cerevisiae] |
| CONTIG5768 | 20288_f3_13 | 4212 | 18315 | 750 | 250 | YDR481C | 585 | 6.0(10)-57 | *Saccharomyces cerevisiae* | [ui:ydr481c] [pn:repressible alkaline phosphatase vacuolar:repressible alkaline phosphatase precursor] [gn:pho8] [gtcfc:6.3:8.1:9.13:9.6:12.16] [ec:3.1.3.1] [keggfc:8.1.9.7:9.12] [sgdfc:9.10.0:16.0.0] [db:gtc-saccharomyces cerevisiae] |
| CONTIG5768 | 33761050_f1_5 | 4213 | 18316 | 951 | 317 | YDR481C | 881 | 2.6(10)-88 | *Saccharomyces cerevisiae* | [ui:ydr481c] [pn:repressible alkaline phosphatase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5657 | 12303452_c2_17 | 4214 | 18317 | 1800 | 600 | YEL042W | 1357 | 9.5(10)-139 | Saccharomyces cerevisiae | vacuolar:repressible alkaline phosphatase precursor] [gn:pho8] [gtcfc:6.3.8.1:9.13:9.6:12.16] [ec:3.1.3.1] [keggfc:8.1:9.7:9.12] [sgdfc:9.10.0:16.0.0] [db:gtc-saccharomyces cerevisiae] [ui:yel042w] [pn:guanosine diphosphatase:gdpase] [gn:gda1:sygp-orf16] [gtcfc:6.3:10.7:12.16] [ec:3.6.1.42] [keggfc:14.1] [sgdfc:6.3.0:9.4.0:16.0.0] [db:gtc-saccharomyces cerevisiae] |
| CONTIG3205 | 23697252_f2_1 | 4215 | 18318 | 1623 | 541 | YER075C | 145 | 3.1(10)-14 | Saccharomyces cerevisiae | [ui:yer075c] [pn:protein tyrosine phosphatase:probable protein-tyrosine phosphatase yet075c] [gn:ptp3] [gtcfc:6.3:14.3] [ec:3.1.3.48] [keggfc:14.1] [sgdfc:16.0.0:13.0.0] [db:gtc-saccharomyces cerevisiae] |
| CONTIG656 | 859383_f1_2 | 4216 | 18319 | 291 | 97 | YER075C | 102 | 0.00022 | Saccharomyces cerevisiae | [ui:yer075c] [pn:protein tyrosine phosphatase:probable protein-tyrosine phosphatase yet075c] [gn:ptp3] [gtcfc:6.3:14.3] [ec:3.1.3.48] [keggfc:14.1] [sgdfc:16.0.0:13.0.0] [db:gtc-saccharomyces cerevisiae] |
| CONTIG656 | 24095062_f1_3 | 4217 | 18320 | 390 | 130 | YER075C | 148 | 2.7(10)-9 | Saccharomyces cerevisiae | [ui:yer075c] [pn:protein tyrosine phosphatase:probable protein-tyrosine phosphatase yet075c] [gn:ptp3] [gtcfc:6.3:14.3] [ec:3.1.3.48] [keggfc:14.1] [sgdfc:16.0.0:13.0.0] [db:gtc-saccharomyces cerevisiae] |
| b9x12x90.x | 32527005_f3_2 | 4218 | 18321 | 519 | 173 | YER075C | 115 | 9.0(10)-6 | Saccharomyces cerevisiae | [ui:yer075c] [pn:protein tyrosine phosphatase:probable protein-tyrosine phosphatase yet075c] [gn:ptp3] [gtcfc:6.3:14.3] [ec:3.1.3.48] [keggfc:14.1] [sgdfc:16.0.0:13.0.0] [db:gtc-saccharomyces cerevisiae] |
| CONTIG4089 | 1054750_c2_10 | 4219 | 18322 | 906 | 302 | YER089C | 294 | 3.6(10)-37 | Saccharomyces cerevisiae | [ui:yer089c] [pn:strong similarity to phosphoprotein phosphatases:putative 51.4 kd phosphatase 2c in seb1-trp2 intergenic region] [gn:ptc2] [gtcfc:6.3:14.3] [ec:3.1.3.16] [keggfc:14.1] [sgdfc:16.0.0:13.0.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5301 | 21978924_c1_10 | 4220 | 18323 | 960 | 320 | YER133W | 1425 | 5.9(10)-146 | Saccharomyces cerevisiae | [db:gtc-saccharomyces cerev [ui:yer133w] [pn:ser/thr phosphoprotein phosphatase 1, catalytic chain:serine/threonine protein phosphatase pp1-2) [gn:glc7/dis2:cid1] [gtcfc:6.3:7.1:7.2:10.7:12.13:12.8] [ec3.1.3.16] [keggfc:13.3] [sgdfc:1.5.2:2.7.0:3.2.0:3.5.0:3.8. |
| CONTIG5806 | 2766886_c1_26 | 4221 | 18324 | 1302 | 434 | YFR028C | 1232 | 1.7(10)-125 | Saccharomyces cerevisiae | [ui:yfr028c] [pn:protein-tyrosine-phosphatase:probable protein-tyrosine phosphatase] [gn:cdc 14] [gtcfc:6.3:10.8:12.8] [ec:3.1.3.48] [keggfc:13.3] [sgdfc:3.6.0:3.8.0:16.0.0] [db:gtc-saccharomyces cerevisiae] |
| b3x16043.y | 10651905_f2_2 | 4222 | 18325 | 396 | 132 | YFR028C | 236 | 4.0(10)-19 | Saccharomyces cerevisiae | [ui:yfr028c] [pn:protein-tyrosine-phosphatase:probable protein-tyrosine phosphatase] [gn:cdc14] [gtcfc:6.3:10.8:12.8] [ec:3.1.3.48] [keggfc:13.3] [sgdfc:36.0:3.8.0:16.0.0] [db:gtc-saccharomyces cerevisiae] |
| CONTIG1691 | 1365882_f3_1 | 4223 | 18326 | 1080 | 360 | YGL190C | 1034 | 1.6(10)-104 | Saccharomyces cerevisiae | [ui:ygl190c] [pn:ser/thr phosphatase 2a regulatory subunit b:protein phosphatase pp2a regulatory subunit b:pp55:cell division control protein 55] [gn:cdc55:g1345] [gtcfc:6.3:12.8:13.2] [keggfc:14.2] [sgdfc:3.1.0:3.2.0:3.8.0:3.9.0:11.1 |
| CONTIG609 | 190888_f3_1 | 4224 | 18327 | 1335 | 445 | YGR123C | 778 | 1.8(10)-91 | Saccharomyces cerevisiae | [ui:ygr123c] [pn:protein ser/thr phosphatase:serine/threonine protein phosphatase t:ppt] [gn:ppt1:g6347] [gtcfc:6.3:14.3] [ec:3.1.3.16] [keggfc:14.1] [sgdfc:16.0.0:13.0.0] [db:gtc-saccharomyces cerevisiae] |
| CONTIG5670 | 19720377_c2_30 | 4225 | 18328 | 525 | 175 | YGR203W | 245 | 6.5(10)-21 | Saccharomyces cerevisiae | [ui:ygr203w] [pn:weak similarity to x. lacvis protein-tyrosin-phosphatase cdc homolog 2 and to hypothetical protein ypr200c:hypothetical 17.2 kd protein in pct1-adc3 intergenic region] [gn:g7731] [gtcfc:6.3:14.3] [keggfc:14.2] [sgdfc:1 |
| CONTIG2121 | 22051912_c3_2 | 4226 | 18329 | 807 | 269 | YIL002C | 91 | 0.38 | Saccharomyces cerevisiae | [ui:yil002c] [pn:synaptojanin homolog 1:hypothetical 108.4 kd protein in bet1-pan1 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4602 | 9806427_f2_3 | 4227 | 18330 | 1053 | 351 | YIL002C | 731 | 2.1(10)-72 | Saccharomyces cerevisiae | region] [gn:sjh1:yia2c] [gtcfc:6.3:8.5:10.7] [keggfc:1.6.7:16.0.0] [sgdfc:1.6.7:16.0.0] [db:gtc-saccharomyces cerevisiae] [ui:yil002c] [pn:synaptojanin homolog 1:hypothetical 108.4 kd protein in bet1-pan1 intergenic region] [gn:sjh1:yia2c] [gtcfc:6.3:8.5:10.7] [keggfc:14.2] [sgdfc:6.7:16.0.0] [db:gtc-saccharomyces cerevisiae] |
| CONTIG5813 | 24065877_c3_61 | 4228 | 18331 | 1080 | 360 | YIR026C | 587 | 3.7(10)-57 | Saccharomyces cerevisiae | [ui:yir026c] [pn:protein tyrosine phosphatase:protein-tyrosine phosphatase:ptpase] [gn:yvh1] [gtcfc:6.3:12.13:12.15:12.8] [keggfc:14.1] [ec:3.1.3.48] [sgdfc:3.4.0:3.5.0:10.4.7:16.0.0] [db:gtc-saccharomyces cerevisiae] |
| CONTIG4689 | 4188540_f2_2 | 4229 | 18332 | 615 | 205 | YKL190W | 614 | 5.0(10)-60 | Saccharomyces cerevisiae | [ui:ykl190w] [pn:calcineurin b, regulatory subunit:calcineurin b subunit:protein phosphatase 2b regulatory subunit] [gn:cnb1:ycnb:ycn2] [gtcfc:6.3:10.2:12.9] [keggfc:14.2] [sgdfc:3.3.0:4.8.2:9.2.0:16.0.0] [db:gtc-saccharomyces cerevis |
| CONTIG5466 | 10625676_f2_4 | 4230 | 18333 | 888 | 296 | YML112W | 111 | 0.00064 | Saccharomyces cerevisia | [ui:yml112w] [pn:carboxy-terminal domain:ctd kinase, gamma subunit:ctd kinase gamma subunit:ctd kinase 32 kd subunit:ctdk-i gamma subunit] [gn:ctk3:ym8339] [gtcfc:6.3:8.5.9.4:10.1:10.2] [ec:2.7.1.-] [keggfc:8.5.9.4] [sgdfc:4.8.2:9.5.0 |
| CONTIG373 | 14884441_f3_1 | 4231 | 18334 | 801 | 267 | YML016C | 709 | 4.4(10)-70 | Saccharomyces cerevisiae | [ui:yml016c] [pn:ser/thr phosphatase required for normal osmoregulation:serine/threonine protein phosphatase pp-z1] [gn:ppz1:ym9571] [gtcfc:6.3:13.2] [ec:3.1.3.16] [keggfc:14.1] [sgdfc:11.1.0:16.0.0] [db:gtc-saccharomyces cerevisiae] |
| CONTIG3862 | 782887_c2_6 | 4232 | 18335 | 357 | 119 | YML016C | 543 | 1.7(10)-52 | Saccharomyces cerevisiae | [ui:yml016c] [pn:ser/thr phosphatase required for normal osmoregulation:serine/threonine protein phosphatase pp-z1] [gn:ppz1:ym9571] [gtcfc:6.3:13.2] [ec:3.1.3.16] [keggfc:14.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG210 | 24020939_c2_1 | 4233 | 18336 | 585 | 195 | YML016C | 702 | 2.3(10)-69 | Saccharomyces cerevisiae | [sgdfc:11.1.0.16.0.0] [db:gtc-saccharomyces cerevisiae] [ui:yml016c] [pn:ser/thr phosphatase required for normal osmoregulation:serine/threonine protein phosphatase pp-z1] [gn:ppz1:ym9571] [gtcfc:6.3:13.2] [ec:3.1.3.16] [keggfc:14.1] [sgdfc:11.1.0.16.0.0] [db:gtc-saccharomyces cerevisiae] |
| CONTIG1341 | 25635817_f3_1 | 4234 | 18337 | 1107 | 369 | YMR036C | 191 | 9.0(10)-13 | Saccharomyces cerevisiae | [ui:ymr036c] [pn:m-phase inducing protein tyrosine phosphatase:m-phase inducer phosphatase:mitosis initiation protein mih1:mitotic inducer homolog] [gn:mih1:ym9532] [gtcfc:6.3:12.8] [ec:3.1.3.48] [keggfc:13.3] [sgdfc:3.8.0:16.0.0] [db-saccharomyces cerevisiae] |
| b1x14347.x | 11775417_f3_1 | 4235 | 18338 | 516 | 172 | YNL217W | 172 | 9.8(10)-13 | Saccharomyces cerevisiae | [ui:ynl217w] [pn:weak similarity to e. coli bis:5''-nucleosyl-tetraphosphatase:hypothetical 37.2 kd protein in alg9-rap1 intergenic region] [gn:n1306] [gtcfc:6.3:14.3] [keggfc:14.2] [sgdfc:16.0.0:13.0.0] [db-gtc-saccharomyces cerevisiae] |
| b2x18173.y | 25625781_f3_1 | 4236 | 18339 | 474 | 158 | YNL128W | 139 | 1.3(10)-16 | Saccharomyces cerevisiae | [ui:ynl128w] [pn:weak similarity to tensin:hypothetical 50.2 kd protein in cpt1-spc98 intergenic region] [gn:n1220:n1872] [sgdfc:14.2] [keggfc:6.3:14.3] [sgdfc:16.0.0:13.0.0] [db-gtc-saccharomyces cerevisiae] |
| CONTIG1134 | 3009683_f3_2 | 4237 | 18340 | 1056 | 352 | YNL106C | 323 | 7.9(10)-28 | Saccharomyces cerevisiae | [ui:ynl106c] [pn:phosphatidylinositol phosphate phosphatase:hypothetical 133.3 kd protein in cyb5-leu4 intergenic region] [gn:pie3:n2160] [gtcfc:6.3:10.7:11.1] [keggfc:14.2] [sgdfc:6.2.0:16.0.0] [db-gtc-saccharomyces cerevisiae] |
| CONTIG2301 | 20441656_c2_5 | 4238 | 18341 | 414 | 138 | YNL106C | 262 | 2.5(10)-21 | Saccharomyces cerevisiae | [ui:ynl106c] [pn:phosphatidylinositol phosphate phosphatase:hypothetical 133.3 kd protein in cyb5-leu4 intergenic region] [gn:pie3:n2160] [gtcfc:6.3:10.7:11.1] [keggfc:14.2] [sgdfc:6.2.0:16.0.0] [db-gtc-saccharomyces cerevisiae] |
| CONTIG3574 | 25578760_c2_9 | 4239 | 18342 | 2457 | 819 | YNL106C | 1651 | 6.5(10)-170 | Saccharomyces cerevisiae | [ui:ynl106c] [pn:phosphatidylinositol phosphate |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4602 | 25992268_f1_1 | 4240 | 18343 | 921 | 307 | YNL106C | 321 | 1.3(10)-27 | Saccharomyces cerevisiae | phosphatase:hypothetical 133.3 kd protein in cyb5-leu4 intergenic region] [gn:pie3:n2160] [gtcfc:6.3:10.7:11.1] [keggfc:14.2] [sgdfc:6.2.0:6.0.0] [db:gtc-saccharomyces cerevisiae] [ui:ynl106c] [pn:phosphatidylinositol phosphate phosphatase:hypothetical 133.3 kd protein in cyb5-leu4 intergenic region] [gn:pic3:n2160] [gtcfc:6.3:10.7:11.1] [keggfc:14.2] [sgdfc:6.2.0:6.0.0] [db:gtc-saccharomyces cerevisiae] |
| CONTIG5748 | 12943827_c3_25 | 4241 | 18344 | 783 | 261 | YNR032W | 755 | 5.9(10)-75 | Saccharomyces cerevisiae | [ui:ynr032w] [pn:phosphoprotein phosphatase ppg catalytic chain:serine/threonine protein phosphatase pp2a-like ppg1] [gn:ppg1:ppg:n3281] [gtcfc:6.3:7.1:7.2] [ec:3.1.3.16] [keggfc:14.1] [sgdfc:2.7.0:16.0.0] [db:gtc-saccharomyces cerevi |
| CONTIG229 | 3261593_c1_2 | 4242 | 18345 | 330 | 110 | YOL064C | 179 | 2.2(10)-13 | Saccharomyces cerevisiae | [ui:yol064c] [pn:protein ser/thr phosphatase:halotolerance protein hal2] [gn:hal2:met22] [gtcfc:6.3.6:6.13.2] [keggfc:14.2] [sgdfc:1.1.1:11.0:16.0.0] [db:gtc-saccharomyces cerevisiae] |
| CONTIG4182 | 901577_c3_8 | 4243 | 18346 | 876 | 292 | YOL064C | 473 | 4.5(10)-45 | Saccharomyces cerevisiae | [ui:yol064c] [pn:protein ser/thr phosphatase:halotolerance protein hal2] [gn:hal2:met22] [gtcfc:6.3.6:6.13.2] [keggfc:14.2] [sgdfc:1.1.1:11.0:16.0.0] [db:gtc-saccharomyces cerevisiae] |
| CONTIG4383 | 901577_c2_11 | 4244 | 18347 | 1200 | 400 | YOL064C | 736 | 6.0(10)-73 | Saccharomyces cerevisiae | 1ui:yol064c] [pn:protein ser/thr phosphatase:halotolerance protein hal2] [gn:hal2:met22] [gtcfc:6.3.6:6.13.2] [keggfc:14.2] [sgdfc:1.1.1:11.0:16.0.0] [db:gtc-saccharomyces cerevisiae] |
| CONTIG5094 | 6120766_f3_7 | 4245 | 18348 | 693 | 231 | YOL064C | 383 | 1.5(10)-35 | Saccharomyces cerevisiae | [ui:yol064c] [pn:protein ser/thr phosphatase:halotolerance protein hal2] [gn:hal2:met22] [gtcfc:6.3.6:6.13.2] [keggfc:14.2] [sgdfc:1.1.1:11.0:16.0.0] [db:gtc-saccharomyces cerevisiae] |
| CONTIG1548 | 4787511_f1_1 | 4246 | 18349 | 339 | 113 | YOR007C | 145 | 1.1(10)-9 | Saccharomyces cerevisiae | [ui:yor007c] [pn:similarity to protein phosphatases] [gtcfc:6.3.14.3] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4573 | 6913441_c2_12 | 4247 | 18350 | 1167 | 389 | YOR007C | 115 | 0.0042 | Saccharomyces cerevisiae | [sgdfc:16.0.0:13.0.0] [db:gtc-saccharomyces cerevisiae] [ui:yor007c] [pn:similarity to protein phosphatases] [gtcfc:6.3:14.3] [keggfc:14.2] [sgdfc:16.0.0:13.0.0] [db:gtc-saccharomyces cerevisiae] |
| CONTIG5488 | 24429813_c1_10 | 4248 | 18351 | 1212 | 404 | YOR007C | 638 | 1.5(10)-62 | Saccharomyces cerevisiae | [ui:yor007c] [pn:similarity to protein phosphatases] [gtcfc:6.3:14.3] [keggfc:14.2] [sgdfc:16.0.0:13.0.0] [db:gtc saccharomyces cerevisiae] |
| CONTIG2168 | 9867812_c3_4 | 4249 | 18352 | 999 | 333 | YOR014W | 444 | 3.5(10)-58 | Saccharomyces cerevisiae | [ui:yor014w] [pn:potential regulatory subunit of protein phosphatase 2a:rts1 protein:scs1 protein] [gn:rts1:scs1:or26] [gtcfc:6.3:13.2] [keggfc:14.2] [sgdfc:9.2.0:11.1.0:16.0.0] [db:gtc-saccharomyces cerevisiae] |
| CONTIG641 | 9782594_c2_5 | 4250 | 18353 | 1104 | 368 | YOR014W | 978 | 1.3(10)-98 | Saccharomyces cerevisiae | [ui:yor014w] [pn:potential regulatory subunit of protein phosphatase 2a:rts1 protein:scs1 protein] [gn:rts1:scs1:or26] [gtcfc:6.3:13.2] [keggfc:14.2] [sgdfc:9.2.0:11.1.0:16.0.0] [db:gtc-saccharomyces cerevisiae] |
| CONTIG5577 | 4117153_f3_6 | 4251 | 18354 | 1293 | 431 | YOR090C | 697 | 8.1(10)-69 | Saccharomyces cerevisiae | [ui:yor090c] [pn:similarity to ser/thr protein phosphatases] [gtcfc:6.3:14.3] [keggfc:14.2] [sgdfc:16.0.0:13.0.0] [db:gtc-saccharomyces cerevisiae] |
| CONTIG3558 | 3913132_f3_5 | 4252 | 18355 | 1458 | 486 | YOR178C | 143 | 6.5(10)-11 | Saccharomyces cerevisiae | [ui:yor178c] [pn:ser/thr phosphoprotein phosphatase 1, regulatory chain:protein phosphatase 1 regulatory subunit] [gn:gac1] [gtcfc:6.3:7.1:7.2:12.13] [keggfc:14.2] [sgdfc:1.5.2:2.7.0:9.2.0:16.0.0] [db:gtc-saccharomyces cerevisiae] |
| CONTIG4310 | 20034655_c3_9 | 4253 | 18356 | 1299 | 433 | YOR178C | 147 | 1.3(10)-9 | Saccharomyces cerevisiae | [ui:yor178c] [pn:ser/thr phosphoprotein phosphatase 1, regulatory chain:protein phosphatase 1 regulatory subunit] [gn:gac1] [gtcfc:6.3:7.1:7.2:12.13] [keggfc:14.2] [sgdfc:1.5.2:2.7.0:9.2.0:16.0.0] [db:gtc-saccharomyces cerevisiae] |
| CONTIG1104 | 31542281_f3_4 | 4254 | 18357 | 372 | 124 | YPL152W | 111 | 6.4(10)-6 | Saccharomyces cerevisiae | [ui:ypl152w] [pn:strong similarity to human phosphotyrosyl |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5596 | 24417532_c2_16 | 4255 | 18358 | 1128 | 376 | YPL152W | 931 | 13(10)-93 | Saccharomyces cerevisiae | phosphatase activator] [gtcfc:6.3.14.3] [keggfc:14.2] [sgdfc:16.0.0.13.0.0] [db:gtc-saccharomyces cerevisiae] [ui:ypl152w] [pn:strong similarity to human phosphotyrosyl phosphatase activator] [gtcfc:6.3.14.3] [keggfc:14.2] [sgdfc:16.0.0.13.0.0] [db:gtc-saccharomyces cerevisiae] |
| b9x13g07.x | 2162792_f3_1 | 4256 | 18359 | 510 | 170 | YPL152W | 113 | 3.8(10)-6 | Saccharomyces cerevisiae | [ui:ypl152w] [pn:strong similarity to human phosphotyrosyl phosphatase activator] [gtcfc:6.3.14.3] [keggfc:14.2] [sgdfc:16.0.0.13.0.0] [db:gtc-saccharomyces cerevisiae] |
| CONTIG5781 | 5085142_f1_8 | 4257 | 18360 | 537 | 179 | YPL151C | 322 | 4.5(10)-29 | Saccharomyces cerevisiae | [ui:ypl151c] [pn:strong similarity to a. thaliana prl1 and prl2 proteins] [gtcfc:6.3.14.3] [keggfc:14.2] [sgdfc:16.0.0.13.0.0] [db:gtc-saccharomyces cerevisiae] |
| CONTIG5781 | 35188125_f3_15 | 4258 | 18361 | 636 | 212 | YPL151C | 404 | 9.1(10)-38 | Saccharomyces cerevisiae | [ui:ypl151c] [pn:strong similarity to a. thaliana prl1 and prl2 proteins] [gtcfc:6.3.14.3] [keggfc:14.2] [sgdfc:16.0.0.13.0.0] [db:gtc-saccharomyces cerevisiae] |
| CONTIG2789 | 24273425_f3_2 | 4259 | 18362 | 531 | 177 | YPR073C | 433 | 7.7(10)-41 | Saccharomyces cerevisiae | [ui:ypr073c] [pn:protein-tyrosine-phosphatase:low molecular weight phosphotyrosine protein phosphatase:low molecular weight cytosolic acid phosphatase:ptpase] [gn:ltp1:yp9499] [gtcfc:6.3.9.13:9.2:14.3] [keggfc:9.2.9.12] [sgdfc:16.0.0: |
| CONTIG3302 | 23864068_c3_4 | 4260 | 18363 | 267 | 89 | YAL004W | 282 | 7.7(10)-25 | Saccharomyces cerevisiae | [ui:yal004w] [pn:strong similarity to a. klebsiana glutamate dehydrogenase:hypothetical 23.8 kd protein in ssa1-efb1 intergenic region] [gtcfc:6.6] [keggfc:14.2] [sgdfc:1.1.1] [db-saccharomyces cerevisiae] |
| CONTIG5775 | 24115905_f3_15 | 4261 | 18364 | 195 | 65 | YAL004W | 164 | 2.5(10)-12 | Saccharomyces cerevisiae | [ui:yal004w] [pn:strong similarity to a. klebsiana glutamate dehydrogenase:hypothetical 23.8 kd protein in ssa1-efb1 intergenic region] [gtcfc:6.6] [keggfc:14.2] [sgdfc:1.1.1] [db-saccharomyces cerevisiae] |
| CONTIG2671 | 214026_f3_2 | 4262 | 18365 | 1113 | 371 | YEL046C | 1051 | 2.5(10)-106 | Saccharomyces cerevisiae | [ui:yel046c] [pn:required for |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | glycine prototrophy in shmt1 and shmt2 double mutant:gly1 protein] [gn:gly1:sygp-orf34] [gtcfc:6.6] [keggfc:14.2] [sgdfc:1.1.1] [db:gtc-saccharomyces cerevisiae |
| CONTIG5415 | 281258_c1_12 | 4263 | 18366 | 1236 | 412 | YEL046C | 1003 | 3.1(10)-101 | Saccharomyces cerevisiae | [ui:yel046c] [pn:required for glycine prototrophy in shmt1 and shmt2 double mutant:gly1 protein] [gn:gly1:sygp-orf34] [gtcfc:6.6] [keggfc:14.2] [sgdfc:1.1.1] [db:gtc-saccharomyces cerevisiae |
| CONTIG1506 | 9859833_f1_1 | 4264 | 18367 | 780 | 260 | YEL038W | 437 | 2.8(10)-41 | Saccharomyces cerevisiae | [ui:yel038w] [pn:similarity to k. oxytoca enolase-phosphatase e-1:ut:ut4 protein:unknown transcript 4 protein] [gn:ut4:sygp-orf20] [gtcfc:6.6] [keggfc:14.2] [sgdfc:1.1.1] [db:gtc-saccharomyces cerevisiae |
| CONTIG5814 | 24015936_f2_12 | 4265 | 18368 | 1233 | 411 | YGL184C | 936 | 3.8(10)-94 | Saccharomyces cerevisiae | [ui:ygl184c] [pn:similarity to arabidopsis cystathionine beta-lyase:hypothetical 51.8 kd protein in cox4-gts1 intergenic region] [gn:g1601] [gtcfc:6.6] [keggfc:14.2] [sgdfc:1.1.1] [db:gtc-saccharomyces cerevisiae |
| CONTIG376 | 10830007_f1_1 | 4266 | 18369 | 549 | 183 | YHR070W | 246 | 2.5(10)-20 | Saccharomyces cerevisiae | [ui:yhr070w] [pn:strong similarity to n. crassa met-10+ protein:hypothetical 56.5 kd protein in dys1-erg7 intergenic region] [gtcfc:6.6] [keggfc:14.2] [sgdfc:1.1.1] [db:gtc-saccharomyces cerevisiae |
| CONTIG3966 | 9821942_c2_3 | 4267 | 18370 | 246 | 82 | YHR112C | 195 | 4.4(10)-15 | Saccharomyces cerevisiae | [ui:yhr112c] [pn:similarity to cystathionine gamma-synthases:hypothetical 42.4 kd protein in cdc12-orc6 intergenic region] [gtcfc:6.6] [keggfc:14.2] [sgdfc:1.1.1] [db:gtc-saccharomyces cerevisiae |
| CONTIG798 | 2343907_f1_1 | 4268 | 18371 | 621 | 207 | YHR112C | 357 | 8.8(10)-33 | Saccharomyces cerevisiae | [ui:yhr112c] [pn:similarity to cystathionine gamma-synthases:hypothetical 42.4 kd protein in cdc12-orc6 intergenic region] [gtcfc:6.6] [keggfc:14.2] [sgdfc:1.1.1] [db:gtc-saccharomyces cerevisiae |
| CONTIG3366 | 5370677_c2_7 | 4269 | 18372 | 423 | 141 | YIL094C | 406 | 5.7(10)-38 | Saccharomyces cerevisiae | [ui:yil094c] [pn:similarity to isopropyl malate and tartrate dehydrogenases:hypothetical 40.1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5518 | 33782842_f2_7 | 4270 | 18373 | 372 | 124 | YIL094C | 238 | 5.2(10)-20 | Saccharomyces cerevisiae | kd protein in sga1-ths1 intergenic region] [gtcfc6.6] [keggfc:14.2] [sgdfc:1.1.1] [db:gtc-saccharomyces cerevisiae] [ui:yil094c] [pn:similarity to isopropyl malate and tartrate dehydrogenases:hypothetical 40.1 kd protein in sga1-ths1 intergenic region] [gtcfc6.6] [keggfc:14.2] [sgdfc:1.1.1] [db:gtc-saccharomyces cerevisiae] |
| CONTIG5609 | 14625911_c3_10 | 4271 | 18374 | 1776 | 592 | YJL071W | 311 | 1.8(10)-51 | Saccharomyces cerevisiae | [ui:yjl071w] [pn:acetylglutamate synthase:hypothetical 65.6 kd protein in scp160-mrpl8 intergenic region] [gn:arg2:j1091:hrb574] [gtcfc6.6] [keggfc:14.2] [sgdfc:1.1.1] [db:gtc-saccharomyces cerevisiae] |
| CONTIG5161 | 15633643_c2_8 | 4272 | 18375 | 2406 | 802 | YKL215C | 1691 | 3.7(10)-174 | Saccharomyces cerevisiae | [ui:ykl215c] [pn:similarity to p. aeruginosa hyua and hyub:hypothetical 140.4 kd protein in ural-doa1 intergenic region] [gtcfc6.6] [keggfc:14.2] [sgdfc:1.1.1] [db:gtc-saccharomyces cerevisiae] |
| CONTIG3518 | 20089762_c3_5 | 4273 | 18376 | 1212 | 404 | YKL215C | 925 | 5.7(10)-93 | Saccharomyces cerevisiae | [ui:ykl215c] [pn:similarity to p. aeruginosa hyua and hyub:hypothetical 140.4 kd protein in ural-doa1 intergenic region] [gtcfc6.6] [keggfc:14.2] [sgdfc:1.1.1] [db:gtc-saccharomyces cerevisiae] |
| CONTIG3518 | 29476511_c1_4 | 4274 | 18377 | 423 | 141 | YKL215C | 291 | 2.2(10)-24 | Saccharomyces cerevisiae | [ui:ykl215c] [pn:similarity to p. aeruginosa hyua and hyub:hypothetical 140.4 kd protein in ural-doa1 intergenic region] [gtcfc6.6] [keggfc:14.2] [sgdfc:1.1.1] [db:gtc-saccharomyces cerevisiae] |
| CONTIG5714 | 26571932_c3_25 | 4275 | 18378 | 258 | 86 | YKL215C | 152 | 1.5(10)-9 | Saccharomyces cerevisiae | [ui:ykl215c] [pn:similarity to p. aeruginosa hyua and hyub:hypothetical 140.4 kd protein in ural-doa1 intergenic region] [gtcfc6.6] [keggfc:14.2] [sgdfc:1.1.1] [db:gtc-saccharomyces cerevisiae] |
| CONTIG5607 | 16052091_f3_6 | 4276 | 18379 | 1674 | 558 | YKL191W | 792 | 8.0(10)-112 | Saccharomyces cerevisiae | [ui:ykl191w] [pn:diphtheria toxin resistance protein:diphtheria toxin resistance protein 2] [gn:dph2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2518 | 20361312_f1_1 | 4277 | 18380 | 249 | 83 | YLR172C | 236 | 5.7(10)-20 | Saccharomyces cerevisiae | [gtcfc:6.6] [keggfc:14.2] [sgdfc:1.1.1] [db:gtc-saccharomyces cerevisiae] [ui:ylr172c] [pn:diphthamide methyltransferase:diphthine synthase:diphthamide biosynthesis methyltransferase] [gn:dph5:19470] [gtcfc:6.6] [ec:2.1.1.98] [keggfc:14.1] [sgdfc:1.1.1] [db:gtc-saccharomyces cerevisiae] |
| CONTIG4706 | 6054758_c2_10 | 4278 | 18381 | 987 | 329 | YLR172C | 1062 | 1.7(10)-107 | Saccharomyces cerevisiae | [ui:ylr172c] [pn:diphthamide methyltransferase:diphthine synthase:diphthamide biosynthesis methyltransferase] [gn:dph5:19470] [gtcfc:6.6] [ec:2.1.1.98] [keggfc:14.1] [sgdfc:1.1.1] [db:gtc-saccharomyces cerevisiae] |
| CONTIG5730 | 4376261_f1_3 | 4279 | 18382 | 2046 | 682 | YML096W | 493 | 2.1(10)-61 | Saccharomyces cerevisiae | [ui:yml096w] [pn:weak similarity to asparagine synthases] [gtcfc:6.6] [keggfc:14.2] [sgdfc:1.1.1] [db:gtc-saccharomyces cerevisiae] |
| CONTIG5682 | 24009687_f2_9 | 4280 | 18383 | 1323 | 441 | YMR062C | 1158 | 1.2(10)-117 | Saccharomyces cerevisiae | [ui:ymr062c] [pn:similarity to glutamate n-acetyltransferase] [gtcfc:6.6] [keggfc:14.2] [sgdfc:1.1.1] [db:gtc-saccharomyces cerevisiae] |
| CONTIG2542 | 23990627_c3_7 | 4281 | 18384 | 561 | 187 | YMR250W | 357 | 2.7(10)-32 | Saccharomyces cerevisiae | [ui:ymr250w] [pn:similarity to glutamate decarboxylases] [gtcfc:6.6] [keggfc:14.2] [sgdfc:1.1.1] [db:gtc-saccharomyces cerevisiae] |
| CONTIG2777 | 9863281_f1_1 | 4282 | 18385 | 1170 | 390 | YMR250W | 750 | 2.0(10)-74 | Saccharomyces cerevisiae | [ui:ymr250w] [pn:similarity to glutamate decarboxylases] [gtcfc:6.6] [keggfc:14.2] [sgdfc:1.1.1] [db:gtc-saccharomyces cerevisiae] |
| CONTIG1469 | 12507088_c2_5 | 4283 | 18386 | 540 | 180 | YCL043C | 286 | 1.2(10)-24 | Saccharomyces cerevisiae | [ui:ycl043c] [pn:protein disulfide-isomerase precursor:pdi/dolichyl-diphosphooligosaccharide-protein glycotransferase:glycosylation site-binding chain:gsbp:thioredoxin-related glycoprotein 1] [gn |
| CONTIG2797 | 878430_c3_2 | 4284 | 18387 | 765 | 255 | YCL043C | 401 | 1.8(10)-37 | Saccharomyces cerevisiae | [ui:ycl043c] [pn:protein disulfide-isomerase precursor:pdi/dolichyl-diphosphooligosaccharide-protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2580 | 4085937_c1_5 | 4285 | 18388 | 678 | 226 | YIL005W | 222 | 2.1(10)-17 | Saccharomyces cerevisiae | glycotransferase:glycosylation site-binding chain;sbp;thioredoxin-related glycoprotein 1] [gn [ui:yil005w] [pn:similarity to protein disulfide isomerases:putative disulfide isomerase yil005w precursor] [gn:yia5w] [gtcfc:7.1:10.5:10.7:11.3:12.7] [ec:5.3.4.1] [keggfc:7.2] [sgdfc:6.1.0] [db:gtc-saccharomyces cerevisiae] |
| CONTIG3210 | 10626036_c1_4 | 4286 | 18389 | 1305 | 435 | YIL005W | 394 | 5.2(10)-36 | Saccharomyces cerevisiae | [ui:yil005w] [pn:similarity to protein disulfide isomerases:putative disulfide isomerase yil005w precursor] [gn:yia5w] [gtcfc:7.1:10.5:10.7:11.3:12.7] [ec:5.3.4.1] [keggfc:7.2] [sgdfc:6.1.0] [db:gtc-saccharomyces cerevisiae] |
| CONTIG5537 | 24414028_f3_10 | 4287 | 18390 | 1239 | 413 | YBL058W | 642 | 5.5(10)-63 | Saccharomyces cerevisiae | [ui:ybl058w] [pn:potential regulatory subunit for glc7p:shp1 protein] [gn:shp1:ybl0509:ybl0515] [gtcfc:7.1:7.2:10.7:12.8] [keggfc:14.2] [sgdfc:2.7.0:3.2.0:3.5.0:3.8.0:5.3.0] [db:gtc-saccharomyces cerevisiae] |
| CONTIG4110 | 7047053_f2_1 | 4288 | 18391 | 189 | 63 | YHR047C | 93 | 0.0018 | Saccharomyces cerevisiae | [ui:yhr047c] [pn:alanine/arginine aminopeptidase] [gn:aap1] [gtcfc:7.1:7.2:12.13] [ec:3.4.11.-] [keggfc:14.1] [sgdfc:1.5.2:2.7.0] [db:gtc-saccharomyces cerevisiae] |
| CONTIG1438 | 24254651_f3_1 | 4289 | 18392 | 927 | 309 | YKL128C | 147 | 4.9(10)-8 | Saccharomyces cerevisiae | [ui:ykl128c] [pn:high copy suppressor of ts tps2 mutant phenotype:hypothetical 33.8 kd protein in myo3-pgm1 intergenic region ] [gn:pmu1] [gtcfc:7.1:7.2] [keggfc:14.2] [sgdfc:2.7.0] [db:gtc-saccharomyces cerevisiae] |
| CONTIG5401 | 6250625_f1_2 | 4290 | 18393 | 975 | 325 | YKL128C | 298 | 1.6(10)-26 | Saccharomyces cerevisiae | [ui:ykl128c] [pn:high copy suppressor of ts tps2 mutant phenotype:hypothetical 33.8 kd protein in myo3-pgm1 intergenic region] [gn:pmu1] [gtcfc:7.1:7.2] [keggfc:14.2] [sgdfc:2.7.0] [db:gtc-saccharomyces cerevisiae] |
| CONTIG5530 | 14649125_f3_7 | 4291 | 18394 | 996 | 332 | YKL128C | 200 | 1.3(10)-14 | Saccharomyces cerevisiae | [ui:ykl128c] [pn:high copy |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | suppressor of ts tps2 mutant phenotype:hypothetical 33.8 kd protein in myo3-pgm1 intergenic region] [gn:pmu1] [gtcfc:7.1:7.2] [keggfc:14.2] [sgdfc:2.7.0] [db-gtc-saccharomyces cerevisiae] |
| CONTIG5530 | 34016500_f3_8 | 4292 | 18395 | 1038 | 346 | YKL128C | 185 | 7.5(10)-21 | Saccharomyces cerevisiae | [ui:ykl128c] [pn:high copy suppressor of ts tps2 mutant phenotype:hypothetical 33.8 kd protein in myo3-pgm1 intergenic region] [gn:pmu1] [gtcfc:7.1:7.2] [keggfc:14.2] [sgdfc:2.7.0] [db-gtc-saccharomyces cerevisiae] |
| CONTIG5661 | 788437_f1_1 | 4293 | 18396 | 945 | 315 | YKL128C | 167 | 2.2(10)-10 | Saccharomyces cerevisiae | [ui:ykl128c] [pn:high copy suppressor of ts tps2 mutant phenotype:hypothetical 33.8 kd protein in myo3-pgm1 intergenic region] [gn:pmu1] [gtcfc:7.1:7.2] [keggfc:14.2] [sgdfc:2.7.0] [db-gtc-saccharomyces cerevisiae] |
| CONTIG5704 | 4772502_f3_8 | 4294 | 18397 | 3726 | 1242 | YLR071C | 370 | 2.2(10)-33 | Saccharomyces cerevisiae | [ui:ylr071c] [pn:dna-directed rna polymerase ii holoenzyme subunit:glucose repression regulatory protein] [gn:rgr1] [gtcfc:7.1:7.2:10.1:10.2:12.13:12.8:12.9] [keggfc:14.2] [sgdfc:1.5.2:2.7.0:3.2.0:3.3.0:4.8.1:9.5.0] [db-gtc-saccharomy |
| CONTIG5111 | 16828400_c3_14 | 4295 | 18398 | 1989 | 663 | YPL240C | 1621 | 2.1(10)-261 | Saccharomyces cerevisiae | [ui:ypl240c] [pn:heat shock protein:heat shock protein hsp82] [gn:hsp82:hsp90] [gtcfc:12.7:7.1:12.8:13.2] [keggfc:14.2] [sgdfc:2.7.0:3.4.0:3.5.0:9.2.0:11.1.0] [db-gtc-saccharomyces cerevisiae] |
| CONTIG3310 | 31551_f2_2 | 4296 | 18399 | 999 | 333 | YPL031C | 1029 | 5.4(10)-104 | Saccharomyces cerevisiae | [ui:ypl031c] [pn:cyclin-dependent protein kinase:negative regulator of the pho system] [gn:pho85] [gtcfc:7.1:7.2:8.5:9.4:10.1:10.2:12.12:12.13:12.8:13.10] [ec:2.7.1.-] [keggfc:8.5.9.4:13.1:13.2:13.3] |
| CONTIG208 | 5320387_f1_1 | 4297 | 18400 | 528 | 176 | YFR019W | 241 | 1.0(10)-18 | Saccharomyces cerevisiae | [ui:yfr019w] [pn:probable pip 5-kinase:probable phosphatidylinositol-4-phosphate 5-kinase:1 - phosphatidylinositol-4-phosphate kinase:pip5k:ptdins:4p-5-kinase:diphosphoinositide kinase] [gn:fab1] [gtcfc:8.1:12.16] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1509 | 26367036_f3_2 | 4298 | 18401 | 999 | 333 | YFR019W | 93 | 0.41999 | *Saccharomyces cerevisiae* | [ec:2.7.1.68] [keggf] [ui:yfr019w] [pn:probable pip 5-kinase;probable phosphatidylinositol-4-phosphate 5-kinase:1 - phosphatidylinositol-4-phosphate kinase;pip5k;ptdins:4p-5-kinase:diphosphoinositide kinase] [gn:fab1] [gtcfc:8.1:12.16] |
| CONTIG3834 | 4943878_c2_2 | 4299 | 18402 | 1362 | 454 | YFR019W | 345 | 4.5(10)-58 | *Saccharomyces cerevisiae* | [ec:2.7.1.68] [keggf] [ui:yfr019w] [pn:probable pip 5-kinase;probable phosphatidylinositol-4-phosphate 5-kinase:1 - phosphatidylinositol-4-phosphate kinase;pip5k;ptdins:4p-5-kinase:diphosphoinositide kinase] [gn:fab1] [gtcfc:8.1:12.16] |
| CONTIG5376 | 5861626_f2_3 | 4300 | 18403 | 2544 | 848 | YFR019W | 158 | 3.8(10)-7 | *Saccharomyces cerevisiae* | [ec:2.7.1.68] [keggf] [ui:yfr019w] [pn:probable pip 5-kinase;probable phosphatidylinositol-4-phosphate 5-kinase:1 - phosphatidylinositol-4-phosphate kinase;pip5k;ptdins:4p-5-kinase:diphosphoinositide kinase] [gn:fab1] [gtcfc:8.1:12.16] |
| CONTIG5617 | 35347143_f3_4 | 4301 | 18404 | 966 | 322 | YFR019W | 941 | 3.3(10)-93 | *Saccharomyces cerevisiae* | [ec:2.7.1.68] [keggf] [ui:yfr019w] [pn:probable pip 5-kinase;probable phosphatidylinositol-4-phosphate 5-kinase:1 - phosphatidylinositol-4-phosphate kinase;pip5k;ptdins:4p-5-kinase:diphosphoinositide kinase] [gn:fab1] [gtcfc:8.1:12.16] |
| CONTIG78 | 433332_f2_1 | 4302 | 18405 | 675 | 225 | YFR019W | 253 | 1.2(10)-22 | *Saccharomyces cerevisiae* | [ec:2.7.1.68] [keggf] [ui:yfr019w] [pn:probable pip 5-kinase;probable phosphatidylinositol-4-phosphate 5-kinase:1 - phosphatidylinositol-4-phosphate kinase;pip5k;ptdins:4p-5-kinase:diphosphoinositide kinase] [gn:fab1] [gtcfc:8.1:12.16] |
| CONTIG4117 | 15679688_c1_2 | 4303 | 18406 | 1887 | 629 | YLR305C | 805 | 7.2(10)-79 | *Saccharomyces cerevisiae* | [ec:2.7.1.68] [keggf] [ui:ylr305c] [pn:phosphatidylinositol-4-kinase;phosphatidylinositol 4-kinase stt4:pi4-kinase;ptdins-4-kinase] [gn:stt4]:l2142] [gtcfc:8.1:12.13:12.8] [ec:2.7.1.67] [keggfc:8.1] [sgdfc:3.8:0:15.0.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4365 | 956942_f2_1 | 4304 | 18407 | 2136 | 712 | YLR305C | 1599 | 2.2(10)-164 | Saccharomyces cerevisiae | saccharomyces cerevisiae] [ui:ylr305c] [pn:phosphatidylinositol-4-kinase;phosphatidylinositol 4-kinase stt4;pi4-kinase;ptdins-4-kinase] [gn:stt4|2|2142] [gtcfc:8.1|12.13:12.8] [ec:2.7.1.67] [keggfc.8.1] [sgdfc:3.8.0:15.0.0] [db:gtc-saccharomyces cerevisiae] |
| CONTIG1188 | 35792166_f1_1 | 4305 | 18408 | 1059 | 353 | YNL267W | 322 | 8.5(10)-28 | Saccharomyces cerevisiae | [ui:ynl267w] [pn:phosphatidylinositol 4-kinase;phosphatidylinositol 4-kinase pik1;pi4-kinase;ptdins-4-kinase] [gn:pik1:n0795] [gtcfc:8.1:10.1:10.2:12.13:12.8] [ec:2.7.1.67] [keggfc.8.1] [sgdfc:3.9.0:9.5.0:15.0.0] [db:gtc-saccharomyces |
| CONTIG2802 | 15712757_4 | 4306 | 18409 | 522 | 174 | YNL267W | 294 | 8.4(10)-25 | Saccharomyces cerevisiae | [ui:ynl267w] [pn:phosphatidylinositol 4-kinase;phosphatidylinositol 4-kinase pik1;pi4-kinase;ptdins-4-kinase] [gn:pik1:n0795] [gtcfc:8.1:10.1:10.2:12.13:12.8] [ec:2.7.1.67] [keggfc.8.1] [sgdfc:3.9.0:9.5.0:15.0.0] [db:gtc-saccharomyces |
| CONTIG2673 | 25407718_f2_1 | 4307 | 18410 | 852 | 284 | YNL267W | 986 | 2.0(10)-99 | Saccharomyces cerevisiae | [ui:ynl267w] [pn:phosphatidylinositol 4-kinase;phosphatidylinositol 4-kinase pik1;pi4-kinase;ptdins-4-kinase] [gn:pik1:n0795] [gtcfc:8.1:10.1:10.2:12.13:12.8] [ec:2.7.1.67] [keggfc.8.1] [sgdfc:3.9.0:9.5.0:15.0.0] [db:gtc-saccharomyces |
| CONTIG2911 | 33254626_f1_1 | 4308 | 18411 | 939 | 313 | YNL267W | 991 | 5.7(10)-100 | Saccharomyces cerevisiae | [ui:ynl267w] [pn:phosphatidylinositol 4-kinase;phosphatidylinositol 4-kinase pik1;pi4-kinase;ptdins-4-kinase] [gn:pik1:n0795] [gtcfc:8.1:10.1:10.2:12.13:12.8] [ec:2.7.1.67] [keggfc.8.1] [sgdfc:3.9.0:9.5.0:15.0.0] [db:gtc-saccharomyces |
| blx18076.x | 5322766_f1_1 | 4309 | 18412 | 516 | 172 | YNL267W | 385 | 1.5(10)-34 | Saccharomyces cerevisiae | [ui:ynl267w] [pn:phosphatidylinositol 4-kinase;phosphatidylinositol 4- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x12s75.y | 25969162_c1_2 | 4310 | 18413 | 558 | 186 | YNL267W | 156 | 4.5(10)-10 | Saccharomyces cerevisiae | kinase pik1:pi4-kinase:ptdins-4-kinase] [gn:pik1:n0795] [gtcfc:8.1.10.1:10.2:12.13:12.8] [ec:2.7.1.67] [keggfc:8.1] [sgdfc:3.9.0:9.5.0:15.0.0] [db-gtc-saccharomyces [ui:ynl267w] [pn:phosphatidylinositol 4-kinase:phosphatidylinositol 4-kinase pik1:pi4-kinase:ptdins-4-kinase] [gn:pik1:n0795] [gtcfc:8.1.10.1:10.2:12.13:12.8] [ec:2.7.1.67] [keggfc:8.1] [sgdfc:3.9.0:9.5.0:15.0.0] [db-gtc-saccharomyces |
| CONTIG5297 | 22460307_c1_12 | 4311 | 18414 | 1356 | 452 | YAR018C | 397 | 2.6(10)-71 | Saccharomyces cerevisiae | [ui:yar018c] [pn:ser/thr protein kinase:serine/threonine-protein kinase kin3] [gn:kin3:npk1:fun52] [gtcfc:8.5.9.4:12.13:14.3] [ec:2.7.1.-] [keggfc:8.5.9.4] [sgdfc:15.0.0:13.0.0] [db-gtc-saccharomyces cerevisiae] |
| CONTIG5233 | 34251566_c3_14 | 4312 | 18415 | 1206 | 402 | YAR019C | 605 | 2.1(10)-58 | Saccharomyces cerevisiae | [ui:yar019c] [pn:protein kinase of the map kinase kinase family:cell division control protein 15] [gn:cdc15] [gtcfc:8.5.9.4:12.13:12.8] [ec:2.7.1.-] [keggfc:8.5.9.4:13.3] [sgdfc:3.8.0:15.0.0] [db-gtc-saccharomyces cerevisiae] |
| CONTIG3766 | 33990918_c3_6 | 4313 | 18416 | 576 | 192 | YBL105C | 647 | 1.3(10)-62 | Saccharomyces cerevisiae | [ui:ybl105c] [pn:ser/thr-specific protein kinase:protein kinase c-like 1:pkc 1] [gn:pkc1:stt1:hpo2:ybl0807] [gtcfc:8.5.9.4:12.13:12.8:13.2] [ec:2.7.1.-] [keggfc:8.5.9.4] [sgdfc:3.2.0:3.8.0:10.2.5:11.1.0:15.0.0] [db-gtc-saccharomyces c |
| CONTIG3284 | 24806563_c1_3 | 4314 | 18417 | 1122 | 374 | YBL016W | 974 | 3.7(10)-98 | Saccharomyces cerevisiae | [ui:ybl016w] [pn:mitogen-activated protein kinase:map kinase:mitogen-activated protein kinase fus3:map kinase fus3] [gn:fus3:dac2:ybl0303:ybl03] [gtcfc:8.5.9.4:12.13:12.8:12.9] [ec:2.7.1.-] [keggfc:8.5.9.4:13.1] [sgdfc:3.3.0:3.8.0:9.2 |
| b1x18255.x | 6814506_c2_1 | 4315 | 18418 | 468 | 156 | YBL016W | 517 | 9.8(10)-50 | Saccharomyces cerevisiae | [ui:ybl016w] [pn:mitogen-activated protein kinase:map kinase:mitogen-activated protein kinase fus3:map |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | kinase fus3] [gn:fus3:dac2:ybl0303:ybl03] [gtcfc:8.5.9.4:12.13:12.8:12.9] [ec:2.7.1.-] [keggfc:8.5.9.4:13.1] [sgdfc:3.3.0:3.8.0:9.2 |
| CONTIG5604 | 10553135_f3_5 | 4316 | 18419 | 897 | 299 | YBR028C | 287 | 9.3(10)-25 | Saccharomyces cerevisiae | [ui:ybr028c] [pn:similarity to ribosomal protein kinases:probable serine/threonine-protein kinase ybr028c] [gn:ybr0312] [gtcfc:8.5.9.4:12.13:14.3] [ec:2.7.1.-] [keggfc:8.5.9.4] [sgdfc:15.0.0:13.0.0] [db:gtc-saccharomyces cerevisiae] |
| CONTIG5604 | 34070937_f2_4 | 4317 | 18420 | 870 | 290 | YBR028C | 343 | 1.3(10)-40 | Saccharomyces cerevisiae | [ui:ybr028c] [pn:similarity to ribosomal protein kinases:probable serine/threonine-protein kinase ybr028c] [gn:ybr0312] [gtcfc:8.5.9.4:12.13:14.3] [ec:2.7.1.-] [keggfc:8.5.9.4] [sgdfc:15.0.0:13.0.0] [db:gtc-saccharomyces cerevisiae] |
| CONTIG3320 | 9772750_f2_2 | 4318 | 18421 | 627 | 209 | YBR059C | 485 | 3.2(10)-45 | Saccharomyces cerevisiae | [ui:ybr059c] [pn:similarity to ser/thr-specific protein kinase pak1p:probable serine/threonine-protein kinase ybr059c] [gn:ybr0519] [gtcfc:8.5.9.4:12.13:14.3] [ec:2.7.1.-] [keggfc:8.5.9.4] [sgdfc:5.0.0:13.0.0] [db:gtc-saccharomyces c |
| CONTIG5051 | 3957063_f1_1 | 4319 | 18422 | 1608 | 536 | YBR059C | 352 | 3.2(10)-29 | Saccharomyces cerevisiae | [ui:ybr059c] [pn:similarity to ser/thr-specific protein kinase pak1p:probable serine/threonine-protein kinase ybr059c] [gn:ybr0519] [gtcfc:8.5.9.4:12.13:14.3] [ec:2.7.1.-] [keggfc:8.5.9.4] [sgdfc:15.0.0:13.0.0] [db:gtc-saccharomyces c |
| CONTIG1377 | 29567590_c2_3 | 4320 | 18423 | 1146 | 382 | YBR097W | 538 | 1.3(10)-50 | Saccharomyces cerevisiae | [ui:ybr097w] [pn:ser/thr protein kinase:protein kinase vps15] [gn:vps15:ybr0825] [gtcfc:8.5.9.4:10.7:11.1:12.10:12.13] [ec:2.7.1.-] [keggfc:8.5.9.4] [sgdfc:6.2.0:8.3.0:8.5.0:15.0.0] [db:gtc-saccharomyces cerevisiae] |
| CONTIG1705 | 33635052_f2_1 | 4321 | 18424 | 1377 | 459 | YBR097W | 173 | 1.0(10)-10 | Saccharomyces cerevisiae | [ui:ybr097w] [pn:ser/thr protein kinase:protein kinase vps15] [gn:vps15:ybr0825] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5403 | 2789827_f1_4 | 4322 | 18425 | 1056 | 352 | YBR097W | 700 | 6.0(10)-68 | Saccharomyces cerevisiae | [gtcfc:8.5.9.4:10.7:11.1:12.10:12.13] [ec:2.7.1-] [keggfc:8.5.9.4] [sgdfc:6.2.0:8.3:0:8.5.0:15.0.0] [db:gtc-saccharomyces cerevisiae] [ui:ybr097w] [pn:ser/thr protein kinase:protein kinase vps15] [gn:vps15:ybr0825] |
| CONTIG4705 | 4475912_f2_3 | 4323 | 18426 | 993 | 331 | YBR160W | 1202 | 2.5(10)-122 | Saccharomyces cerevisiae | [gtcfc:8.5.9.4:10.7:11.1:12.10:12.13] [ec:2.7.1-] [keggfc:8.5.9.4] [sgdfc:6.2.0:8.3:0:8.5.0:15.0.0] [db:gtc-saccharomyces cerevisiae] [ui:ybr160w] [pn:cyclin-dependent protein kinase:cell division control protein 28] [gn:cdc28:srm5:ybr1211] [gtcfc:8.5.9.4:10.8:12.13:12.8] [ec:2.7.1-] [keggfc:8.5.9.4:13.1:13.2:13.3] [sgdfc:3.2.0:3.6.0:3.8.0:15.0.0] [db:gtc-saccharom |
| CONTIG5495 | 803161_c2_16 | 4324 | 18427 | 1932 | 644 | YCR008W | 1313 | 4.4(10)-134 | Saccharomyces cerevisiae | [ui:ycr008w] [pn:similarity to npr1p and hal5p protein kinases:probable serine/threonine-protein kinase ycr8w] [gn:sat4:ycr8w:ycr101:ycr046] [gtcfc:8.5.9.4:12.13:13.2] [ec:2.7.1-] [keggfc:8.5.9.4] [sgdfc:11.1.0:15.0.0] [db:gtc-saccha |
| CONTIG4031 | 4772782_f1_1 | 4325 | 18428 | 1044 | 348 | YDL108W | 1142 | 5.7(10)-116 | Saccharomyces cerevisiae | [ui:ydl108w] [pn:cyclin-dependent ser/thr protein kinase:serine/threonine-protein kinase kin28] [gn:kin28:d2330] [gtcfc:8.5.9.4:10.1:10.10:10.2:12.13:12.8] [ec:2.7.1-] [keggfc:8.5.9.4] |
| b9x11x80.x | 24227342_c2_2 | 4326 | 18429 | 309 | 103 | YDL101C | 219 | 2.3(10)-17 | Saccharomyces cerevisiae | [sgdfc:3.8.0:4.8.1.9.5.0:11.2.1:15.0.0] [db:gtc-] [ui:ydl101c] [pn:protein kinase:dna damage response protein kinase dun1] [gn:dun1:d2370] [gtcfc:8.5.9.4:10.1:10.10:10.2:12.13:12.8] [ec:2.7.1-] [keggfc:8.5.9.4:13.3] |
| CONTIG1961 | 14569708_c3_4 | 4327 | 18430 | 1143 | 381 | YDL028C | 411 | 1.0(10)-37 | Saccharomyces cerevisiae | [sgdfc:9.5.0:11.2.1:15.0.0] [db:gtc-saccharomyces cerevisiae] [ui:ydl028c] [pn:serine/threonine/tyrosine protein kinase:serine/threonine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2279 | 1269534_c1_4 | 4328 | 18431 | 636 | 212 | YDL028C | 536 | 1.1(10)-51 | Saccharomyces cerevisiae | protein kinase mps1:regulatory cell proliferation kinase 1 [gn:mps1:rpk1:d27785] [gcfc:8.5:9.4:12.13:12.8] [ec:2.7.1.-] [keggfc:8.5:9.4] [sgdfc:3.5:0:3.8.0:15] [ui:ydl028c] [pn:serine/threonine/tyrosine protein kinase:serine/threonine protein kinase mps1:regulatory cell proliferation kinase 1] [gn:mps1:rpk1:d27785] [gcfc:8.5:9.4:12.13:12.8] [ec:2.7.1.-] [keggfc:8.5:9.4] [sgdfc:3.5:0:3.8.0:15] |
| CONTIG2710 | 34182902_f3_2 | 4329 | 18432 | 1380 | 460 | YDL017W | 525 | 6.9(10)-75 | Saccharomyces cerevisiae | [ui:ydl017w] [pn:protein kinase:cell division control protein 7] [gn:cdc7:oaf2:d2855] [gcfc:8.5:9.4:10.1:10.2:10.8:12.13:12.8] [ec:2.7.1.-] [keggfc:8.5:9.4:13.2] [sgdfc:3.5:0:3.6.0:3.8.0:9.5.0:15.0.0] [db:gtc-saccharomyces cerevisiae] |
| CONTIG3789 | 16432842_f3_3 | 4330 | 18433 | 501 | 167 | YDL017W | 94 | 0.00073 | Saccharomyces cerevisiae | [ui:ydl017w] [pn:protein kinase:cell division control protein 7] [gn:cdc7:oaf2:d2855] [gcfc:8.5:9.4:10.1:10.2:10.8:12.13:12.8] [ec:2.7.1.-] [keggfc:8.5:9.4:13.2] [sgdfc:3.5:0:3.6.0:3.8.0:9.5.0:15.0.0] [db:gtc-saccharomyces cerevisiae] |
| CONTIG433 | 36351637_f2_1 | 4331 | 18434 | 318 | 106 | YDL017W | 103 | 8.0(10)-5 | Saccharomyces cerevisiae | [ui:ydl017w] [pn:protein kinase:cell division control protein 7] [gn:cdc7:oaf2:d2855] [gcfc:8.5:9.4:10.1:10.2:10.8:12.13:12.8] [ec:2.7.1.-] [keggfc:8.5:9.4:13.2] [sgdfc:3.5:0:3.6.0:3.8.0:9.5.0:15.0.0] [db:gtc-saccharomyces cerevisiae] |
| CONTIG2631 | 2949512_c1_5 | 4332 | 8435 | 1173 | 391 | YDR122W | 1051 | 2.5(10)-106 | Saccharomyces cerevisiae | [ui:ydr122w] [pn:ser/thr protein kinase:protein kinase] [gn:kin1] [gcfc:8.5:9.4:11.1:12.13] [ec:2.7.1.-] [keggfc:8.5:9.4] [sgdfc:9.1.0:15.0.0] [db:gtc-saccharomyces cerevisiae] |
| b3x13461.x | 16064567_f2_2 | 4333 | 18436 | 612 | 204 | YDR122W | 92 | 0.069 | Saccharomyces cerevisiae | [ui:ydr122w] [pn:ser/thr protein kinase:protein kinase] [gn:kin1] [gcfc:8.5:9.4:11.1:12.13] [ec:2.7.1.-] [keggfc:8.5:9.4] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2765 | 6852175_f3_2 | 4334 | 18437 | 1233 | 411 | YDR283C | 286 | 6.0(10)-48 | Saccharomyces cerevisiae | [sgdfc:9.1o:15.0.0] [db-gtc-saccharomyces cerevisiae] [ui:ydr283c] [pn:ser/thr protein kinase:protein kinase gen2] [gn:gcn2:aas1] [gtcfc:8.5:9.4:10.7:12.13] [ec:2.7.1.-] [keggfc:8.5.9.4] [sgdfc:5.3.0:9.2.0:15.0.0] [db-gtc-saccharomyces cerevisiae] |
| CONTIG3593 | 19532525_c3_4 | 4335 | 18438 | 1053 | 351 | YDR283C | 400 | 9.6(10)-58 | Saccharomyces cerevisiae | [ui:ydr283c] [pn:ser/thr protein kinase:protein kinase gen2] [gn:gcn2:aas1] [gtcfc:8.5:9.4:10.7:12.13] [ec:2.7.1.-] [keggfc:8.5.9.4] [sgdfc:5.3.0:9.2.0:15.0.0] [db-gtc-saccharomyces cerevisiae] |
| CONTIG4328 | 4797160_f1_1 | 4336 | 18439 | 792 | 264 | YDR283C | 160 | 2.8(10)-10 | Saccharomyces cerevisiae | [ui:ydr283c] [pn:ser/thr protein kinase:protein kinase gen2] [gn:gcn2:aas1] [gtcfc:8.5:9.4:10.7:12.13] [ec:2.7.1.-] [keggfc:8.5.9.4] [sgdfc:5.3.0:9.2.0:15.0.0] [db-gtc-saccharomyces cerevisiae] |
| CONTIG443 | 2384652_c3_1 | 4337 | 18440 | 645 | 215 | YDR283C | 334 | 8.6(10)-29 | Saccharomyces cerevisiae | [ui:ydr283c] [pn:ser/thr protein kinase:protein kinase gen2] [gn:gcn2:aas1] [gtcfc:8.5:9.4:10.7:12.13] [ec:2.7.1.-] [keggfc:8.5.9.4] [sgdfc:5.3.0:9.2.0:15.0.0] [db-gtc-saccharomyces cerevisiae] |
| CONTIG2526 | 4492135_f1_1 | 4338 | 18441 | 1254 | 418 | YDR477W | 1345 | 1.8(10)-137 | Saccharomyces cerevisiae | [ui:ydr477w] [pn:carbon catabolite derepressing ser/thr protein kinase:carbon catabolite derepressing protein kinase] [gn:snf1:cat1:ccr1:pas14:glc2:d8035] [gtcfc:8.5:9.4:12.13:13.2] [ec:2.7.1.-] [keggfc:8.5.9.4] [sgdfc:1.5.2:9.2.0:11.] |
| CONTIG369 | 11813561_f2_1 | 4339 | 18442 | 438 | 146 | YDR477W | 500 | 6.2(10)-48 | Saccharomyces cerevisiae | [ui:ydr477w] [pn:carbon catabolite derepressing ser/thr protein kinase:carbon catabolite derepressing protein kinase] [gn:snf1:cat1:ccr1:pas14:glc2:d8035] [gtcfc:8.5:9.4:12.13:13.2] [ec:2.7.1.-] [keggfc:8.5.9.4] [sgdfc:1.5.2:9.2.0:11.] |
| CONTIG5005 | 820385_f3_3 | 4340 | 18443 | 1293 | 431 | YDR523C | 311 | 1.3(10)-27 | Saccharomyces cerevisiae | [ui:ydr523c] [pn:ser/thr protein kinase:sporulation-specific protein 1] [gn:sps1:d9719] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5636 | 35164093_f3_4 | 4341 | 18444 | 1095 | 365 | YDR523C | 237 | 4.2(10)-34 | Saccharomyces cerevisiae | [gtcfc:8.5.9.4;12.13;12.15:12.8] [ec:2.7.1.-] [keggfc:8.5.9.4] [sgdfc:3.4.0:3.5.0:15.0.0] [db:gtc-saccharomyces cerevisiae] [ui:ydr523c] [pn:ser/thr protein kinase:sporulation-specific protein 1] [gn:sps1:d9719] |
| CONTIG1559 | 24707588_c2_5 | 4342 | 18445 | 903 | 301 | YER123W | 95 | 0.05099 | Saccharomyces cerevisiae | [gtcfc:8.5.9.4;12.13;12.15:12.8] [ec:2.7.1.-] [keggfc:8.5.9.4] [sgdfc:3.4.0:3.5.0:15.0.0] [db:gtc-saccharomyces cerevisiae] [ui:yer123w] [pn:casein kinase, isoform i homolog 3] [gn:yck3:cki3] [gtcfc:8.5.9.4;11.1;12.13;12.8] [ec:2.7.1.-] [keggfc:8.5.9.4] [sgdfc:3.8.0:9.1.0:9.2.0:15.0.0] [db:gtc-saccharomyces cerevisiae] |
| CONTIG2252 | 20133502_c3_2 | 4343 | 18446 | 912 | 304 | YER129W | 448 | 3.2(10)-41 | Saccharomyces cerevisiae | [ui:yer129w] [pn:protein kinase:serine/threonine-protein kinase pak1] [gn:pak1:sygp-orf45] [gtcfc:8.5.9.4;12.13;14.3] [ec:2.7.1.-] [keggfc:8.5.9.4] [sgdfc:15.0.0:13.0.0] [db:gtc-saccharomyces cerevisiae] |
| CONTIG5646 | 23648375_c2_16 | 4344 | 18447 | 4278 | 1426 | YER129W | 575 | 1.1(10)-91 | Saccharomyces cerevisiae | [ui:yer129w] [pn:protein kinase:serine/threonine-protein kinase pak1] [gn:pak1:sygp-orf45] [gtcfc:8.5.9.4;12.13;14.3] [ec:2.7.1.-] [keggfc:8.5.9.4] [sgdfc:15.0.0:13.0.0] [db:gtc-saccharomyces cerevisiae] |
| b3x13076.x | 24820337_c1_1 | 4345 | 18448 | 288 | 96 | YER129W | 127 | 6.0(10)-7 | Saccharomyces cerevisiae | [ui:yer129w] [pn:protein kinase:serine/threonine-protein kinase pak1] [gn:pak1:sygp-orf45] [gtcfc:8.5.9.4;12.13;14.3] [ec:2.7.1.-] [keggfc:8.5.9.4] [sgdfc:15.0.0:13.0.0] [db:gtc-saccharomyces cerevisiae] |
| CONTIG2770 | 35829017_c2_2 | 4346 | 18449 | 909 | 303 | YFL033C | 550 | 9.5(10)-52 | Saccharomyces cerevisiae | [ui:yfl033c] [pn:similarity to s. pombe cek1 serine/threonine protein kinase:probable serine/threonine-protein kinase yfl033c] [gtcfc:8.5.9.4;12.13;14.3] [ec:2.7.1.-] [keggfc:8.5.9.4] [sgdfc:15.0.0:13.0.0] [db:gtc-saccharomyces cerevisiae] |
| CONTIG4635 | 14178450_f3_6 | 4347 | 18450 | 858 | 286 | YFL033C | 97 | 0.17 | Saccharomyces cerevisiae | [ui:yfl033c] [pn:similarity to s. pombe cek1 serine/threonine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4951 | 196890_f2_3 | 4348 | 18451 | 1158 | 386 | YFL033C | 290 | 3.5(10)-33 | *Saccharomyces cerevisiae* | protein kinase:probable serine/threonine-protein kinase yfl033c] [gtcfc:8.5:9.4:12.13:14.3] [ec:2.7.1.-] [kegg fc:8.5:9.4] [sgdfc:15.0.0:13.0.0] [db-gtc-*saccharomyces cerevis* [ui:yfl033c] [pn:similarity to *s. pombe* cek1 serine/threonine protein kinase:probable serine/threonine-protein kinase yfl033c] [gtcfc:8.5:9.4:12.13:14.3] [ec:2.7.1.-] [kegg fc:8.5:9.4] [sgdfc:15.0.0:13.0.0] [db-gtc-*saccharomyces cerevis* |
| CONTIG4951 | 4164136_f2_4 | 4349 | 18452 | 732 | 244 | YFL033C | 179 | 2.8(10)-12 | *Saccharomyces cerevisiae* | [ui:yfl033c] [pn:similarity to *s. pombe* cek1 serine/threonine protein kinase:probable serine/threonine-protein kinase yfl033c] [gtcfc:8.5:9.4:12.13:14.3] [ec:2.7.1.-] [kegg fc:8.5:9.4] [sgdfc:15.0.0:13.0.0] [db-gtc-*saccharomyces cerevis* |
| CONTIG879 | 1464010_c1_2 | 4350 | 18453 | 570 | 190 | YFL033C | 92 | 0.01 | *Saccharomyces cerevisiae* | [ui:yfl033c] [pn:similarity to *s. pombe* cek1 serine/threonine protein kinase:probable serine/threonine-protein kinase yfl033c] [gtcfc:8.5:9.4:12.13:14.3] [ec:2.7.1.-] [kegg fc:8.5:9.4] [sgdfc:5.0.0:13.0.0] [db-gtc-*saccharomyces cerevis* |
| CONTIG2080 | 20114042_f1_2 | 4351 | 18454 | 1038 | 346 | YFL029C | 239 | 5.2(10)-19 | *Saccharomyces cerevisiae* | [ui:yfl029c] [pn:cdk-activating protein kinase:serine/threonine-protein kinase cak1:cdk-activating kinase] [gn:cak1:civ1] [gtcfc:8.5:9.4:12.13:12.8] [ec:2.7.1.-] [kegg fc:8.5:9.4:13.3] [sgdfc:3.8.0:15.0.0] [db-gtc-*saccharomyces cerevis* |
| CONTIG3639 | 25398512_c1_4 | 4352 | 18455 | 786 | 262 | YGL180W | 187 | 1.6(10)-17 | *Saccharomyces cerevisiae* | [ui:ygl180w] [pn:weak similarity to ser/thr protein kinases:probable serine/threonine-protein kinase ygl180w] [gn:g1615] [gtcfc:8.5:9.4:12.13:14.3] [ec:2.7.1.-] [kegg fc:8.5:9.4] [sgdfc:15.0.0:13.0.0] [db-gtc-*saccharomyces cerevisiae*] |
| CONTIG5646 | 2191277_c3_20 | 4353 | 18456 | 1233 | 411 | YGL180W | 874 | 1.3(10)-87 | *Saccharomyces cerevisiae* | [ui:ygl180w] [pn:weak similarity to ser/thr protein kinases:probable serine/threonine-protein kinase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG607 | 9814063_f2_1 | 4354 | 18457 | 792 | 264 | YGR092W | 352 | 8.4(10)-32 | Saccharomyces cerevisiae | ygl180w] [gn:g1615] [gtcfc:8.5.9.4:12.13:14..3] [ec:2.7.1.-] [keggfc:8.5.9.4] [sgdfc:15.0.0:13.0.0] [db:gtc-saccharomyces cerevisiae] [ui:ygr092w] [pn:ser/thr protein kinase related to dbf20p:cell cycle protein kinase] [gn:dbf2] [gtcfc:8.5.9.4:12.13:12.8] [ec:2.7.1.-] [keggfc:8.5.9.4:13..3] [sgdfc:3.8.0:15.0.0] [db:gtc-saccharomyces cerevisiae] |
| b3x16309.x | 22437827_c2_3 | 4355 | 18458 | 879 | 293 | YGR092W | 509 | 5.5(10)-59 | Saccharomyces cerevisiae | [ui:ygr092w] [pn:ser/thr protein kinase related to dbf20p:cell cycle protein kinase] [gn:dbf2] [gtcfc:8.5.9.4:12.13:12.8] [ec:2.7.1.-] [keggfc:8.5.9.4:13..3] [sgdfc:3.8.0:15.0.0] [db:gtc-saccharomyces cerevisiae] |
| CONTIG3029 | 13835130_c1_4 | 4356 | 18459 | 1443 | 481 | YGR188C | 661 | 2.0(10)-64 | Saccharomyces cerevisiae | [ui:ygr188c] [pn:ser/thr protein kinase:checkpoint serine/threonine-protein kinase bub1] [gn:bub1:g7542] [gtcfc:8.5.9.4:10.1:10.2:12.13:12.8] [ec:2.7.1.-] [keggfc:8.5.9.4] [sgdfc:3.8.0:9.5.0:15.0.0] [db:gtc-saccharomyces cerevisiae] |
| b1x17652.y | 16287538_f3_1 | 4357 | 18460 | 807 | 269 | YGR188C | 194 | 8.5(10)-17 | Saccharomyces cerevisiae | [ui:ygr188c] [pn:ser/thr protein kinase:checkpoint serine/threonine-protein kinase bub1] [gn:bub1:g7542] [gtcfc:8.5.9.4:10.1:10.2:12.13:12.8] [ec:2.7.1.-] [keggfc:8.5.9.4] [sgdfc:3.8.0:9.5.0:15.0.0] [db:gtc-saccharomyces cerevisiae] |
| CONTIG4932 | 15745328_f2_3 | 4358 | 18461 | 1233 | 411 | YHL007C | 1209 | 4.5(10)-123 | Saccharomyces cerevisiae | [ui:yhl007c] [pn:ser/thr protein kinase of the pheromone pathway:serine/threonine-protein kinase] [gn:ste20] [gtcfc:8.5.9.4:12.13:12.8:12.9] [ec:2.7.1.-] [keggfc:8.5.9.4:13.1:13..3] [sgdfc:3.2.0:3.3.0:9.2.0:10.1.4:15.0.0] [db:gtc-sacch |
| CONTIG5773 | 24413287_c3_31 | 4359 | 18462 | 1623 | 541 | YHR030C | 1348 | 8.5(10)-138 | Saccharomyces cerevisiae | [ui:yhr030c] [pn:ser/thr protein kinase of map kinase family:mitogen-activated protein kinase slt2/mpk1:map kinase mpk1] [gn:slt2:mpk1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2779 | 181557_c2_3 | 4360 | 18463 | 1161 | 387 | YHR079C | 445 | 6.2(10)-41 | Saccharomyces cerevisiae | [ui:yhr079c] [pn:protein kinase:probable protein kinase ire1 precursor] [gn:ire1:ern1] [gtcfc:8.5.9.4:12.13:12.16:13.2] [ec:2.7.1.-] [keggfc:8.5.9.4] [sgdfc:9.4.0:11.1.0:15.0.0] [db:gtc-saccharomyces cerevisiae] |
| CONTIG652 | 4772567_f2_1 | 4361 | 18464 | 804 | 268 | YHR079C | 643 | 3.1(10)-62 | Saccharomyces cerevisiae | [ui:yhr079c] [pn:protein kinase:probable protein kinase ire1 precursor] [gn:ire1:ern1] [gtcfc:8.5.9.4:12.13:12.16:13.2] [ec:2.7.1.-] [keggfc:8.5.9.4] [sgdfc:9.4.0:11.1.0:15.0.0] [db:gtc-saccharomyces cerevisiae] |
| b2x14728.x | 11173962_f2_1 | 4362 | 18465 | 528 | 176 | YHR079C | 385 | 1.7(10)-34 | Saccharomyces cerevisiae | [ui:yhr079c] [pn:protein kinase:probable protein kinase ire1 precursor] [gn:ire1:ern1] [gtcfc:8.5.9.4:12.13:12.16:13.2] [ec:2.7.1.-] [keggfc:8.5.9.4] [sgdfc:9.4.0:11.1.0:15.0.0] [db:gtc-saccharomyces cerevisiae] |
| CONTIG4004 | 15829380_c2_7 | 4363 | 18466 | 1914 | 638 | YHR082C | 301 | 1.3(10)-25 | Saccharomyces cerevisiae | [ui:yhr082c] [pn:ser/thr protein kinase:serine/threonine-protein kinase] [gn:ksp1] [gtcfc:8.5.9.4:10.1:10.2:12.12.13] [ec:2.7.1.-] [keggfc:8.5.9.4] [sgdfc:9.5.0:15.0.0] [db:gtc-saccharomyces cerevisiae] |
| CONTIG4754 | 787550_f1_6 | 4364 | 18467 | 315 | 105 | YHR082C | 133 | 1.2(10)-7 | Saccharomyces cerevisiae | [ui:yhr082c] [pn:ser/thr protein kinase:serine/threonine-protein kinase] [gn:ksp1] [gtcfc:8.5.9.4:10.1:10.2:12.12.13] [ec:2.7.1.-] [keggfc:8.5.9.4] [sgdfc:9.5.0:15.0.0] [db:gtc-saccharomyces cerevisiae] |
| CONTIG4227 | 10985682_c3_8 | 4365 | 18468 | 2061 | 687 | YHR102W | 1093 | 9.0(10)-111 | Saccharomyces cerevisiae | [ui:yhr102w] [pn:ser/thr protein kinase that interacts with cdc31p:serine/threonine-protein kinase:n-rich kinase 1] [gn:nrk1] [gtcfc:8.5.9.4:12.13:12.8] [ec:2.7.1.-] [keggfc:8.5.9.4] [sgdfc:3.8.0:15.0.0] [db:gtc-saccharomyces cerevisi |

TABLE 2

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5005 | 1175001_f3_2 | 4366 | 18469 | 396 | 132 | YHR102W | 197 | 1.8(10)-14 | *Saccharomyces cerevisiae* | [ui:yhr102w] [pn:ser/thr protein kinase that interacts with cdc31p:serine/threonine-protein kinase:n-rich kinase 1] [gn:nrk1] [gtcfc:8.5.9.4.12.13:12.8] [ec:2.7.1.-] [kegg fc:8.5.9.4] [sgdkc:3.8.0:15.0.0] [db:gtc-saccharomyces cerevisi |
| CONTIG5332 | 31652083_f2_3 | 4367 | 18470 | 570 | 190 | YHR102W | 109 | 4.7(10)-5 | *Saccharomyces cerevisiae* | [ui:yhr102w] [pn:ser/thr protein kinase that interacts with cdc31p:serine/threonine-protein kinase:n-rich kinase 1] [gn:nrk1] [gtcfc:8.5.9.4.12.13:12.8] [ec:2.7.1.-] [kegg fc:8.5.9.4] [sgdkc:3.8.0:15.0.0] [db:gtc-saccharomyces cerevisi |
| CONTIG3439 | 23869215_c3_8 | 4368 | 18471 | 1833 | 611 | YJL187C | 566 | 2.2(10)-69 | *Saccharomyces cerevisiae* | [ui:yjl187c] [pn:ser/tyr dual-specifity protein kinase:mitosis inhibitor protein kinase swe1] [gn:swe1:j0406] [gtcfc:8.5.9.4.12.13:12.8] [ec:2.7.1.-] [kegg fc:8.5.9.4.13.3] [sgdfc:3.8.0:15.0.0] [db:gtc-*saccharomyces cerevisiae*] |
| CONTIG3751 | 21681527_f3_1 | 4369 | 18472 | 1791 | 597 | YJL141C | 517 | 3.1(10)-49 | *Saccharomyces cerevisiae* | [ui:yjl141c] [pn:ser/thr protein kinase:protein kinase yak1] [gn:yak1:j0652] [gtcfc:8.5.9.4.12.13:12.8] [ec:2.7.1.-] [kegg fc:8.5.9.4] [sgdfc:3.8.0:15.0.0] [db:gtc-*saccharomyces cerevisiae*] |
| CONTIG3091 | 97531_f1_1 | 4370 | 18473 | 1455 | 485 | YJL141C | 1074 | 9.1(10)-109 | *Saccharomyces cerevisiae* | [ui:yjl141c] [pn:ser/thr protein kinase:protein kinase yak1] [gn:yak1:j0652] [gtcfc:8.5.9.4.12.13:12.8] [ec:2.7.1.-] [kegg fc:8.5.9.4] [sgdfc:3.8.0:15.0.0] [db:gtc-*saccharomyces cerevisiae*] |
| CONTIG3112 | 12695187_f3_2 | 4371 | 18474 | 996 | 332 | YJL128C | 562 | 1.7(10)-54 | *Saccharomyces cerevisiae* | [ui:yjl128c] [pn:tyrosine protein kinase of the map kinase kinase family:polymyxin b resistance protein kinase] [gn:pbs2:hog4:sfs4:ssk4:j0699] [gtcfc:8.5.9.4.12.11:12.13:13.2] [ec:2.7.1.-] [kegg fc:8.5.9.4] |
| CONTIG5493 | 7267961_f3_7 | 4372 | 18475 | 1581 | 527 | YJL106W | 933 | 8.0(10)-94 | *Saccharomyces cerevisiae* | [ui:yjl106w] [pn:ser/thr protein kinase:meiosis induction protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4749 | 4881586_c2_9 | 4373 | 18476 | 1860 | 620 | YJL057C | 337 | 9.8(10)-28 | Saccharomyces cerevisiae | kinase sme1/ime2 [gn:sme1:ime2:j0817] [gtcfc:8.5.9.4:12.13:12.15:12.8] [ec:2.7.1.-] [keggfc:8.5.9.4] [sgdfc:3.4.0:3.5.0:3.8.0:15.0.0] [db:gtc-saccharomyces cerevisiae] [ui:yjl057c] [pn:weak similarity to human p1/eif-2a protein kinase;probable serine/threonine protein kinase yjl057c] [gn:j1143] [gtcfc:8.5.9.4:14.3] [ec:2.7.1.-] [keggfc:8.5.9.4] [sgdfc:13.0.0] |
| b2x11515.x | 43754438_f3_3 | 4374 | 18477 | 561 | 187 | YJL006C | 147 | 5.7(10)-10 | Saccharomyces cerevisiae | [db:gtc-saccharomyces cerevisiae] [ui:yjl006c] [pn:carboxy-terminal domain:ctd kinase, beta subunit:c kinase beta subunit:ctd kinase 38 kd subunit:ctdk-i beta subunit] [gn:ctk2:j1390] [gtcfc:8.5.9.4:10.1:10.2] [ec:2.7.0] [keggfc:8.5.9.4] |
| CONTIG3458 | 22071000_c3_12 | 4375 | 18478 | 801 | 267 | YJR059W | 401 | 1.6(10)-36 | Saccharomyces cerevisiae | [sgdfc:4.8.2:9.5.0] [db:gt [ui:yjr059w] [pn:involved in polyamine uptake:probable serine/threonine-protein kinase yjr059w] [gn:ptk2:j1725] [gtcfc:8.5.9.4:12.13:12.16] [ec:2.7.1.-] [keggfc:8.5.9.4] [sgdfc:8.8.0:15.0.0] [db:gtc-saccharomyces cerevisiae] |
| CONTIG3458 | 31899812_c1_5 | 4376 | 18479 | 978 | 326 | YJR059W | 469 | 6.5(10)-44 | Saccharomyces cerevisiae | [ui:yjr059w] [pn:involved in polyamine uptake:probable serine/threonine-protein kinase yjr059w] [gn:ptk2:j1725] [gtcfc:8.5.9.4:12.13:12.16] [ec:2.7.1.-] [keggfc:8.5.9.4] [sgdfc:8.0.0:15.0.0] [db:gtc-saccharomyces cerevisiae] |
| CONTIG2622 | 26048442_f3_2 | 4377 | 18480 | 1986 | 662 | YKL171W | 235 | 1.8(10)-29 | Saccharomyces cerevisiae | [ui:ykl171w] [pn:ser/thr protein kinase;probable serine/threonine-protein kinase ykl171w] [gn:ykl635] [gtcfc:12.13:8.5.9.4] [ec:2.7.1.-] [keggfc:15.0.0:13.0.0] [db:gtc-saccharomyces cerevisiae] |
| CONTIG3900 | 24039516_f3_4 | 4378 | 18481 | 1680 | 560 | YKL139W | 874 | 1.3(10)-87 | Saccharomyces cerevisiae | [ui:ykl139w] [pn:carboxy-terminal domain:ctd kinase, alpha subunit:ctd kinase alpha subunit:ctd kinase 58 kd subunit:ctdk-i alpha subunit] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3582 | 24005340_c3_5 | 4379 | 18482 | 1413 | 471 | YKL126W | 1386 | 8.0(10)-142 | Saccharomyces cerevisiae | [ui:ykl126w] [pn:ser/thr-specific protein kinase:serine/threonine-protein kinase] [gn:ypk1] [gtcfc:8.5.9.4:12.13.14.3] [ec:2.7.1.-] [keggfc:8.5.9.4] [sgdfc:15.0.0:13.0.0] [db:gtc-saccharomyces cerevisiae] [gn:ctk1] [gtcfc:8.5.9.4:10.1:10.2:12.13] [ec:2.7.1.-] [keggfc:8.5.9.4] [sgdfc:4.8.2:9.5:0.15.0] |
| CONTIG4716 | 15120377_f3_7 | 4380 | 18483 | 1476 | 492 | YKL116C | 139 | 2.0(10)-6 | Saccharomyces cerevisiae | [ui:ykl116c] [pn:ser/thr protein kinase with similarity to rat snf1, celegans unc-51, dun1p:probable serine/threonine-protein kinase ykl116c] [gn:ykl516] [gtcfc:8.5.9.4:12.13.14.3] [ec:2.7.1.-] [keggfc:8.5.9.4] [sgdfc:15.0.0:13.0.0] [ |
| CONTIG5282 | 33222062_f1_1 | 4381 | 18484 | 1320 | 440 | YKL101W | 112 | 0.0077 | Saccharomyces cerevisiae | [ui:ykl101w] [pn:ser/thr protein kinase that interacts genetically with histone mutations:probable serine/threonine-protein kinase ykl101w] [gn:hsl1:ykl453] [gtcfc:8.5.9.4:12.13.12.8] [ec:2.7.1.-] [keggfc:8.5.9.4:13.3] [sgdfc:3.8.0:15] |
| CONTIG5594 | 4885787_f3_7 | 4382 | 18485 | 1164 | 388 | YKL101W | 438 | 6.4(10)-40 | Saccharomyces cerevisiae | [ui:ykl101w] [pn:ser/thr protein kinase that interacts genetically with histone mutations:probable serine/threonine-protein kinase ykl101w] [gn:hsl1:ykl453] [gtcfc:8.5.9.4:12.13.12.8] [ec:2.7.1.-] [keggfc:8.5.9.4:13.3] [sgdfc:3.8.0:15] |
| b2x12381.y | 14540930_f3_1 | 4383 | 18486 | 351 | 117 | YKL101W | 198 | 2.2(10)-14 | Saccharomyces cerevisiae | [ui:ykl101w] [pn:ser/thr protein kinase that interacts genetically with histone mutations:probable serine/threonine-protein kinase ykl101w] [gn:hsl1:ykl453] [gtcfc:8.5.9.4:12.13.12.8] [ec:2.7.1.-] [keggfc:8.5.9.4:13.3] [sgdfc:3.8.0:15] |
| CONTIG3954 | 4393910_c2_4 | 4384 | 18487 | 996 | 332 | YLL019C | 117 | 0.00027 | Saccharomyces cerevisiae | [ui:yll019c] [pn:ser/thr protein kinase:probable serine/threonine-protein kinase] [gn:kns1] [gtcfc:8.5.9.4:12.13.14.3] [ec:2.7.1.-] [keggfc:85.9.4] [sgdfc:15.0.0:13.0.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x13q33.x | 21766543_f1_1 | 4385 | 18488 | 621 | 207 | YLL019C | 499 | 1.3(10)-47 | *Saccharomyces cerevisiae* | *saccharomyces cerevisiae* [ui:yll019c] [pn:ser/thr protein kinase;probable serine/threonine-protein kinase] [gn:kns1] [gtcfc:8.5.9.4:12.13:14.3] [ec:2.7.1.-] [keggfc:8.5.9.4] [sgdfc:15.0.0:13.0.0] [db:gtc-*saccharomyces cerevisiae*] |
| CONTIG2037 | 13869203_f1_1 | 4386 | 18489 | 708 | 236 | YLR096W | 270 | 3.3(10)-22 | *Saccharomyces cerevisiae* | [ui:ylr096w] [pn:ser/thr protein kinase protein kinase] [gn:kin2] [gtcfc:8.5.9.4:11.1:12.13] [ec:2.7.1.-] [keggfc:8.5.9.4] [sgdfc:9/1:0:15.0.0] [db:gtc-*saccharomyces cerevisiae*] |
| CONTIG2037 | 12617180_f1_2 | 4387 | 18490 | 555 | 185 | YLR096W | 167 | 3.2(10)-11 | *Saccharomyces cerevisiae* | [ui:ylr096w] [pn:ser/thr protein kinase:protein kinase] [gn:kin2] [gtcfc:8.5.9.4:11.1:12.13] [ec:2.7.1.-] [keggfc:8.5.9.4] [sgdfc:9.1.0:15.0.0] [db:gtc-*saccharomyces cerevisiae*] |
| CONTIG3656 | 195437_f1_3 | 4388 | 18491 | 240 | 80 | YLR113W | 253 | 2.5(10)-21 | *Saccharomyces cerevisiae* | [ui:ylr113w] [pn ser/thr protein kinase of map kinase:mapk family:mitogen-activated protein kinase hog1:map kinase hog:osmosensing protein hog1] [gn:hog1:ssk3:19354] [gtcfc:8.5.9.4:12.11:12.13:13.2] [ec:2.7.1.-] [keggfc:8.5.9.4] [sgdf |
| b9x12d90.y | 11737841_f2_1 | 4389 | 18492 | 666 | 222 | YLR113W | 826 | 1.8(10)-82 | *Saccharomyces cerevisiae* | [ui:ylr113w] [pn:ser/thr protein kinase of map kinase:mapk family:mitogen-activated protein kinase hog1:map kinase hog:osmosensing protein hog1] [gn:hog1:ssk3:19354] [gtcfc:8.5.9.4:12.11:12.13:13.2] |
| CONTIG3789 | 2495715_f2_1 | 4390 | 18493 | 1182 | 394 | YLR248W | 325 | 1.3(10)-55 | *Saccharomyces cerevisiae* | [ui:ylr248w] [pn:ca/calmodulin-dependent ser/thr protein kinase:serine/threonine-protein kinase rck2:cam kinase-like protein kinase clk1] [gn:rck2:clk1:cmk3:i9672] [gtcfc:8.5.9.4:12.13:12.8] [ec:2.7.1.-] [keggfc:8.5.9.4] [sgdfc:3.8.0: |
| CONTIG4245 | 203175_c2_14 | 4391 | 18494 | 1803 | 601 | YLR248W | 892 | 3.5(10)-94 | *Saccharomyces cerevisiae* | [ui:ylr248w] [pn:ca/calmodulin-dependent ser/thr protein kinase:serine/threonine-protein kinase rck2:cam kinase-like protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4407 | 787812_c2_6 | 4392 | 18495 | 1791 | 597 | YLR362W | 759 | 2.2(10)-109 | Saccharomyces cerevisiae | kinase clk1 [gn:rck2:clk1:cmk3:i9672] [gtcfc:8.5.9.4:12.13:12.8] [ec:2.7.1-] [keggfc:8.5.9.4] [sgdfc:3.8.0: [ui:ylr362w] [pn:ser/thr protein kinase of the mekk family:serine/threonine-protein kinase ste11] [gn:ste11:i8039] [gtcfc:8.5.9.4:12.13:12.8:12.9] [ec:2.7.1-] [keggfc:8.5.9.4:13.1] [sgdfc:3.2.0:3.3.0:10.1.4:10.4.6:15.0.0] [db:gtc-sac |
| CONTIG3441 | 259470075_c3_6 | 4393 | 18496 | 1005 | 335 | YMR001C | 467 | 9.4(10)-53 | Saccharomyces cerevisiae | [ui:ymr001c] [pn:involved in regulation of dna replication:cell cycle protein kinase cdc5/msd2] [gn:cdc5:pkx2:msd2:ym8270] [gtcfc:8.5.9.4:10.8:12.13:12.8] [ec:2.7.1-] [keggfc:8.5.9.4:13.3] [sgdfc:3.6.0:3.8.0:15.0.0] [db:gtc-saccharom |
| CONTIG3441 | 31510455_c2_5 | 4394 | 18497 | 993 | 331 | YMR001C | 1104 | 60(10)-112 | Saccharomyces cerevisiae | [ui:ymr001c] [pn:involved in regulation of dna replication:cell cycle protein kinase cdc5/msd2] [gn:cdc5:pkx2:msd2:ym8270] [gtcfc:8.5.9.4:10.8:12.13:12.8] [ec:2.7.1-] [keggfc:8.5.9.4:13.3] [sgdfc:3.6.0:3.8.0:15.0.0] [db:gtc-saccharom |
| CONTIG153 | 34568942_f1_1 | 4395 | 18498 | 228 | 76 | YMR104C | 276 | 3.1(10)-23 | Saccharomyces cerevisiae | [ui:ymr104c] [pn:ser/thr protein kinase:serine/threonine-protein kinase ypk2/ykr2] [gn:ypk2:ykr2:ym9718] [gtcfc:8.5.9.4:12.13:12.8] [ec:2.7.1-] [keggfc:8.5.9.4] [sgdfc:3.8.0:15.0.0] [db:gtc-saccharomyces cerevisiae |
| CONTIG3595 | 34073402_f3_6 | 4396 | 18499 | 1185 | 395 | YMR139W | 1047 | 6.7(10)-106 | Saccharomyces cerevisiae | [ui:ymr139w] [pn:ser/thr protein kinase:serine/threonine-protein kinase mds1/rim11] [gn:mds1:rim11:gsk3:ym9375] [gtcfc:8.5.9.4:10.1:10.2:12.13:12.8] [ec:2.7.1-] [keggfc:8.5.9.4] [sgdfc:3.5.0:9.5.0:15.0.0] [db:gtc-saccharomyces cerevi |
| CONTIG2534 | 2454007_f3_2 | 4397 | 18500 | 1236 | 412 | YNL307C | 944 | 1.2(10)-104 | Saccharomyces cerevisiae | [ui:ynl307c] [pn:ser/thr/tyr protein kinase:protein kinase mck1:meiosis and centromere regulatory kinase] [gn:mck1:ypk1:n0392] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5640 | 1417062_f3_5 | 4398 | 18501 | 915 | 305 | YNL298W | 948 | 2.1(10)-95 | Saccharomyces cerevisiae | [ui:ynl298w] [pn:ser/thr protein kinase:serine/threonine-protein kinase cla4] [gn:cla4:n0450] [gtcfc:8.5.9.4:12.13:12.15:12.8] [ec:2.7.1.-] [keggfc:8.5.9.4] [sgdfc:3.4.0:3.5.0:3.8.0:15.0.0] [db:gtc-sac] [gtcfc:8.5.9.4:12.13:12.8] [ec:2.7.1.-] [keggfc:8.5.9.4:13.3] [sgdfc:3.9.0:15.0.0] [db:gtc-saccharomyces cerevisiae] |
| CONTIG4277 | 26178451_c3_5 | 4399 | 18502 | 192 | 64 | YNL161W | 160 | 1.1(10)-10 | Saccharomyces cerevisiae | [ui:ynl161w] [pn:similarity to ser/thr protein kinase:probable serine/threonine-protein kinase ynl161w] [gn:n1727] [gtcfc:8.5.9.4:12.13:14.3] [ec:2.7.1.-] [keggfc:8.5.9.4] [sgdfc:15.0.0:13.0.0] [db:gtc-saccharomyces cerevisiae] |
| CONTIG4277 | 24428261_c2_4 | 4400 | 18503 | 1251 | 417 | YNL161W | 1705 | 1.3(10)-175 | Saccharomyces cerevisiae | [ui:ynl161w] [pn:similarity to ser/thr protein kinase:probable serine/threonine-protein kinase ynl161w] [gn:n1727] [gtcfc:8.5.9.4:12.13:14.3] [ec:2.7.1.-] [keggfc:8.5.9.4] [sgdfc:15.0.0:13.0.0] [db:gtc-saccharomyces cerevisiae] |
| CONTIG2988 | 14572163_c2_11 | 4401 | 18504 | 1509 | 503 | YNL154C | 1392 | 1.8(10)-142 | Saccharomyces cerevisiae | [ui:ynl154c] [pn:casein kinase i isoform:casein kinase i homolog 2] [gn:yck2:cki1:n1755] [gtcfc:8.5.9.4:12.13:12.8:13.2] [ec:2.7.1.-] [keggfc:8.5.9.4] [sgdfc:3.1.0:3.2.0:11.1.0:15.0.0] [db:gtc-saccharomyces cerevisiae] |
| CONTIG3895 | 19926502_f1_1 | 4402 | 18505 | 1419 | 473 | YNL154C | 1282 | 8.4(10)-131 | Saccharomyces cerevisiae | [ui:ynl154c] [pn:casein kinase i isoform:casein kinase i homolog 2] [gn:yck2:cki1:n1755] [gtcfc:8.5.9.4:12.13:12.8:13.2] [ec:2.7.1.-] [keggfc:8.5.9.4] [sgdfc:3.1.0:3.2.0:11.1.0:15.0.0] [db:gtc-saccharomyces cerevisiae] |
| CONTIG4709 | 12922175_c2_15 | 4403 | 18506 | 1035 | 345 | YNL020C | 842 | 3.5(10)-84 | Saccharomyces cerevisiae | [ui:ynl020c] [pn:strong similarity to protein kinase pak1:probable serine/threonine-protein kinase ynl020c] [gn:n2823] [gtcfc:8.5.9.4:12.13:14.3] [ec:2.7.1.-] [keggfc:8.5.9.4] [sgdfc:15.0.0:13.0.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG815 | 32814_c1_2 | 4404 | 18507 | 777 | 259 | YNR047W | 549 | 1.8(10)-52 | Saccharomyces cerevisiae | [ui:ynr047w] [pn:similarity to microtubule-associated ser/thr protein kinases:probable serine/threonine-protein kinase ynr047w] [gn:n3449] [gtcfc:8.5.9.4|12.13|14.3] [ec:2.7.1.-] [keggfc:8.5.9.4] [sgdfc:15.0.0|13.0.0] [db:gtc-saccharo |
| CONTIG702 | 11932293_c3_4 | 4405 | 18508 | 945 | 315 | YGR231W | 714 | 1.3(10)-70 | Saccharomyces cerevisiae | [ui:ygr231w] [pn:ser/thr protein kinase:protein kinase mkk1/ssp32] [gn:mkk1|ssp32|o5095] [gtcfc:8.5.9.4|12.13|12.8|13.2] [ec:2.7.1.-] [keggfc:8.5.9.4] [sgdfc:3.1.0:3.2.0:3.8.0|10.2.5|11.1.0.15.0.0] [db:gtc-saccharomyces cerevisiae] |
| CONTIG3739 | 22861312_c3_2 | 4406 | 18509 | 951 | 317 | YOR233W | 220 | 4.4(10)-17 | Saccharomyces cerevisiae | [ui:yor233w] [pn:ser/thr protein kinase:serine/threonine-protein kinase kin4] [gn:kin4|kin31|kin3|o5220] [gtcfc:8.5.9.4|12.13|14.3] [ec:2.7.1.-] [keggfc:8.5.9.4] [sgdfc:15.0.0|13.0.0] [db:gtc-saccharomyces cerevisiae] |
| CONTIG5788 | 20348300_c2_22 | 4407 | 18510 | 294 | 98 | YOR351C | 97 | 0.00034 | Saccharomyces cerevisiae | [ui:yor351c] [pn:ser/thr protein kinase:protein kinase mek1/mre4] [gn:mek1|mre4|o6357] [gtcfc:8.5.9.4|10.1|10.2|10.8|12.13.12.8] [ec:2.7.1.-] [keggfc:8.5.9.4] [sgdfc:3.5.0:3.7.0|9.5.0|15.0.0] [db:gtc-saccharomyces cerevisiae] |
| CONTIG5788 | 24882806_c1_14 | 4408 | 18511 | 489 | 163 | YOR351C | 412 | 1.3(10)-38 | Saccharomyces cerevisiae | [ui:yor351c] [pn:ser/thr protein kinase:protein kinase mek1/mre4] [gn:mek1|mre4|o6357] [gtcfc:8.5.9.4|10.1|10.2|10.8|12.13.12.8] [ec:2.7.1.-] [keggfc:8.5.9.4] [sgdfc:3.5.0:3.7.0|9.5.0|15.0.0] [db:gtc-saccharomyces cerevisiae] |
| CONTIG5788 | 6734387_c3_26 | 4409 | 18512 | 807 | 269 | YOR351C | 169 | 2.0(10)-10 | Saccharomyces cerevisiae | [ui:yor351c] [pn:ser/thr protein kinase:protein kinase mek1/mre4] [gn:mek1|mre4|o6357] [gtcfc:8.5.9.4|10.1|10.2|10.8|12.13.12.8] [ec:2.7.1.-] [keggfc:8.5.9.4] [sgdfc:3.5.0:3.7.0|9.5.0|15.0.0] [db:gtc-saccharomyces cerevisiae] |
| CONTIG5171 | 23884758_f1_1 | 4410 | 18513 | 1533 | 511 | YPL209C | 447 | 1.3(10)-69 | Saccharomyces cerevisiae | [ui:ypl209c] [pn:ser/thr protein kinase:serine/threonine-protein kinase] [gn:ip11] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2810 | 897706_c1_3 | 4411 | 18514 | 879 | 293 | YPL204W | 1096 | 4.2(10)-111 | Saccharomyces cerevisiae | [gtcfc:8.5.9.4:12.13:12.8] [ec:2.7.1.-] [keggfc:8.5.9.4] [sgdfc:3.8.0:15.0.0] [db:gtc-saccharomyces cerevisiae] [ui:ypl204w] [pn:casein kinase ser/thr/tyr protein kinase:casein kinase i homolog] [gn:hrr25] [gtcfc:8.5.9.4:10.10:12.13:12.8] [ec:2.7.1.-] [keggfc:8.5.9.4] [sgdfc:3.5.0:11.2.1:15.0.0] [db:gtc-saccharomyces cerevisiae] |
| CONTIG4679 | 4729067_f3_3 | 4412 | 18515 | 1539 | 513 | YPL153C | 933 | 1.8(10)-114 | Saccharomyces cerevisiae | [ui:ypl153c] [pn:ser/thr/tyr protein kinase:protein kinase spk1:serine-protein kinase 1] [gn:spk1:sad1:rad53:mec2:p2588] [gtcfc:8.59.4:10.1:10.10:10.2:12.13:12.8] [ec:2.7.1.-] [keggfc:8.5:9.4:13.3] [sgdfc:3.8.0:9.5.0:11.2.1:15.0.0] |
| CONTIG5596 | 35551337_c2_15 | 4413 | 18516 | 450 | 150 | YPL153C | 172 | 6.2(10)-12 | Saccharomyces cerevisiae | [ui:ypl153c] [pn:ser/thr/tyr protein kinase:protein kinase spk1:serine-protein kinase 1] [gn:spk1:sad1:rads3:mec2:p2588] [gtcfc:8.5.9.4:10.1:10.10:10.2:12.13:12.8] [ec:2.7.1.-] [keggfc:8.5:9.4:13.3] [sgdfc:3.8.0:9.5.0:11.2.1:15.0.0] |
| CONTIG3883 | 25995694_c1_1 | 4414 | 18517 | 1380 | 460 | YPL042C | 958 | 1.0(10)-111 | Saccharomyces cerevisiae | [ui:ypl042c] [pn:cyclin-dependent ser/thr protein kinase:meiotic mrna stability protein kinase ume5] [gn:rume5:ssn3:srb10] [gtcfc:8.5.9.4:10.1:10.2:12.13:12.8] [ec:2.7.1.-] [keggfc:8.5.9.4] [sgdfc:1.5.2.3.5.0:48.2.9.5.0:15.0.0] [db:gt] |
| CONTIG1164 | 15628182_c3_2 | 4415 | 18518 | 696 | 232 | YPR054W | 560 | 2.7(10)-54 | Saccharomyces cerevisiae | [ui:ypr054w] [pn:sporulation-specific map kinase:sporulation-specific mitogen-activated protein kinase smk1:map kinase smk1] [gn:smk1:yp9499] [gtcfc:8.5.9.4:12.15] [ec:2.7.1.-] [keggfc:8.5:9.4] [sgdfc:3.4.0] [db:gtc-saccharomyces cere |
| CONTIG3688 | 2915632_c3_6 | 4416 | 18519 | 207 | 69 | YPR054W | 149 | 5.4(10)-10 | Saccharomyces cerevisiae | [ui:ypr054w] [pn:sporulation-specific map kinase:sporulation-specific mitogen-activated protein kinase smk1:map kinase smk1] [gn:smk1:yp9499] [gtcfc:8.5.9.4:12.15] [ec:2.7.1.-] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG472 | 1988425_c2_2 | 4417 | 18520 | 771 | 257 | YPR161C | 598 | 2.5(10)-58 | *Saccharomyces cerevisiae* | [keggfc:8.5.9.4] [sgdfc:3.4.0] [db:gtc-saccharomyces cere [ui:ypr161c] [pn:ser/thr protein kinase/serine/threonine protein kinase sgv1] [gn:sgv1:bur1:p9584] [gtcfc:8.5.9.4.12.13.12.8.12.9] [ec:2.7.1.-] [keggfc:8.5.9.4] [sgdfc:3.1.0:3.3.0:3.8.0:15.0.0] [db:gtc-saccharomyces cerevisiae] |
| CONTIG5063 | 12929650_f3_6 | 4418 | 18521 | 534 | 178 | YMR020W | 208 | 3.7(10)-16 | *Saccharomyces cerevisiae* | [ui:ymr020w] [pn:suppressor of fenpropimorph resistance mutation fen2:fms1 protein] [gn:fms1:ym9711] [gtcfc:8.5] [keggfc:14.2] [sgdfc:1.6.6] [db-gtc-saccharomyces cerevisiae] |
| CONTIG5063 | 25947078_f1_2 | 4419 | 18522 | 969 | 323 | YMR020W | 278 | 1.7(10)-43 | *Saccharomyces cerevisiae* | [ui:ymr020w] [pn:suppressor of fenpropimorph resistance mutation fen2:fms1 protein] [gn:fms1:ym9711] [gtcfc:8.5] [keggfc:14.2] [sgdfc:1.6.6] [db-gtc-saccharomyces cerevisiae] |
| CONTIG2063 | 4818878_f3_1 | 4420 | 18523 | 795 | 265 | YDR302W | 101 | 0.00119 | *Saccharomyces cerevisiae* | [ui:ydr302w] [pn:weak similarity to human gpi-anchor biosynthesis protein] [gtcfc:8.5:10.7] [keggfc:14.2] [sgdfc:1.6.7] [db-gtc-saccharomyces cerevisiae] |
| CONTIG5769 | 5188452_f2_7 | 4421 | 18524 | 882 | 294 | YMR079W | 988 | 1.2(10)-99 | *Saccharomyces cerevisiae* | [ui:ymr079w] [pn:phosphatidylinositol:pi/phosph atidylcholine:pc transfer protein:sec14 cytosolic factor:phosphatidylinositol/phosph atidylcholine transfer protein:pi/pc tp] [gn:sec14:pi1:ym9582] [gtcfc:8.5.10.7:12.10] [keggfc:14.2] [s |
| CONTIG3457 | 4301301_c3_16 | 4422 | 18525 | 657 | 219 | YNL264C | 334 | 2.3(10)-30 | *Saccharomyces cerevisiae* | [ui:ynl264c] [pn:similarity to sec14p:hypothetical 40.7 kd protein in plk1-pol2 intergenic region] [gn:n0815] [gtcfc:8.5:10.7] [keggfc:14.2] [sgdfc:1.6.7] [db-gtc-saccharomyces cerevisiae] |
| CONTIG5475 | 10203282_f3_6 | 4423 | 18526 | 1137 | 379 | YNL264C | 725 | 8.9(10)-72 | *Saccharomyces cerevisiae* | [ui:ynl264c] [pn:hypothetical 40.7 kd protein in plk1-pol2 intergenic region] [gn:n0815] [gtcfc:8.5:10.7] [keggfc:14.2] [sgdfc:1.6.7] [db-gtc-saccharomyces cerevisiae] |
| CONTIG632 | 3913312_f1_1 | 4424 | 18527 | 225 | 75 | YNL264C | 139 | 5.4(10)-9 | *Saccharomyces cerevisiae* | [ui:ynl264c] [pn:similarity to sec14p:hypothetical 40.7 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2447 | 35440936_c1_3 | 4425 | 18528 | 708 | 236 | YDL205C | 739 | 2.8(10)-73 | Saccharomyces cerevisiae | protein in pik1-pol2 intergenic region] [gn:n0815] [gtcfc:8.5:10.7] [keggfc:14.2] [sgdfc:1.6.7] [dbgtc-saccharomyces cerevisiae] [ui:ydl205c] [pn:porphobilinogen deaminase:pbg:hydroxymethylbilane synthase:hmbs:pre-uroporphyrinogen synthase] [gn:hem3:d1057] [gtcfc:9.10:9.11] [ec:4.3.1.8] [keggfc:9.10] [sgdfc:1.7.1.9.2.0] [dbgtc-saccharomyces cerevisiae] |
| CONTIG5411 | 191311_c2_10 | 4426 | 18529 | 1047 | 349 | YDR044W | 1205 | 1.2(10)-122 | Saccharomyces cerevisiae | [ui:ydr044w] [pn:coproporphyrinogen iii oxidase:coproporphyrinogenase:coprogen oxidase] [gn:hem13:yd5112] [gtcfc:9.10:9.11] [ec:1.3.3.3] [keggfc:9.10] [sgdfc:1.7.1.9.2.0] [db:gtc-saccharomyces cerevisiae] |
| CONTIG3839 | 2556288_f1_1 | 4427 | 18530 | 1059 | 353 | YDR047W | 1277 | 2.7(10)-130 | Saccharomyces cerevisiae | [ui:ydr047w] [pn:uroporphyrinogen decarboxylase:upd] [gn:hem12:hem6:pop3:yd9609] [gtcfc:9.10:9.11] [ec:4.1.1.37] [keggfc:9.10] [sgdfc:1.7.1.9.2.0] [db:gtc-saccharomyces cerevisiae] |
| CONTIG3082 | 10995167_c3_11 | 4428 | 18531 | 744 | 248 | YGL040C | 793 | 5.5(10)-79 | Saccharomyces cerevisiae | [ui:ygl040c] [pn:delta-aminolevulinic acid dehydratase:porphobilinogen synthase:aladh] [gn:hem2] [gtcfc:9.10:9.11] [ec:4.2.1.24] [keggfc:9.10] [sgdfc:1.7.1.9.2.0] [db:gtc-saccharomyces cerevisiae] |
| CONTIG3082 | 36351513_c2_7 | 4429 | 18532 | 513 | 171 | YGL040C | 469 | 1.2(10)-44 | Saccharomyces cerevisiae | [ui:yg1040c] [pn:delta-aminolevulinic acid dehydratase:porphobilinogen synthase:aladh] [gn:hem2] [gtcfc:9.10:9.11] [ec:4.2.1.24] [keggfc:9.10] [sgdfc:1.7.1.9.2.0] [db:gtc-saccharomyces cerevisiae] |
| CONTIG5819 | 163930_c1_35 | 4430 | 18533 | 1839 | 613 | YKR069W | 814 | 1.3(10)-111 | Saccharomyces cerevisiae | [ui:ykr069w] [pn:siroheme synthase:probable uroporphyrin-iii c-methyltransferase:urogen iii methylase:sumt:uroporphyrinogen iii methylase:urom] [gn:met1] [gtcfc:9.10:9.11] [ec:2.1.107] [keggfc:9.10] [sgdfc:1.7.1] [dbgtc-saccharomyc |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5455 | 22344025_c1_7 | 4431 | 18534 | 630 | 210 | YOR278W | 364 | 1.6(10)-33 | *Saccharomyces cerevisiae* | [ui:yor278w] [pn:uroporphyrinogen iii synthase:urosuroporphyrinogen-iii cosynthetase:hydroxymethylbilane hydrolyase:cyclizing:uroiiis] [gn:hem4:orfl:o5463] [gtcfc:9.10:9.11] [ec:4.2.1.75] [keggfc:9.10] [ |
| CONTIG5706 | 13673313_c2_21 | 4432 | 18535 | 1092 | 364 | YBL033C | 619 | 1.5(10)-60 | *Saccharomyces cerevisiae* | [ui:ybl033c] [pn:gtp cyclohydrolase ii] [gn:rib1:ybl0417] [gtcfc:9.10:9.11:9.2] [ec:3.5.4.25] [keggfc:9.2] [sgdfc:1.7.1] [db:gtc-saccharomyces cerevisiae] |
| CONTIG5647 | 14238805_c2_19 | 4433 | 18536 | 882 | 294 | YBR035C | 648 | 1.3(10)-63 | *Saccharomyces cerevisiae* | [ui:ybr035c] [pn:pyridoxamine-phosphate oxidase:pyridoxamine 5''-phosphate oxidase:pnp/pmp oxidase] [gn:pdx3:ybr0321] [gtcfc:9.10:9.11:9.3] [ec:1.4.3.5] [keggfc:9.3] [sgdfc:1.7.1] [db:gtc-saccharomyces cerevisiae] |
| CONTIG835 | 31673958_f2_1 | 4434 | 18537 | 771 | 257 | YBR035C | 696 | 1.1(10)-68 | *Saccharomyces cerevisiae* | [ui:ybr035c] [pn:pyridoxamine-phosphate oxidase:pyridoxamine 5''-phosphate oxidase:pnp/pmp oxidase] [gn:pdx3:ybr0321] [gtcfc:9.10:9.11:9.3] [ec:1.4.3.5] [keggfc:9.3] [sgdfc:1.7.1] [db:gtc-saccharomyces cerevisiae] |
| CONTIG3539 | 869037_f1_2 | 4435 | 18538 | 309 | 103 | YBR153W | 238 | 3.6(10)-20 | *Saccharomyces cerevisiae* | [ui:ybr153w] [pn:htp reductase] [gn:rib7:ybr1203] [gtcfc:9.10:9.11] [keggfc:14.2] [sgdfc:1.7.1] [db:gtc-saccharomyces cerevisiae] |
| CONTIG4859 | 4973762_f2_4 | 4436 | 18539 | 279 | 93 | YBR176W | 163 | 8.6(10)-12 | *Saccharomyces cerevisiae* | [ui:ybr176w] [pn:strong similarity to e. coli 3-methyl-2-oxobutanoate hydroxymethyltransferase:putative 3-methyl-2-oxobutanoate hydroxymethyltransferase:ketopantoate hydroxymethyltransferase] [gn:ybr1238] |
| CONTIG5523 | 2003502_c1_16 | 4437 | 18540 | 855 | 285 | YBR256C | 701 | 3.1(10)-69 | *Saccharomyces cerevisiae* | [gtcfc:9.10:9.11:9.5.9.6] [ec: [ui:ybr256c] [pn:riboflavin synthase, alpha chain:riboflavin synthase alpha chain] [gn:rib5:ybr1724] [gtcfc:9.10:9.11:9.2] [ec:2.5.1.9] [keggfc:9.2] [sgdfc:1.7.1] [db:gtc-saccharomyces cerevisiae] |
| CONTIG4978 | 23486660_c2_10 | 4438 | 18541 | 657 | 219 | YDL045C | 363 | 2.0(10)-33 | *Saccharomyces cerevisiae* | [ui:ydl045c] [pn:flavin adenine |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | dinucleotide:fad synthetase:fmn adenylyltransferase:fad pyrophosphorylase:flavin adenine dinucleotide snythetase] [gn:fad1:d2702] [gtcfc:9.10:9.11:9.2] [ec:2.7.7.2] [keggfc:9.2] [sgdfc:1.7.1:9.2.0] [db: |
| CONTIG5735 | 485306_c1_14 | 4439 | 18542 | 360 | 120 | YDR487C | 296 | 2.6(10)-26 | Saccharomyces cerevisiae | [ui:ydr487c] [pn:3,4-dihydroxy-2-butanone 4-phosphate synthase] [gn:rib3] [gtcfc:9.10:9.11] [keggfc:14.2] [sgdfc:1.7.1] [db-gtc-saccharomyces cerevisiae] |
| CONTIG5120 | 3945937_c1_4 | 4440 | 18543 | 912 | 304 | YFR047C | 1008 | 9.0(10)-102 | Saccharomyces cerevisiae | [ui:yfr047c] [pn:similarity to human quinolinate phosphoribosyltransferase:putative nicotinate-nucleotide pyrophosphorylase:carboxylating:q uinolinate phosphoribosyltransferase:decarbo xylating:qaprtase] [gtcfc:9.10:9.11:9.4] [ec:2.4.2. |
| CONTIG5490 | 6140937_c1_9 | 4441 | 18544 | 1407 | 469 | YGL125W | 1322 | 4.7(10)-135 | Saccharomyces cerevisiae | [ui:ygl125w] [pn:similarity to human methylenetetrahydrofolate reductase:hypothetical 68.5 kd protein in scs3-sup44 intergenic region] [gng2882] [gtcfc:10.7] [keggfc:14.2] [sgdfc:1.7.1] [db-gtc-saccharomyces cerevisiae] |
| CONTIG5728 | 15675637_c2_20 | 4442 | 18545 | 1524 | 508 | YGR255C | 792 | 7.0(10)-79 | Saccharomyces cerevisiae | [ui:ygr255c] [pn:similarity to e. coli ubih and visc proteins:hypothetical 53.5 kd protein in enol-gnd2 intergenic region] [gn:g9165] [gtcfc:9.10:9.11] [keggfc:14.2] [sgdfc:1.7.1] [db-gtc-saccharomyces cerevisiae] |
| CONTIG5513 | 24004557_f3_9 | 4443 | 18546 | 330 | 110 | YGR267C | 117 | 6.0(10)-7 | Saccharomyces cerevisiae | [ui:ygr267c] [pn:gtp cyclohydrolase i:gtp-ch-i] [gn:fol2:g9349] [gtcfc:9.10:9.11:9.6] [ec:3.5.4.16] [keggfc:9.7] [sgdfc:1.7.1] [db:gtc-saccharomyces cerevisiae] |
| CONTIG5637 | 1070376_c3_25 | 4444 | 18547 | 498 | 166 | YGR267C | 653 | 3.7(10)-64 | Saccharomyces cerevisiae | [ui:ygr267c] [pn:gtp cyclohydrolase i:gtp-ch-i] [gn:fol2:g9349] [gtcfc:9.10:9.11:9.6] [ec:3.5.4.16] [keggfc:9.7] [sgdfc:1.7.1] [db:gtc-saccharomyces cerevisiae] |
| CONTIG5560 | 4415700_f3_6 | 4445 | 18548 | 1263 | 421 | YGR286C | 1193 | 2.2(10)-121 | Saccharomyces | [ui:ygr286c] [pn:biotin synthetase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | [gn:bio2] [gtcfc:9.10:9.11:9.6] [ec:2.8.1.-] [keggfc:9.6] [sgdfc:1.7.1] [db:gtc-saccharomyces cerevisiae] |
| CONTIG5546 | 24275077_c2_17 | 4446 | 18549 | 372 | 124 | YHR042W | 300 | 8.1(10)-26 | Saccharomyces cerevisiae | [ui:yhr042w] [pn:nadph-cytochrome p450 reductase:cpr] [gn:ncp1:ncpr1:prd1] [gtcfc:9.10:9.11:9.13:12.12:12.16] [ec:1.6.2.4] [keggfc:9.12] [sgdfc:1.7.1:9.4.0:11.3.0] [db:gtc-saccharomyces cerevisiae] |
| CONTIG5546 | 25782638_c1_14 | 4447 | 18550 | 1713 | 571 | YHR042W | 1229 | 3.5(10)-125 | Saccharomyces cerevisiae | [ui:yhr042w] [pn:nadph-cytochrome p450 reductase:cpr] [gn:ncp1:ncpr1:prd1] [gtcfc:9.10:9.11:9.13:12.12:12.16] [ec:1.6.2.4] [keggfc:9.12] [sgdfc:1.7.1:9.4.0:11.3.0] [db:gtc-saccharomyces cerevisiae] |
| CONTIG3135 | 36057828_f3_3 | 4448 | 18551 | 609 | 203 | YHR111W | 435 | 4.7(10)-41 | Saccharomyces cerevisiae | [ui:yhr111w] [pn:similarity to molybdopterin biosynthesis proteins:hypothetical 49.4 kd protein in cdc12-orc6 intergenic region] [gtcfc:9.10:9.11] [keggfc:14.2] [sgdfc:1.7.1] [db:gtc-saccharomyces cerevisiae] |
| CONTIG3468 | 4335825_f3_5 | 4449 | 18552 | 402 | 134 | YHR111W | 282 | 1.3(10)-24 | Saccharomyces cerevisiae | [ui:yhr111w] [pn:similarity to molybdopterin biosynthesis proteins:hypothetical 49.4 kd protein in cdc12-orc6 intergenic region] [gtcfc:9.10:9.11] [keggfc:14.2] [sgdfc:1.7.1] [db:gtc-saccharomyces cerevisiae] |
| CONTIG4532 | 4162762_c2_8 | 4450 | 18553 | 255 | 85 | YJR142W | 248 | 3.1(10)-21 | Saccharomyces cerevisiae | [ui:yjr142w] [pn:similarity to thiamin pyrophosphokinase:hypothetical 39.7 kd protein in hom6-pmt4 intergenic region] [gn:j2171] [gtcfc:9.10:9.11] [keggfc:14.2] [db:gtc-saccharomyces cerevisiae] [sgdfc:1.7.1] |
| CONTIG2848 | 29394562_f2_2 | 4451 | 18554 | 894 | 298 | YKL027W | 970 | 9.6(10)-98 | Saccharomyces cerevisiae | [ui:ykl027w] [pn:similarity to e. coli molybdopterin-converting factor chln:hypothetical 50.3 kd protein in tfal-pan3 intergenic region] [gtcfc:9.10:9.11] [keggfc:14.2] [sgdfc:1.7.1] [db:gtc-saccharomyces cerevisiae] |
| CONTIG2513 | 21964455_f3_1 | 4452 | 18555 | 1329 | 443 | YMR113W | 669 | 7.5(10)-66 | Saccharomyces cerevisiae | [ui:ymr113w] [pn:similarity to folylpolyglutamate synthetases and |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3763 | 27050781_c3_5 | 4453 | 18556 | 951 | 317 | YNL256W | 521 | 1.7(10)-49 | Saccharomyces cerevisiae | strong similarity to hypothetical protein ykl132c] [gtcfc:9.10:9.11] [keggfc:14.2] [sgdfc:1.7.1] [db:gtc-saccharomyces cerevisiae] [ui:ynl256w] [pn:similarity to bacterial dihydropteroate synthase:probable folic acid synthesis protein:contains:dihydropteroate synthase:dhps:dihydropteroate pyrophosphorylase:2-amino-4-hydroxy-6-hydroxymethyldihydropteridine pyropho |
| CONTIG5793 | 20098165_c2_23 | 4454 | 18557 | 1752 | 584 | YNL256W | 718 | 4.9(10)-71 | Saccharomyces cerevisiae | [ui:ynl256w] [pn:similarity to bacterial dihydropteroate synthase:probable folic acid synthesis protein:contains:dihydropteroate synthase:dhps:dihydropteroate pyrophosphorylase:2-amino-4-hydroxy-6-hydroxymethyldihydropteridine pyropho |
| CONTIG4540 | 4897188_c1_6 | 4455 | 18558 | 648 | 216 | YNR057C | 412 | 1.3(10)-38 | Saccharomyces cerevisiae | [ui:ynr057c] [pn:putative dethiobiotin synthetase:dethiobiotin synthetase:dtb snythetase:dtbs] [gn:bio4:n3506] [gtcfc:9.10:9.11:9.6] [ec:6.3.3.3] [keggfc:9.6] [sgdfc:1.7.1] [db:gtc-saccharomyces cerevisiae] |
| CONTIG3721 | 21881311_f2_2 | 4456 | 18559 | 453 | 151 | YOL151W | 317 | 1.5(10)-28 | Saccharomyces cerevisiae | [ui:yol151w] [pn:similarity to plant dihydroflavonol-4-reductases] [gtcfc:9.10:9.11] [keggfc:14.2] [sgdfc:1.7.1] [db:gtc-saccharomyces cerevisiae] |
| CONTIG3787 | 21876287_c2_6 | 4457 | 18560 | 1041 | 347 | YOL151W | 549 | 4.0(10)-53 | Saccharomyces cerevisiae | [ui:yol151w] [pn:similarity to plant dihydroflavonol-4-reductases] [gtcfc:9.10:9.11] [keggfc:14.2] [sgdfc:1.7.1] [db:gtc-saccharomyces cerevisiae] |
| CONTIG3950 | 23610936_f3_2 | 4458 | 18561 | 804 | 268 | YOL151W | 521 | 3.7(10)-50 | Saccharomyces cerevisiae | [ui:yol151w] [pn:similarity to plant dihydroflavonol-4-reductases] [gtcfc:9.10:9.11] [keggfc:14.2] [sgdfc:1.7.1] [db:gtc-saccharomyces cerevisiae] |
| CONTIG5221 | 24414136_f2_10 | 4459 | 18562 | 453 | 151 | YOL151W | 255 | 5.7(10)-22 | Saccharomyces cerevisiae | [ui:yol151w] [pn:similarity to plant |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5494 | 24064437_f3_7 | 4460 | 18563 | 189 | 63 | YOL151W | 105 | 2.7(10)-5 | Saccharomyces cerevisiae | dihydroflavonol-4-reductases [gtcfc:9.10:9.11] [keggfc:14.2] [sgdfc:1.7.1] [db:gtc-saccharomyces cerevisiae] |
| CONTIG5568 | 24406555_c1_13 | 4461 | 18564 | 1059 | 353 | YOL151W | 806 | 2.2(10)-80 | Saccharomyces cerevisiae | [ui:yol151w] [pn:similarity to plant dihydroflavonol-4-reductases [gtcfc:9.10:9.11] [keggfc:14.2] [sgdfc:1.7.1] [db:gtc-saccharomyces cerevisiae] |
| CONTIG5664 | 26250632_c3_22 | 4462 | 18565 | 645 | 215 | YOL151W | 385 | 9.5(10)-36 | Saccharomyces cerevisiae | [ui:yol151w] [pn:similarity to plant dihydroflavonol-4-reductases [gtcfc:9.10:9.11] [keggfc:14.2] [sgdfc:1.7.1] [db:gtc-saccharomyces cerevisiae] |
| CONTIG5708 | 2525201_c1_18 | 4463 | 18566 | 633 | 211 | YOL151W | 301 | 7.5(10)-27 | Saccharomyces cerevisiae | [ui:yol151w] [pn:similarity to plant dihydroflavonol-4-reductases [gtcfc:9.10:9.11] [keggfc:14.2] [sgdfc:1.7.1] [db:gtc-saccharomyces cerevisiae] |
| CONTIG2992 | 32070305_c3_6 | 4464 | 18567 | 549 | 183 | YOL143C | 581 | 1.6(10)-56 | Saccharomyces cerevisiae | [ui:yol143c][[pn:6,7-dimethyl-8-ribityllumazine synthase:dmrl synthase:lumazine synthase:riboflavin synthase beta chain] [gn:rib4] [gtcfc:9.10:9.2] [ec:2.5.1.9] [keggfc:9.2] [sgdfc:1.7.1] [db:gtc-saccharomyces cerevisiae] |
| CONTIG1475 | 20506952_c3_3 | 4465 | 18568 | 663 | 221 | YOL066C | 359 | 1.7(10)-32 | Saccharomyces cerevisiae | [ui:yol066c] [pn:drap deaminase] [gn:rib2] [gtcfc:9.10:9.11] [keggfc:14.2] [sgdfc:1.7.1] [db:gtc-saccharomyces cerevisiae] |
| CONTIG2804 | 5892535_f3_3 | 4466 | 18569 | 1275 | 425 | YOL066C | 1015 | 1.7(10)-102 | Saccharomyces cerevisiae | [ui:yol066c] [pn:drap deaminase] [gn:rib2] [gtcfc:9.10:9.11] [keggfc:14.2] [sgdfc:1.7.1] [db:gtc-saccharomyces cerevisiae] |
| CONTIG873 | 20506952_f2_1 | 4467 | 18570 | 624 | 208 | YOL066C | 359 | 1.7(10)-32 | Saccharomyces cerevisiae | [ui:yol066c] [pn:drap deaminase] [gn:rib2] [gtcfc:9.10:9.11] [keggfc:14.2] [sgdfc:1.7.1] [db:gtc-saccharomyces cerevisiae] |
| CONTIG5165 | 26440792_c1_10 | 4468 | 18571 | 336 | 112 | YOL049W | 298 | 4.0(10)-26 | Saccharomyces cerevisiae | [ui:yol049w] [pn:strong similarity to s. pombe gsa1 protein] [gtcfc:9.10:9.11] [keggfc:14.2] [sgdfc:1.7.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5165 | 11189587_c3_17 | 4469 | 18572 | 441 | 147 | YOL049W | 294 | 1.2(10)-25 | Saccharomyces cerevisiae | [ui:yol049w] [pn:strong similarity to s. pombe gsa1 protein] [gtcfc:9.10:9.11] [keggfc:14.2] [sgdfc:1.7.1] [db:gtc-saccharomyces cerevisiae] |
| CONTIG3711 | 892056_f1_2 | 4470 | 18573 | 456 | 152 | YOL049W | 284 | 1.5(10)-24 | Saccharomyces cerevisiae | [ui:yol049w] [pn:strong similarity to s. pombe gsa1 protein] [gtcfc:9.10:9.11] [keggfc:14.2] [sgdfc:1.7.1] [db:gtc-saccharomyces cerevisiae] |
| CONTIG2084 | 12612755_c2_5 | 4471 | 18574 | 717 | 239 | YOR143C | 318 | 1.2(10)-28 | Saccharomyces cerevisiae | [ui:yor143c] [pn:thiamin pyrophosphokinase:tpk:thiamin kinase] [gn:thi80:yor3373c] [gtcfc:9.10:9.1:9.11] [ec:2.7.6.2] [keggfc:9.1] [sgdfc:1.7.1] [db:gtc-saccharomyces cerevisiae] |
| CONTIG3157 | 21891955_c2_5 | 4472 | 18575 | 300 | 100 | YOR143C | 148 | 4.4(10)-10 | Saccharomyces cerevisiae | [ui:yor143c] [pn:thiamin pyrophosphokinase:tpk:thiamin kinase] [gn:thi80:yor3373c] [gtcfc:9.10:9.1:9.11] [ec:2.7.6.2] [keggfc:9.1] [sgdfc:1.7.1] [db:gtc-saccharomyces cerevisiae] |
| CONTIG2709 | 22550026_f1_1 | 4473 | 18576 | 1011 | 337 | YOR209C | 946 | 3.3(10)-95 | Saccharomyces cerevisiae | [ui:yor209c] [pn:nicotinate phosphoribosyltransferase:probable nicotinate phosphoribosyltransferase:naprtase] [gn:npt1] [gtcfc:9.10:9.11.9.4] [ec:2.4.2.11] [keggfc:9.4] [sgdfc:1.7.1] [db:gtc-saccharomyces cerevisiae] |
| CONTIG4348 | 22437775_f1_1 | 4474 | 18577 | 1557 | 519 | YOR241W | 1257 | 3.7(10)-128 | Saccharomyces cerevisiae | [ui:yor241w] [pn:similarity to tetrahydrofolylpolyglutamate synthase] [gtcfc:9.10:9.11] [keggfc:14.2] [sgdfc:1.7.1] [db:gtc-saccharomyces cerevisiae] |
| CONTIG1422 | 119015_f3_1 | 4475 | 18578 | 525 | 175 | YPL214C | 390 | 2.7(10)-36 | Saccharomyces cerevisiae | [ui:ypl214c] [pn:thiamin-phosphate pyrophosphorylase and hydroxyethylthiazole kinase:thiamin biosynthetic bifunctional enzyme:contains:thiamin-phosphate pyrophosphorylase:tmp pyrophosphorylase:tmp-ppase/ hydroxyethylthiazole kinase:4 |
| CONTIG5317 | 20601527_c3_15 | 4476 | 18579 | 1095 | 365 | YPL023C | 842 | 3.5(10)-84 | Saccharomyces cerevisiae | [ui:ypl023c] [pn:similarity to human methylenetetrahydrofolate reductase:putative methylenetetrahydrofolate reductase] [gn:lpb8c] [gtcfc:10.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5798 | 26689001_f1_1 | 4477 | 18580 | 822 | 274 | YIR008C | 732 | 1.6(10)-72 | *Saccharomyces cerevisiae* | [ec:1.5.1.20] [keggfc:14.1] [sgdfc:17.1] [dbgtc-*saccharomyces cerevisiae*] [ui:yir008c] [pn:dna-directed dna polymerase alpha 48 kda subunit:dna primase:dna primase small chain:p48] [gn:pri1:yib8c] [gtcfc:9.12:10.1:10.2:10.8] [ec:2.7.7.-] [keggfc:9.13] [sgdfc:3.6.0:9.5.0] [dbgtc-*saccharomyces cerevisiae*] |
| CONTIG5798 | 24801275_f2_10 | 4478 | 18581 | 636 | 212 | YIR008C | 250 | 4.0(10)-21 | *Saccharomyces cerevisiae* | [ui:yir008c] [pn:dna-directed dna polymerase alpha 48 kda subunit:dna primase:dna primase small chain:p48] [gn:pri1:yib8c] [gtcfc:9.12:10.1:10.2:10.8] [ec:2.7.7.-] [keggfc:9.13] [sgdfc:3.6.0:9.5.0] [dbgtc-*saccharomyces cerevisiae*] |
| CONTIG1903 | 31423252_f3_1 | 4479 | 18582 | 1110 | 370 | YKL045W | 756 | 4.5(10)-75 | *Saccharomyces cerevisiae* | [ui:ykl045w] [pn:dna-directed dna polymerase alpha, 58 kd subunit:dna primase:dna primase large chain:p58] [gn:pri2:ykl258] [gtcfc:9.12:10.1:10.2:10.8] [ec:2.7.7.-] [keggfc:9.13] [sgdfc:3.6.0:9.5.0] [dbgtc-*saccharomyces cerevisiae*] |
| CONTIG4654 | 978541_c2_9 | 4480 | 18583 | 660 | 220 | YKL045W | 373 | 1.8(10)-34 | *Saccharomyces cerevisiae* | [ui:ykl045w] [pn:dna-directed dna polymerase alpha, 58 kd subunit:dna primase:dna primase large chain:p58] [gn:pri2:ykl258] [gtcfc:9.12:10.1:10.2:10.8] [ec:2.7.7.-] [keggfc:9.13] [sgdfc:3.6.0:9.5.0] [dbgtc-*saccharomyces cerevisiae*] |
| CONTIG5809 | 32680300_c2_24 | 4481 | 18584 | 783 | 261 | YOR346W | 107 | 0.006 | *Saccharomyces cerevisiae* | [ui:yor346w] [pn:dna repair protein rev1] [gn:rev1:o6339] [gtcfc:9.12:10.10] [ec:2.7.7.-] [keggfc:9.13] [sgdfc:11.2.1] [dbgtc-*saccharomyces cerevisiae*] |
| CONTIG5809 | 2910900_c2_23 | 4482 | 18585 | 2583 | 861 | YOR346W | 737 | 4.2(10)-100 | *Saccharomyces cerevisiae* | [ui:yor346w] [pn:dna repair protein:dna repair protein rev] [gn:rev1:o6339] [gtcfc:9.12:10.10] [ec:2.7.7.-] [keggfc:9.13] [sgdfc:11.2.1] [dbgtc-*saccharomyces cerevisiae*] |
| CONTIG5342 | 15400660_f3_11 | 4483 | 18586 | 1545 | 515 | YDL141W | 712 | 2.1(10)-70 | *Saccharomyces cerevisiae* | [ui:ydl141w] [pn:biotin holocarboxylase synthetase:biotin-- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5342 | 20901412_f2_8 | 4484 | 18587 | 546 | 182 | YDL141W | 295 | 2.7(10)-25 | Saccharomyces cerevisiae | protein ligase:biotin apo-protein ligase:biotin--][gn:bpl1:acc2:d2140][gtcfc:9.12:9.6:10.7][keggfc:9.6][sgdfc:1.7.2:6.3.0][db:gtc-saccharomyces cerevisiae] [ui:ydl141w][pn:biotin holocarboxylase synthetase:biotin--protein ligase:biotin apo-protein ligase:biotin--][gn:bpl1:acc2:d2140][gtcfc:9.12:9.6:10.7][keggfc:9.6][sgdfc:1.7.2:6.3.0][db:gtc-saccharomyces cerevisiae] |
| CONTIG5148 | 2145453_c1_5 | 4485 | 18588 | 1329 | 443 | YAR071W | 935 | 5.0(10)-94 | Saccharomyces cerevisiae | [ui:yar071w][pn:secreted acid phosphatase:acid phosphatase precursor:p56][gn:pho11][gtcfc:9.13:9.2:13.10][ec:3.1.3.2][keggfc:9.2:9.12][sgdfc:1.4.1][db:gtc-saccharomyces cerevisiae] |
| CONTIG4439 | 20023552_c3_10 | 4486 | 18589 | 1494 | 498 | YAR071W | 1016 | 1.3(10)-102 | Saccharomyces cerevisiae | [ui:yar071w][pn:secreted acid phosphatase:acid phosphatase precursor:p56][gn:pho11][gtcfc:9.13:9.2:13.10][ec:3.1.3.2][keggfc:9.2:9.12][sgdfc:1.4.1][db:gtc-saccharomyces cerevisiae] |
| CONTIG4782 | 29588513_f2_2 | 4487 | 18590 | 1215 | 405 | YAR071W | 969 | 1.2(10)-97 | Saccharomyces cerevisiae | [ui:yar071w][pn:secreted acid phosphatase:acid phosphatase precursor:p56][gn:pho11][gtcfc:9.13:9.2:13.10][ec:3.1.3.2][keggfc:9.2:9.12][sgdfc:1.4.1][db:gtc-saccharomyces cerevisiae] |
| CONTIG5080 | 23626501_c3_16 | 4488 | 18591 | 1065 | 355 | YDR541C | 530 | 4.0(10)-51 | Saccharomyces cerevisiae | [ui:ydr541c][pn:similarity to dihydroflavonol-4-reductases][gtcfc:9.13][keggfc:14.2][sgdfc:1.7.5][db:gtc-saccharomyces cerevisiae] |
| CONTIG4287 | 30476526_f3_7 | 4489 | 18592 | 543 | 181 | YER183C | 152 | 4.7(10)-11 | Saccharomyces cerevisiae | [ui:yer183c][pn:similarity to human 5,10-methenyltetrahydrofolate synthetase:hypothetical 24.1 kd protein in isc10 3"region][gtcfc:10.7][keggfc:14.2][sgdfc:1.7.5][db:gtc-saccharomyces cerevisiae] |
| CONTIG2130 | 19062_c1_4 | 4490 | 18593 | 621 | 207 | YGL157W | 200 | 5.2(10)-25 | Saccharomyces cerevisiae | [ui:ygl157w][pn:similarity to v. vinifera dihydroflavonol 4-reductase:hypothetical 38.1 kd protein in rck1-ams1 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5595 | 4725438_c2_9 | 4491 | 18594 | 375 | 125 | YGL157W | 105 | 2.7(10)-5 | Saccharomyces cerevisiae | region] [gn:g1857] [gtcfc:9.13] [keggfc:14.2] [sgdfc:1.7.5] [db:gtc-saccharomyces cerevisiae] |
| CONTIG3659 | 20003802_f1_1 | 4492 | 18595 | 252 | 84 | YGL157W | 106 | 2.1(10)-5 | Saccharomyces cerevisiae | [ui:ygl157w] [pn:similarity to v. vinifera dihydroflavonol 4-reductase:hypothetical 38.1 kd protein in rck1-ams1 intergenic region] [gn:g1857] [gtcfc:9.13] [keggfc:14.2] [sgdfc:1.7.5] [db-gtc-saccharomyces cerevisiae] |
| CONTIG5521 | 10719657_c3_31 | 4493 | 18596 | 1083 | 361 | YGR144W | 781 | 1.0(10)-77 | Saccharomyces cerevisiae | [ui:ygr144w] [pn:thiamine-repressed protein:mol1 protein] [gn:mol1:resp35:thi4:g6620] [gtcfc:9.13:13.2] [keggfc:14.2] [sgdfc:1.7.5:11.1.0] [db:gtc-saccharomyces cerevisiae] |
| CONTIG1078 | 4885950_c3_3 | 4494 | 18597 | 738 | 246 | YDR039C | 873 | 1.8(10)-87 | Saccharomyces cerevisiae | [ui:ydr039c] [pn:p-type atpase involved in na+ efflux:sodium transport atpase 2] [gn:ena2:pmr2b] [gtcfc:12.5.9.6] [ec:3.6.1.-] [keggfc:9.7] [sgdfc:1.8.2:7.8.0] [db-gtc-saccharomyces cerevisiae] |
| CONTIG1948 | 15633052_f1_1 | 4495 | 18598 | 390 | 130 | YDR039C | 342 | 6.4(10)-30 | Saccharomyces cerevisiae | [ui:ydr039c] [pn:p-type atpase involved in na+ efflux:sodium transport atpase 2] [gn:ena2:pmr2b] [gtcfc:12.5.9.6] [ec:3.6.1.-] [keggfc:9.7] [sgdfc:1.8.2:7.8.0] [db-gtc-saccharomyces cerevisiae] |
| CONTIG4224 | 5119000_c2_5 | 4496 | 18599 | 927 | 309 | YDR039C | 695 | 6.0(10)-68 | Saccharomyces cerevisiae | [ui:ydr039c] [pn:p-type atpase involved in na+ efflux:sodium transport atpase 2] [gn:ena2:pmr2b] [gtcfc:12.5.9.6] [ec:3.6.1.-] [keggfc:9.7] [sgdfc:1.8.2:7.8.0] [db-gtc-saccharomyces cerevisiae] |
| CONTIG4224 | 4884385_c1_4 | 4497 | 18600 | 768 | 256 | YDR039C | 437 | 4.4(10)-40 | Saccharomyces cerevisiae | [ui:ydr039c] [pn:p-type atpase involved in na+ efflux:sodium transport atpase 2] [gn:ena2:pmr2b] [gtcfc:12.5.9.6] [ec:3.6.1.-] [keggfc:9.7] [sgdfc:1.8.2:7.8.0] [db-gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5529 | 25680192_c2_13 | 4498 | 18601 | 474 | 158 | YDR039C | 365 | 2.2(10)-32 | Saccharomyces cerevisiae | [sgdfc:1.8:2:7.8.0] [db:gtc-saccharomyces cerevisiae] [ui:ydr039c] [pn:p-type atpase involved in na+ efflux:sodium transport atpase 2] [gn:ena2:pmr2b] [gtcfc:12.5.9.6] [ec:3.6.1.-] [keggfc:9.7] [sgdfc:1.8:2:7.8.0] [db:gtc-saccharomyces cerevisiae] |
| CONTIG2005 | 16844757_f1_1 | 4499 | 18602 | 777 | 259 | YEL031W | 915 | 6.5(10)-92 | Saccharomyces cerevisiae | [ui:yel031w] [pn:p-type atpase:probable cation-transporting atpase yel031w] [gn:spf1] [gtcfc:12.5:9.6] [ec:3.6.1.-] [keggfc:9.7] [sgdfc:1.8:2:7.2.2:7.8.0] [db:gtc-saccharomyces cerevisiae] |
| CONTIG3972 | 4117930_c3_7 | 4500 | 18603 | 2061 | 687 | YEL031W | 2065 | 8.9(10)-214 | Saccharomyces cerevisiae | [ui:yel031w] [pn:p-type atpase:probable cation-transporting atpase yel031w] [gn:spf1] [gtcfc:12.5:9.6] [ec:3.6.1.-] [keggfc:9.7] [sgdfc:1.8:2:7.2.2:7.8.0] [db:gtc-saccharomyces cerevisiae] |
| CONTIG3972 | 10550012_c3_6 | 4501 | 18604 | 672 | 224 | YEL031W | 307 | 4.2(10)-26 | Saccharomyces cerevisiae | [ui:yel031w] [pn:p-type atpase:probable cation-transporting atpase yel031w] [gn:spf1] [gtcfc:12.5:9.6] [ec:3.6.1.-] [keggfc:9.7] [sgdfc:1.8:2:7.2.2:7.8.0] [db:gtc-saccharomyces cerevisiae] |
| CONTIG4721 | 14270187_f3_1 | 4502 | 18605 | 3039 | 1013 | YLR172C | 1797 | 2.2(10)-185 | Saccharomyces cerevisiae | [ui:yer172c] [pn:rna helicase-related protein:pre-mrna splicing helicase brr2] [gn:brr2:rss1:sygp-orf66] [gtcfc:9.6.10.1:10.2] [ec:3.6.1.-] [keggfc:9.7] [sgdfc:4.9.0:9.5.0] [db:gtc-saccharomyces cerevisiae] |
| CONTIG5651 | 10182681_f1_13 | 4503 | 18606 | 1635 | 545 | YER172C | 661 | 8.5(10)-69 | Saccharomyces cerevisiae | [ui:yer172c] [pn:rna helicase-related protein:pre-mrna splicing helicase brr2] [gn:brr2:rss1:sygp-orf66] [gtcfc:9.6.10.1:10.2] [ec:3.6.1.-] [keggfc:9.7] [sgdfc:4.9.0:9.5.0] [db:gtc-saccharomyces cerevisiae] |
| CONTIG2357 | 7292217_c1_4 | 4504 | 18607 | 1713 | 571 | YIL048W | 1688 | 8.0(10)-174 | Saccharomyces cerevisiae | [ui:yil048w] [pn:similarity to amino-phospholipids-atpase drs2p:probable cation-transporting atpase yil048w] [gtcfc:12.5.9.6] [ec:3.6.1.-] [keggfc:9.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3255 | 6285256_f2_2 | 4505 | 18608 | 819 | 273 | YIL048W | 892 | 1.8(10)-89 | *Saccharomyces cerevisiae* | [sgdfc:7.8.0] [db:gtc-saccharomyces cerevisiae] [ui:yil048w] [pn:similarity to amino-phospholipids-atpase drs2p:probable cation-transporting atpase yil048w] [gtcfc:12.5:9.6] [ec:3.6.1.-] [keggfc:9.7] [sgdfc:7.8.0] [db:gtc-saccharomyces cerevisiae] |
| CONTIG1626 | 2909662_f2_2 | 4506 | 18609 | 672 | 224 | YJL092W | 331 | 1.1(10)-28 | *Saccharomyces cerevisiae* | [ui:yjl092w] [pn:atp-dependent dna helicase:atp-dependent dna helicase srs2] [gn:srs2:radh:hpr5:j0913] [gtcfc:9.6:10.1:10.10:10.2] [ec:3.6.1.-] [keggfc:9.7] [sgdfc:9.5.0:11.2.1] [db:gtc-saccharomyces cerevisiae] |
| CONTIG3330 | 21726626_c2_3 | 4507 | 18610 | 1356 | 452 | YJL092W | 573 | 1.3(10)-54 | *Saccharomyces cerevisiae* | [ui:yjl092w] [pn:atp-dependent dna helicase:atp-dependent dna helicase srs2] [gn:srs2:radh:hpr5:j0913] [gtcfc:9.6:10.1:10.10:10.2] [ec:3.6.1.-] [keggfc:9.7] [sgdfc:9.5.0:11.2.1] [db:gtc-saccharomyces cerevisiae] |
| CONTIG3407 | 21697181_f3_3 | 4508 | 18611 | 3147 | 1049 | YAL051W | 157 | 2.7(10)-7 | *Saccharomyces cerevisiae* | [ui:yal051w] [pn:peroxisome proliferating transcription factor:putative 118.2 kd transcriptional regulatory protein in acs1-gcv3 intergenic region] [gn:oaf1:fun43] [gtcfc:10.1:10.2] [keggfc:14.2] [sgdfc:1.6.4:4.8.2:9.5.0] [db:gtc-sacc |
| CONTIG4406 | 4116551_f2_1 | 4509 | 18612 | 2079 | 693 | YAL051W | 134 | 4.5(10)-5 | *Saccharomyces cerevisiae* | [ui:yal051w] [pn:peroxisome proliferating transcription factor:putative 118.2 kd transcriptional regulatory protein in acs1-gcv3 intergenic region] [gn:oaf1:fun43] [gtcfc:10.1:10.2] [keggfc:14.2] [sgdfc:1.6.4:4.8.2:9.5.0] [db:gtc-sacc |
| CONTIG5212 | 488430_f3_11 | 4510 | 18613 | 735 | 245 | YAL025C | 675 | 1.8(10)-66 | *Saccharomyces cerevisiae* | [ui:yal025c] [pn:nuclear viral propagation protein:protein] [gn:mak16] [gtcfc:10.1:10.2:12.8] [keggfc:14.2] [sgdfc:3.8.0:9.5.0] [db:gtc-saccharomyces cerevisiae] |
| CONTIG1717 | 35439526_f2_2 | 4511 | 18614 | 1155 | 385 | YAL021C | 909 | 2.7(10)-91 | *Saccharomyces cerevisiae* | [ui:yal021c] [pn:transcriptional regulator:glucose-repressible alcohol dehydrogenase |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG620 | 9848317_f3_3 | 4512 | 18615 | 384 | 128 | YAL021C | 398 | 3.5(10)-36 | Saccharomyces cerevisiae | transcriptional effector:carbon catabolite repressor protein 4] [gn:ccr4:fun27] [gtcfc:10.1:10.2] [keggfc:14.2] [sgdfc:4.8.2:9.5.0] [db:gtc-saccharom [ui:yal021c] [pn:transcriptional regulator:glucose-repressible alcohol dehydrogenase transcriptional effector:carbon catabolite repressor protein 4] [gn:ccr4:fun27] [gtcfc:10.1:10.2] [keggfc:14.2] [sgdfc:4.8.2:9.5.0] [db:gtc-saccharom |
| CONTIG3958 | 164002_f3_5 | 4513 | 18616 | 390 | 130 | YAL019W | 364 | 3.0(10)-32 | Saccharomyces cerevisiae | [ui:yal019w] [pn:similarity to helicases of the snf2/rad54 family:hypothetical 128.5 kd helicase in ats1-tpd3 intergenic region] [gn:yal001:fun30] [gtcfc:10.1:10.10:10.2] [keggfc:14.2] [sgdfc:9.5.0:11.2.1] [db:gtc-saccharomyces cerevi |
| CONTIG4665 | 117805_c1_10 | 4514 | 18617 | 1326 | 442 | YAL019W | 94 | 0.41999 | Saccharomyces cerevisiae | [ui:yal019w] [pn:similarity to helicases of the snf2/rad54 family:hypothetical 128.5 kd helicase in ats1-tpd3 intergenic region] [gn:yal001:fun30] [gtcfc:10.1:10.10:10.2] [keggfc:14.2] [sgdfc:9.5.0:11.2.1] [db:gtc-saccharomyces cerevi |
| CONTIG676 | 986561_f3_1 | 4515 | 18618 | 1038 | 346 | YAL019W | 945 | 4.2(10)-95 | Saccharomyces cerevisiae | [ui:yal019w] [pn:similarity to helicases of the snf2/rad54 family:hypothetical 128.5 kd helicase in ats1-tpd3 intergenic region] [gn:yal001:fun30] [gtcfc:10.1:10310:10.2] [keggfc:14.2] [sgdfc:9.5.0:11.2.1] [db:gtc-saccharomyces cerevi |
| b3x12445.y | 10757692_c3_3 | 4516 | 18619 | 270 | 90 | YAL019W | 93 | 0.0025 | Saccharomyces cerevisiae | [ui:yal019w] [pn:similarity to helicases of the snf2/rad54 family:hypothetical 128.5 kd helicase in ats1-tpd3 intergenic region] [gn:yal001:fun30] [gtcfc:10.1:10.10:10.2] [keggfc:14.2] [sgdfc:9.5.0:11.2.1] [db:gtc-saccharomyces cerevi |
| CONTIG5393 | 24392825_c1_17 | 4517 | 18620 | 2040 | 680 | YAL001C | 316 | 1.7(10)-26 | Saccharomyces cerevisiae | [ui:yal001c] [pn:tfiiic:transcription initiation factor subunit, 138 kd:transcription factor tau 138 kd subunit:tfiiic 138 kd subunit] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5393 | 10657757_c3_19 | 4518 | 18621 | 2232 | 744 | YAL001C | 126 | 3.5(10)-16 | Saccharomyces cerevisiae | [ui:yal001c] [pn:tfiiic:transcription initiation factor subunit, 138 kd:transcription factor tau 138 kd subunit:tfiiic 138 kd subunit] [gn:tfc3:tsv115:fun24] [gtcfc:10.1:10.2:10.3] [keggfc:14.2] [sgdfc:4.1.0:4.4.0:9.5.0] [db:gtc-sacch |
| CONTIG5814 | 29491427_f2_13 | 4519 | 18622 | 1098 | 366 | YAR007C | 788 | 1.8(10)-78 | Saccharomyces cerevisiae | [ui:yar007c] [pn:dna replication factor a, 69 kd subunit:replication factor-a protein 1:rf-a:single-stranded dna-binding protein:dna binding protein buf2] [gn:rfa1:buf2:rpa1:fun3] [gtcfc:10.1:10.2:10.8:12.9] [keggfc:14.2] [sgdfc:3.3.0] |
| CONTIG5814 | 4806312_f3_26 | 4520 | 18623 | 303 | 101 | YAR007C | 139 | 1.3(10)-8 | Saccharomyces cerevisiae | [ui:yar007c] [pn:dna replication factor a, 69 kd subunit:replication factor-a protein 1:rf-a:single-stranded dna-binding protein:dna binding protein buf2] [gn:rfa1:buf2:rpa1:fun3] [gtcfc:10.1:10.2:10.8:12.9] [keggfc:14.2] [sgdfc:3.3.0] |
| CONTIG5814 | 26737503_f2_14 | 4521 | 18624 | 381 | 127 | YAR007C | 303 | 2.8(10)-26 | Saccharomyces cerevisiae | [ui:yar007c] [pn:dna replication factor a, 69 kd subunit:replication factor-a protein 1:rf-a:single-stranded dna-binding protein:dna binding protein buf2] [gn:rfa1:buf2:rpa1:fun3] [gtcfc:10.1:10.2:10.8:12.9] [keggfc:14.2] [sgdfc:3.3.0] |
| CONTIG5688 | 24242181_f3_13 | 4522 | 18625 | 1575 | 525 | YBL103C | 134 | 3.5(10)-6 | Saccharomyces cerevisiae | [ui:ybl103c] [pn:bhlh/zip transcription factor that regulates cit2 gene expression:retrograde regulation protein 3 [gn:rtg3:ybl0810] [gtcfc:10.1:10.2:12.13] [keggfc:14.2] [sgdfc:1.5.2:4.8.2:9.5.0] [db:gtc-saccharomyces cerevisiae] |
| CONTIG3479 | 4722510_f1_1 | 4523 | 18626 | 513 | 171 | YBL093C | 151 | 5.9(10)-11 | Saccharomyces cerevisiae | [ui:ybl093c] [pn:transcription factor:rox3 nuclear protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5561 | 19565875_c3_16 | 4524 | 18627 | 2646 | 882 | YBL084C | 698 | 6.0(10)-86 | Saccharomyces cerevisiae | [gn:rox3:ybl0837] [gtcfc:10.1:10.2:13.2] [keggfc:14.2] [sgdfc:4.8:2:9.50:11.1.0] [db:gtc-saccharomyces cerevisiae] [ui:ybl084c] [pn:subunit of anaphase-promoting complex:cyclosome:cell division control protein 27] [gn:cdc27:snb1:ybl0718] [gtcfc:10.1:10.11:10.2:12.16:12.8] [keggfc:14.2] |
| CONTIG1136 | 10962752_c3_3 | 4525 | 18628 | 735 | 245 | YBL079W | 227 | 1.8(10)-17 | Saccharomyces cerevisiae | [sgdfc:3.8:0:6.5.1:9.3:0:9.5.0] [db:gtc-sacchammyces cerevisi [ui:ybl079w] [pn:nuclear pore protein:nucleoporin nup170] [gn:nup170:ybl0725] [gtcfc:10.1:10.2:12.6] [keggfc:14.2] |
| CONTIG2309 | 2131950_f3_2 | 4526 | 18629 | 609 | 203 | YBL079W | 169 | 2.7(10)-11 | Saccharomyces cerevisiae | [sgdfc:8.1:0:9.5.0:17.0.0] [db:gtc-saccharomyces cerevisiae] [ui:ybl079w] [pn:nuclear pore protein:nucleoporin nup170] [gn:nup170:ybl0725] [gtcfc:10.1:10.2:12.6] [keggfc:14.2] |
| CONTIG2594 | 24422162_c1_3 | 4527 | 18630 | 612 | 204 | YBL079W | 328 | 3.2(10)-28 | Saccharomyces cerevisiae | [sgdfc:8.1:0:9.5.0:17.0.0] [db:gtc-saccharomyces cerevisiae] [ui:ybl079w] [pn:nuclear pore protein:nucleoporin nup170] [gn:nup170:ybl0725] [gtcfc:10.1:10.2:12.6] [keggfc:14.2] |
| CONTIG2791 | 23563513_f3_1 | 4528 | 18631 | 1230 | 410 | YBL063W | 683 | 1.3(10)-66 | Saccharomyces cerevisiae | [sgdfc:8.1:0:9.5.0:17.0.0] [db:gtc-saccharomyces cerevisiae] [ui:ybl063w] [pn:kinesin-related protein:kinesin-like protein kip1] [gn:kip1:cin9:ybl0504:ybl0521] [gtcfc:10.1:10.2:12.16:12.8] [keggfc:14.2] |
| CONTIG5586 | 12614033_c1_16 | 4529 | 18632 | 1692 | 564 | YBL063W | 402 | 2.5(10)-36 | Saccharomyces cerevisiae | [sgdfc:3.8:0:9.3.0:9.5.0] [db:gtc-saccharomyces cerevisiae] [ui:ybl063w] [pn:kinesin-related protein:kinesin-like protein kip1] [gn:kip1:cin9:ybl0504:ybl0521] [gtcfc:10.1:10.2:12.16:12.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4385 | 14876506_f2_4 | 4530 | 18633 | 462 | 154 | YBL035C | 110 | 6.5(10)-5 | Saccharomyces cerevisiae | [keggfc:14.2] [sgdfc:3.8.0:9.3.0:9.5.0] [db:gtc-saccharomyces cerevisiae] [ui:ybl035c] [pn:subunit of dna polymerase alpha-primase complex:dna polymerase alpha/primase associated subunit:p86 subunit] [gn:pol12:ybl0414] [gtcfc:10.1:10.2:10.8] [keggfc:14.2] [sgdfc:3.6.0:9.5.0] |
| CONTIG4737 | 203251_c3_5 | 4531 | 18634 | 1131 | 377 | YBL035C | 725 | 8.9(10)-72 | Saccharomyces cerevisiae | [db:gtc-saccharomyces cerevisiae] [ui:ybl035c] [pn:subunit of dna polymerase alpha-primase complex:dna polymerase alpha/primase associated subunit:p86 subunit] [gn:pol12:ybl0414] [gtcfc:10.1:10.2:10.8] [keggfc:14.2] [sgdfc:3.6.0:9.5.0] [db:gtc-saccharomyces cerevisiae] |
| CONTIG4470 | 23470317_c3_8 | 4532 | 18635 | 375 | 125 | YBL026W | 367 | 7.7(10)-34 | Saccharomyces cerevisiae | [ui:ybl026w] [pn:snrnp-related protein:hypothetical 11.2 kd protein in rpl19-mcm2 intergenic region] [gn:snp3:ybl0425] [gtcfc:10.1:10.2] [keggfc:14.2] [sgdfc:9.5.0] [db:gtc-saccharomyces cerevisiae] |
| CONTIG4772 | 14555312_f2_3 | 4533 | 18636 | 2061 | 687 | YBL024W | 1801 | 8.5(10)-186 | Saccharomyces cerevisiae | [ui:ybl024w] [pn:similarity to nucleolar nop2p:hypothetical 77.9 kd protein in rrn10-mcm2 intergenic region] [gn:ybl0437] [gtcfc:10.1:10.2] [keggfc:14.2] [sgdfc:9.5.0:13.0.0] [db:gtc-saccharomyces cerevisiae] |
| CONTIG4940 | 58532_f2_1 | 4534 | 18637 | 1635 | 545 | YBL023C | 1691 | 4.9(10)-218 | Saccharomyces cerevisiae | [ui:ybl023c] [pn:member of the mcm2p, mcm3p, cdc46p family:minichromosome maintenance protein 2] [gn:mcm2:ybl0438] [gtcfc:10.1:10.2:10.8:12.8] [keggfc:13.2] [sgdfc:3.6.0:9.5.0] [db:gtc-saccharomyces cerevisiae] |
| CONTIG1248 | 12209752_f2_1 | 4535 | 18638 | 660 | 220 | YBL021C | 303 | 4.5(10)-27 | Saccharomyces cerevisiae | [ui:ybl021c] [pn:ccaat-binding factor subunit:hap3 transcriptional activator:uas2 regulatory protein a] [gn:hap3:ybl0441] [gtcfc:10.1:10.2] [keggfc:14.2] [sgdfc:4.8.2:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5141 | 4104637_f2_1 | 4536 | 18639 | 330 | 110 | YBL021C | 413 | 1.0(10)-38 | *Saccharomyces cerevisiae* | *saccharomyces cerevisiae* [ui:ybl021c] [pn:ccaat-binding factor subunit:hap3 transcriptional activator:uas2 regulatroy protein a] [gn:hap3;ybl0441] [gtcfc:10.1:10.2] [keggfc:14.2] [sgdfc:4.8.3.9.5.0] [db:gtc-saccharomyces cerevisiae] |
| CONTIG2073 | 4772630_f2_1 | 4537 | 18640 | 1425 | 475 | YBL020W | 422 | 1.1(10)-39 | *Saccharomyces cerevisiae* | [ui:ybl020w] [pn:nuclear division protein:nuclear division rft1 protein] [gn:rft1;ybl0442] [gtcfc:10.1:10.2:12.8] [keggfc:14.2] [sgdfc:3.8.0.9.5.0] [db:gtc-*saccharomyces cerevisiae*] |
| CONTIG5197 | 10001885_f3_1 | 4538 | 18641 | 2436 | 812 | YBL014C | 219 | 2.8(10)-14 | *Saccharomyces cerevisiae* | [ui:byl014c] [pn:rna polymerase i specific transcription initiation factor:rna polymerase i specific transcription initiation factor rrn6] [gn:rrn6;ybl0311;ybl0312] [gtcfc:10.1:10.2:10.3] [keggfc:14.2] [sgdfc:4.1.0.9.5.0] [db:gtc-sacc |
| CONTIG3645 | 4711636_f3_3 | 4539 | 18642 | 1263 | 421 | YBL008W | 1125 | 3.6(10)-114 | *Saccharomyces cerevisiae* | [ui:ybl008w] [pn:histone transcription regulator:histone transcription regulagor 1] [gn:hir1;ybl0318] [gtcfc:10.1:10.2] [keggfc:14.2] [sgdfc:4.8.2:9.5.0] [db:gtc-*saccharomyces cerevisiae*] |
| CONTIG4343 | 782806_c3_9 | 4540 | 18643 | 1404 | 468 | YBL008W | 101 | 0.07299 | *Saccharomyces cerevisiae* | [ui:ybl008w] [pn:histone transcription regulator:histone transcription regulator 1] [gn:hir1;ybl0318] [gtcfc:10.1:10.2] [keggfc:14.2] [sgdfc:4.8.2:9.5.0] [db:gtc-*saccharomyces cerevisiae*] |
| CONTIG5245 | 5080340_c3_21 | 4541 | 18644 | 1467 | 489 | YBL008W | 189 | 9.5(10)-15 | *Saccharomyces cerevisiae* | [ui:ybl008w] [pn:histone transcription regulator:histone transcription regulator 1] [gn:hir1;ybl0318] [gtcfc:10.1:10.2] [keggfc:14.2] [sgdfc:4.8.2:9.5.0] [db:gtc-*saccharomyces cerevisiae*] |
| CONTIG2490 | 10976555_f1_2 | 4542 | 18645 | 324 | 108 | YBR009C | 383 | 1.5(10)-35 | *Saccharomyces cerevisiae* | [ui:ybr009c] [pn:histone h4] [gn:hhf1;ybr0122;hhf2;n2752] [gtcfc:10.1:10.2] [keggfc:14.2] [sgdfc:4.8.2:9.5.0:9.6.0] [db:gtc-*saccharomyces cerevisiae*] |
| CONTIG5534 | 23437687_f2_6 | 4543 | 18646 | 348 | 116 | YBR009C | 384 | 1.2(10)-35 | *Saccharomyces cerevisiae* | [ui:ybr009c] [pn:histone h4] [gn:hhf1;ybr0122;hhf2;n2752] [gtcfc:10.1:10.2] [keggfc:14.2] [sgdfc:4.8.2:9.5.0:9.6.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1485 | 16032090_f2_2 | 4544 | 18647 | 507 | 169 | YBR010W | 324 | 2.7(10)-29 | *Saccharomyces cerevisiae* | *saccharomyces cerevisiae* [ui:ybr010w] [pn:histone h3] [gn:hht1:ybr0201:hht2:sin2:n2749] [gtcfc:10.1:10.2] [keggfc:14.2] [sgdfc:4.8.2:9.5.0:9.6.0] [db:gtc-saccharomyces cerevisiae] |
| CONTIG2687 | 34250313_c3_3 | 4545 | 18648 | 261 | 87 | YBR010W | 387 | 5.7(10)-36 | *Saccharomyces cerevisiae* | *saccharomyces cerevisiae* [ui:ybr010w] [pn:histone h3] [gn:hht1:ybr0201:hht2:sin2:n2749] [gtcfc:10.1:10.2] [keggfc:14.2] [sgdfc:4.8.2:9.5.0:9.6.0] [db:gtc-saccharomyces cerevisiae] |
| CONTIG5534 | 19531300_c3_18 | 4546 | 18649 | 459 | 153 | YBR010W | 647 | 1.6(10)-63 | *Saccharomyces cerevisiae* | *saccharomyces cerevisiae* [ui:ybr010w] [pn:histone h3] [gn:hht1:ybr0201:hht2:sin2:n2749] [gtcfc:10.1:10.2] [keggfc:14.2] [sgdfc:4.8.2:9.5.0:9.6.0] [db:gtc-saccharomyces cerevisiae] |
| CONTIG2229 | 26378503_f1_1 | 4547 | 18650 | 471 | 157 | YBR026C | 318 | 1.2(10)-28 | *Saccharomyces cerevisiae* | *saccharomyces cerevisiae* [ui:ybr026c] [pn:mitochondrial respiratory function protein:mitochondrial respiratory function protein 1] [gtcfc:10.1:10.2] [keggfc:14.2] [sgdfc:4.8.2:9.5.0] [db:gtc-saccharomyces cerevisiae] |
| CONTIG4624 | 3305317_f3_4 | 4548 | 18651 | 1185 | 395 | YBR026C | 507 | 1.1(10)-48 | *Saccharomyces cerevisiae* | *saccharomyces cerevisiae* [ui:ybr026c] [pn:mitochondrial respiratory function protein:mitochondrial respiratory function protein 1] [gtcfc:10.1:10.2] [keggfc:14.2] [sgdfc:4.8.2:9.5.0] [db:gtc-saccharomyces cerevisiae] |
| CONTIG1160 | 22695943_c1_4 | 4549 | 18652 | 240 | 80 | YBR049C | 113 | 2.7(10)-14 | *Saccharomyces cerevisiae* | *saccharomyces cerevisiae* [ui:ybr049c] [pn:transcription factor:dna-binding protein reb1:qbp] [gn:reb1:grf2:ybr0502] [gtcfc:10.1:10.2:10.3] [keggfc:14.2] [sgdfc:4.1.0:4.8.2:9.5.0] [db:gtc-saccharomyces cerevisiae] |
| CONTIG5208 | 25476516_c2_14 | 4550 | 18653 | 1185 | 395 | YBR055C | 462 | 5.4(10)-43 | *Saccharomyces cerevisiae* | *saccharomyces cerevisiae* [ui:ybr055c] [pn:snmpu4/u6-associated splicing factor:pre-mrna splicing factor prp6] [gn:prp6:rna6:ybr0508] [gtcfc:10.1:10.2] [keggfc:14.2] [sgdfc:4.9.0:9.5.0] [db:gtc-saccharomyces cerevisiae] |
| CONTIG5208 | 22854652_c2_13 | 4551 | 18654 | 747 | 249 | YBR055C | 180 | 9.9(10)-13 | *Saccharomyces cerevisiae* | *saccharomyces cerevisiae* [ui:ybr055c] [pn:snmpu4/u6-associated splicing factor:pre-mrna splicing factor prp6] [gn:prp6:rna6:ybr0508] [gtcfc:10.1:10.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x12464.x | 4860050_c3_1 | 4552 | 18655 | 603 | 201 | YBR055C | 246 | 8.5(10)-20 | Saccharomyces cerevisiae | [sgdfc:4.9.0.9.5.0] [db:gtc-saccharomyces cerevisiae] [ui:ybr055c] [pn:snrnp:u4/u6-associated splicing factor:pre-mrna splicing factor prp6] [gn:prp6:rna6:ybr0508] [gtcfc:10.1:10.2] [keggfc:14.2] [sgdfc:4.9.0.9.5.0] [db:gtc-saccharomyces cerevisiae] |
| CONTIG3320 | 11750817_f3_3 | 4553 | 18656 | 1242 | 414 | YBR060C | 602 | 9.5(10)-59 | Saccharomyces cerevisiae | [ui:ybr060c] [pn:origin recognition complex, 72 kda subunit:origin recognition complex protein, subunit 2:origin recognition complex protein 71 kd subunit] [gn:orc2:rrr1:sir5:ybr0523] [gtcfc:10.1:10.2:10.8:12.8:12.9] [keggfc:13.2] [sg |
| CONTIG3647 | 41562877_c1_3 | 4554 | 18657 | 318 | 106 | YBR081C | 107 | 9.6(10)-5 | Saccharomyces cerevisiae | [ui:ybr081c] [pn:involved in alteration of transcription start site selection:transcriptional activator spt7] [gn:spt7:ybr0739] [gtcfc:10.1:10.2] [keggfc:14.2] [sgdfc:4.8.2.9.5.0] [db:gtc-saccharomyces cerevisiae] |
| CONTIG4860 | 26343875_f3_4 | 4555 | 18658 | 3006 | 1002 | YBR081C | 662 | 1.2(10)-135 | Saccharomyces cerevisiae | [ui:ybr081c] [pn:involved in alteration of transcription start site selection:transcriptional activator spt7] [gn:spt7:ybr0739] [gtcfc:10.1:10.2] [keggfc:14.2] [sgdfc:4.8.2.9.5.0] [db:gtc-saccharomyces cerevisiae] |
| CONTIG4671 | 4098513_f2_2 | 4556 | 18659 | 1347 | 449 | YBR083W | 213 | 1.0(10)-14 | Saccharomyces cerevisiae | [ui:ybr083w] [pn:ty transcription activator:ty transcription activator tec1] [gn:tec1:ybr0750] [gtcfc:10.1:10.2:12.8] [keggfc:14.2] [sgdfc:3.2.0:4.8.2.9.5.0] [db:gtc-saccharomyces cerevisiae] |
| CONTIG1943 | 2822192_f1_1 | 4557 | t8660 | 261 | 87 | YBR087W | 141 | 3.2(10)-9 | Saccharomyces cerevisiae | [ui:ybr087w] [pn:dna replication factor c, 40 kd subunit:activator 1 subunit 5:replication factor c subunit 5] [gn:rfc5:ybr0810] [gtcfc:10.1:10.2:10.8] [keggfc:14.2] [sgdfc:3.6.0.9.5.0] [db:gtc-saccharomyces cerevisiae] |
| b3x19517.y | 25652036_f2_1 | 4558 | 18661 | 870 | 290 | YBR087W | 692 | 2.7(10)-68 | Saccharomyces cerevisiae | [ui:ybr087w] [pn:dna replication factor c, 40 kd subunit:activator 1 subunit 5:replication factor c subunit 5] [gn:rfc5:ybr0810] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2521 | 23939051_c2_9 | 4559 | 18662 | 798 | 266 | YBR088C | 740 | 2.2(10)-73 | *Saccharomyces cerevisiae* | [gtcfc:10.1:10.2:10.8] [kegfc:14.2] [sgdfc:3.6.0:9.5.0] [db:gtc-*saccharomyces cerevisiae*] [ui:ybr088c] [pn:proliferating cell nuclear antigen;pcna] [gn:pol30;ybr0811] [gtcfc:10.1:10.2:10.8] [keggfc:14.2] [sgdfc:3.60:3.7.0:9.5.0] [db:gtc-*saccharomyces cerevisiae*] |
| CONTIG4482 | 35633436_f3_7 | 4560 | 18663 | 2001 | 667 | YBR112C | 1362 | 2.7(10)-139 | *Saccharomyces cerevisiae* | [ui:ybr112c] [pn:general repressor of transcription:glucose repression mediator protein] [gn:ssn6:cyc8;ybr0908] [gtcfc:10.1:10.2] [keggfc:14.2] [sgdfc:4.8.2:9.5.0] [db:gtc-*saccharomyces cerevisiae*] |
| b3x16071.y | 36147808_c3_4 | 4561 | 18664 | 303 | 101 | YBR112C | 116 | 7.4(10)-6 | *Saccharomyces cerevisiae* | [ui:ybr112c] [pn:general repressor of transcription:glucose repression mediator protein] [gn:ssn6:cyc8;ybr0908] [gtcfc:10.1:10.2] [keggfc:14.2] [sgdfc:4.8.2:9.5.0] [db:gtc-*saccharomyces cerevisiae*] |
| b3x13452.y | 24635752_c3_2 | 4562 | 18665 | 606 | 202 | YBR112C | 108 | 0.0018 | *Saccharomyces cerevisiae* | [ui:ybr112c] [pn:general repressor of transcription:glucose repression mediator protein] [gn:ssn6:cyc8;ybr0908] [gtcfc:10.1:10.2] [keggfc:4.2] [sgdfc:4.8.2:9.5.0] [db:gtc-*saccharomyces cerevisiae*] |
| CONTIG4298 | 22065680_f1_1 | 4563 | 18666 | 3207 | 1069 | YBR114W | 130 | 4.2(10)-7 | *Saccharomyces cerevisiae* | [ui:ybr114w] [pn:nucleotide excision repair protein:dna repair protein rad16] [gn:rad16;ybr0909] [gtcfc:10.1:10.10:10.2:10.8] [keggfc:14.2] [sgdfc:3.7.0:9.5.0:11.2.1] [db:gtc-*saccharomyces cerevisiae*] |
| CONTIG5782 | 5256282_c1_18 | 4564 | 18667 | 2568 | 856 | YBR114W | 2633 | 5.7(10)-274 | *Saccharomyces cerevisiae* | [ui:ybr114w] [pn:nucleotide excision repair protein:dna repair protein rad16] [gn:rad16;ybr0909] [gtcfc:10.1:10.10:10.2:10.8] [keggfc:14.2] [sgdfc:3.7.0:9.5.0:11.2.1] [db:gtc-*saccharomyces cerevisiae*] |
| CONTIG863 | 14722182_c1_2 | 4565 | 18668 | 435 | 145 | YBR123C | 171 | 5.5(10)-12 | *Saccharomyces cerevisiae* | [ui:ybr123c] [pn:tfiiic:transcription initiation factor tau 95 kd subunit;tfiiic 95 kd subunit] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | [gn:tfc1:ybr0919] [gtcfc:10.1:10.2:10.3] [keggfc:14.2] [sgdfc:4.1.0:4.4.0:9.5.0] [db-gtc-saccharomyces |
| CONTIG2869 | 22089187_f3_1 | 4566 | 18669 | 1095 | 365 | YBR150C | 91 | 0.53 | Saccharomyces cerevisiae | [ui:ybr150c] [pn:weak similarity to transcription factors:putative 126.9 kd transcriptional regulatory protein in ysw1-rib7 intergenic region] [gn:ybr1133] [gtcfc:10.1:10.2] [keggfc:14.2] [sgdfc:4.12.0:9.5.0] [db-gtc-saccharomyces cer |
| CONTIG3753 | 26274013_f1_1 | 4567 | 18670 | 1422 | 474 | YBR198C | 1260 | 1.8(10)-128 | Saccharomyces cerevisiae | [ui:ybr198c] [pn:tfiid subunit:tbp-associated factor, 90 kd:hypothetical trp-asp repeats containing protein in pgi1-ktr4 intergenic region] [gn:taf90:ybr14l410] [gtcfc:10.1:10.2] [keggfc:14.2] [sgdfc:4.8.1:9.5.0] [db-gtc-saccharomyces |
| CONTIG5005 | 22066557_c2_4 | 4568 | 18671 | 1182 | 394 | YBR198C | 215 | 1.3(10)-14 | Saccharomyces cerevisiae | [ui:ybr198c] [pn:tfiid subunit:tbp-associated factor, 90 kd:hypothetical trp-asp repeats containing protein in pgi1-ktr4 intergenic region] [gn:taf90:ybr1410] [gtcfc:10.1:10.2] [keggfc:14.2] [sgdfc:4.8.1:9.5.0] [db-gtc-saccharomyces |
| CONTIG5810 | 22438777_f3_21 | 4569 | 18672 | 864 | 288 | YBR198C | 199 | 1.0(10)-27 | Saccharomyces cerevisiae | [ui:ybr198c] [pn:tfiid subunit:tbp-associated factor, 90 kd:hypothetical trp-asp repeats containing protein in pgi1-ktr4 intergenic region] [gn:taf90:ybr1410] [gtcfc:10.1:10.2] [keggfc:14.2] [sgdfc:4.8.1:9.5.0] [db-gtc-saccharomyces |
| CONTIG2640 | 13683587_c1_2 | 4570 | 18673 | 996 | 332 | YBR202W | 1238 | 3.8(10)-126 | Saccharomyces cerevisiae | [ui:ybr202w] [pn:cell division control protein:cell division control protein 479 [gn:cdc47:ybr144] [gtcfc:10.1:10.2:10.8:12.8] [keggfc:14.2] [sgdfc:3.6.0:3.8.0:9.5.0] [db-gtc-saccharomyces cerevisiae] |
| CONTIG4638 | 16222813_c1_8 | 4571 | 18674 | 948 | 316 | YBR202W | 362 | 2.7(10)-32 | Saccharomyces cerevisiae | [ui:ybr202w] [pn:cell division control protein:cell division control |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4195 | 6355200_c1_3 | 4572 | 18675 | 2007 | 669 | YBR237W | 1067 | 5.0(10)-108 | Saccharomyces cerevisiae | protein 47] [gn:cdc47:ybr1441] [gtcfc:10.1:10.2:10.8:12.8] [keggfc:14.2] [sgdfc:3.6.0:3.8.0:9.5.0] [db:gtc-saccharomyces cerevisiae] [ui:ybr237w] [pn:pre-mrna processing rna-helicase:pre-mrna processing rna helicase prp5] [gn:prp5:rna5:ybr1603] [gtcfc:10.1:10.2:12.16] [keggfc:14.2] [sgdfc:4.9.0:6.4.0:9.5.0] [db:gtc-saccharomyces cerevisiae] |
| CONTIG2066 | 19546878_c1_2 | 4573 | 18676 | 942 | 314 | YBR239C | 173 | 3.7(10)-14 | Saccharomyces cerevisiae | [ui:ybr239c] [pn:weak similarity to transcription factor put3p:putative 60.3 kd transcriptional regulatory protein in prp5-alg7 intergenic region] [gn:ybr1622] [gtcfc:10.1:10.2] [keggfc:14.2] [sgdfc:4.12.0:9.5.0] [db:gtc-saccharomyces |
| CONTIG2225 | 34423436_c2_2 | 4574 | 18677 | 294 | 98 | YBR239C | 248 | 1.8(10)-20 | Saccharomyces cerevisiae | [ui:ybr239c] [pn:weak similarity to transcription factor put3p:putative 60.3 kd transcriptional regulatory protein in prp5-alg7 intergenic region] [gn:ybr1622] [gtcfc:10.1:10.2] [keggfc:14.2] [sgdfc:4.12.0:9.5.0] [db:gtc-saccharomyces |
| CONTIG4191 | 20423138_c3_7 | 4575 | 18678 | 1941 | 647 | YBR239C | 243 | 5.7(10)-26 | Saccharomyces cerevisiae | [ui:ybr239c] [pn:weak similarity to transcription factor put3p:putative 60.3 kd transcriptional regulatory protein in prp5-alg7 intergenic region] [gn:ybr1622] [gtcfc:10.1:10.2] [keggfc:14.2] [sgdfc:4.12.0:9.5.0] [db:gtc-saccharomyces |
| CONTIG5697 | 20081537_f3_10 | 4576 | 18679 | 2427 | 809 | YBR239C | 104 | 0.035 | Saccharomyces cerevisiae | [ui:ybr239c] [pn:weak similarity to transcription factor put3p:putative 60.3 kd transcriptional regulatory protein in prp5-alg7 intergenic region] [gn:ybr1622] [gtcfc:10.1:10.2] [keggfc:14.2] [sgdfc:4.12.0:9.5.0] [db:gtc-saccharomyces |
| CONTIG5532 | 211507_f1_1 | 4577 | 18680 | 351 | 117 | YBR247C | 334 | 2.3(10)-30 | Saccharomyces cerevisiae | [ui:ybr247c] [pn:n-glycosylation protein:emp1 protein] [gn:emp1:meg1:ybr1635] [gtcfc:10.1:10.2:10.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4398 | 31292707_f3_2 | 4578 | 18681 | 645 | 215 | YBR275C | 90 | 0.54 | Saccharomyces cerevisiae | [keggfc:14.2] [sgdfc:6.3.0.9.5.0] [db:gtc-saccharomyces cerevisiae] [ui:ybr275c] [pn:rif1 protein:rap1-interacting factor 1] [gn:rif1:ybr1743] [gtcfc:10.1:10.2] [keggfc:14.2] [sgdfc:4.8.2:9.5.0:9.6.0] [db:gtc-saccharomyces cerevisiae] |
| CONTIG4398 | 11719762_f1_1 | 4579 | 18682 | 1779 | 593 | YBR275C | 104 | 4.9(10)-7 | Saccharomyces cerevisiae | [ui:ybr275c] [pn:rif1 protein:rap1-interacting factor 1] [gn:rif1:ybr1743] [gtcfc:10.1:10.2] [keggfc:14.2] [sgdfc:4.8.2:9.5.0:9.6.0] [db:gtc-saccharomyces cerevisiae] |
| CONTIG3103 | 30585057_f3_2 | 4580 | 18683 | 1446 | 482 | YBR279W | 260 | 9.5(10)-30 | Saccharomyces cerevisiae | [ui:ybr279w] [pn:dna-directed rna polymerase ii regulator:paf1 protein] [gn:paf1:ybr2016] [gtcfc:10.1:10.2] [keggfc:14.2] [sgdfc:4.8.2:9.5.0] [db:gtc-saccharomyces cerevisiae] |
| CONTIG2536 | 437512_f1_1 | 4581 | 18684 | 1311 | 437 | YBR289W | 309 | 6.9(10)-30 | Saccharomyces cerevisiae | [ui:ybr289w] [pn:component of swi/snf transcription activator complex:transcription regulatory protein snf5:swi/snf complex component snf5:transcription factor tye4] [gn:snf5:tye4:swi10:ybr2036] [gtcfc:10.1:10.2:12.13:12.9] [keggfc:14 |
| CONTIG3809 | 2355208_f3_4 | 4582 | 18685 | 669 | 223 | YBR289W | 278 | 3.2(10)-23 | Saccharomyces cerevisiae | [ui:ybr289w] [pn:component of swi/snf transcription activator complex:transcription regulatory protein snf5:swi/snf complex component snf5:transcription factor tye4] [gn:snf5:tye4:swi10:ybr2036] [gtcfc:10.1:10.2:12.13:12.9] [keggfc:14 |
| CONTIG2911 | 24015625_f2_3 | 4583 | 18686 | 636 | 212 | YCL066W | 106 | 0.00013 | Saccharomyces cerevisiae | [ui:ycl066w] [pn:mating type regulatory protein, silenced copy at hml:1 mating type regulatory protein, expressed copy at mat locus:mating-type protein alpha-1] [gn:alpha1:matalpha:ycl66w:matal1:mat1a:mat_alpha-1:ycr40w] [gtcfc:10.1:10 |
| CONTIG5663 | 6645262_c2_15 | 4584 | 18687 | 987 | 329 | YCL055W | 828 | 1.3(10)-86 | Saccharomyces cerevisiae | [ui:ycl055w] [pn:regulatory protein required for pheromone induction of karyogamy genes:hypothetical |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONITG353 | 36360326_f2_1 | 4585 | 18688 | 249 | 83 | YCL054W | 409 | 1.3(10)-37 | Saccharomyces cerevisiae | 38.7 kd protein in prd1-pbn1 intergenic region] [gn:kar4:ycl55w:ycl432] [gtcfc:10.1:10.2:12.9] [keggfc:14.2] [sgdfc:3.3.0:4.8.2:9.5.0 [ui:ycl054w] [pn:transcriptional silencing protein:hypothetical 83.2 kd protein in prd1-pbn1 intergenic region] [gn:ycl54w:ycl431] [gtcfc:10.1:10.2] [keggfc:14.2] [sgdfc:4.8.2:9.5.0] [db:gtc-saccharomyces cerevisiae] |
| CONTIG5623 | 36360326_f1_1 | 4586 | 18689 | 1536 | 512 | YCL054W | 1258 | 1.3(10)-176 | Saccharomyces cerevisiae | [ui:ycl054w] [pn:transcriptional silencing protein:hypothetical 83.2 kd protein in prd1-pbn1 intergenic region] [gn:ycl54w:ycl431] [gtcfc:10.1:10.2] [keggfc:14.2] [sgdfc:4.8.2:9.5.0] [db:gtc-saccharomyces cerevisiae] |
| CONTIG3731 | 10567301_c2_16 | 4587 | 18690 | 375 | 125 | YCL029C | 159 | 5.7(10)-11 | Saccharomyces cerevisiae | [ui:ycl029c] [pn:nuclear fusion protein:nuclear fusion protein bik1] [gn:bik1:ycl29c] [gtcfc:10.1:10.2:12.16:12.8:12.9] [keggfc:14.2] [sgdfc:3.3.0:3.8.0:9.3.0:9.5.0] [db:gtc-saccharomyces cerevisiae] |
| CONTIG5143 | 26741377_c1_15 | 4588 | 18691 | 1287 | 429 | YCL011C | 413 | 5.5(10)-63 | Saccharomyces cerevisiae | [ui:ycl011c] [pn:potential telomere-associated protein:single-strand telomeric dna-binding protein gbp2:g-strand binding protein 2:rap1 localization factor 6] [gn:gbp2:tlf6:ycl11c] [gtcfc:10.1:10.2] [keggfc:14.2] [sgdfc:9.5.0:9.6.0] |
| CONTIG3208 | 35723780_f1_1 | 4589 | 18692 | 1158 | 386 | YCR042C | 379 | 1.1(10)-33 | Saccharomyces cerevisiae | [ui:ycr042c] [pn:component of tafii complex:tsm1 protein] [gn:tsm1:ycr42c:ycr724] [gtcfc:10.1:10.2] [keggfc:14.2] [sgdfc:4.8.2:9.5.0] [db:gtc-saccharomyces cerevisiae] |
| CONTIG3956 | 26054813_c2_8 | 4590 | 18693 | 1443 | 481 | YCR042C | 879 | 2.7(10)-87 | Saccharomyces cerevisiae | [ui:ycr042c] [pn:component of tafii complex:tsm1 protein] [gn:tsm1:ycr42c:ycr724] [gtcfc:10.1:10.2] [keggfc:14.2] [sgdfc:4.8.2:9.5.0] [db:gtc-saccharomyces cerevisiae] |
| CONTIG3956 | 4800906_c3_9 | 4591 | 18694 | 663 | 221 | YCR042C | 212 | 6.9(10)-16 | Saccharomyces cerevisiae | [ui:ycr042c] [pn:component of tafii complex:tsm1 protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3956 | 4007160_c3_10 | 4592 | 18695 | 189 | 63 | YCR042C | 144 | 1.2(10)-8 | Saccharomyces cerevisiae | [gn:tsm1ycr42c;ycr724] [gtcfc:10.1:10.2] [keggfc:14.2] [sgdfc:4.8.2:9.5.0] [db:gtc-saccharomyces cerevisiae] [ui:ycr042c] [pn:component of tafiii complextsm1 protein] [gn:tsm1ycr42c;ycr724] [gtcfc:10.1:10.2] [keggfc:14.2] [sgdfc:4.8.2:9.5.0] [db:gtc-saccharomyces cerevisiae] |
| CONTIG4152 | 24414083_f1_2 | 4593 | 18696 | 720 | 240 | YCR065W | 266 | 2.0(10)-22 | Saccharomyces cerevisiae | [ui:ycr065w] [pn:transcription factor:hcm1 protein] [gn:hcm1ycr65w:ycr902] [gtcfc:10.1:10.2] [keggfc:14.2] [sgdfc:4.8.2:9.5.0] [db:gtc-saccharomyces cerevisiae] |
| CONTIG5596 | 23609536_f3_11 | 4594 | 18697 | 777 | 259 | YCR065W | 103 | 0.0074 | Saccharomyces cerevisiae | [ui:ycr065w] [pn:transcription factor:hcm1 protein] [gn:hcm1ycr65w:ycr902] [gtcfc:10.1:10.2] [keggfc:14.2] [sgdfc:4.8.2:9.5.0] [db:gtc-saccharomyces cerevisiae] |
| CONTIG5184 | 12140677_c2_11 | 4595 | 18698 | 1176 | 392 | YCR066W | 247 | 1.5(10)-34 | Saccharomyces cerevisiae | [ui:ycr066w] [pn:dna repair protein:dna repair protein rad18] [gn:rad18;ycr66w] [gtcfc:10.1:10.10:10.2:10.8] [keggfc:14.2] [sgdfc:3.7.0:9.5.0:11.2.1] [db:gtc-saccharomyces cerevisiae] |
| CONTIG1568 | 4094567_c3_4 | 4596 | 18699 | 942 | 314 | YCR072C | 106 | 0.00459 | Saccharomyces cerevisiae | [ui:ycr072c] [pn:beta-transducin family:wd-40 repeat protein:hypothetical trp-asp repeats containing protein in cpr4-ssk22 intergenic region] [gn:ycr72c] [gtcfc:10.1:10.2] [keggfc:14.2] [sgdfc:9.5.0:13.0.0] [db:gtc-saccharomyces cere |
| CONTIG5040 | 13688762_c2_13 | 4597 | 18700 | 1224 | 408 | YCR072C | 122 | 0.00017 | Saccharomyces cerevisiae | [ui:ycr072c] [pn:beta-transducin family:wd-40 repeat protein:hypothetical trp-asp repeats containing protein in cpr4-ssk22 intergenic region] [gn:ycr72c] [gtcfc:10.1:10.2] [keggfc:14.2] [sgdfc:9.5.0:13.0.0] [db:gtc-saccharomyces cere |
| CONTIG708 | 24797506_c2_4 | 4598 | 18701 | 993 | 331 | YCR072C | 1156 | 1.8(10)-117 | Saccharomyces cerevisiae | [ui:ycr072c] [pn:beta-transducin family:wd-40 repeat protein:hypothetical trp-asp repeats containing protein in cpr4-ssk22 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9xl0155.y | 23693849_c1_2 | 4599 | 18702 | 471 | 157 | YCR072C | 594 | 6.7(10)-58 | Saccharomyces cerevisiae | intergenic region] [gn:ycr72c] [gtcfc:10.1:10.2] [keggfc:14.2] [sgdfc:9.5.0:13.0.0] [db:gtc-saccharomyces cere [ui:ycr072c] [pn:beta-transducin family:wd-40 repeat protein:hypothetical trp-asp repeats containing protein in cpr4-ssk22 intergenic region] [gn:ycr72c] [gtcfc:10.1:10.2] [keggfc:14.2] [sgdfc:9.5.0:13.0.0] [db:gtc-saccharomyces cere |
| CONTIG5601 | 12238550_f1_1 | 4600 | 18703 | 1185 | 395 | YCR084C | 1050 | 3.2(10)-106 | Saccharomyces cerevisiae | [ui:ycr084c] [pn:general transcription repressor:glucose repression regulatory protein tup1:flocculation suppressor protein:repressor aer2] [gn:tup1:aer2:sfl2:cyc9:umr7:aar1:amm1:flk1_oryct84c] [gtcfc:10.1:10.2] [keggfc:14.2] [sgdfc:4 |
| CONTIG1665 | 8392_c1_2 | 4601 | 18704 | 690 | 230 | YCR092C | 274 | 1.1(10)-22 | Saccharomyces cerevisiae | [ui:ycr092c] [pn:dna mismatch repair protein:muts protein homolog 3:mismatch binding protein:mbp] [gn:msh3:ycr92c:ycr1152] [gtcfc:10.1:10.2:10.8] [keggfc:14.2] [sgdfc:3.7.0.9.5.0] [db:gtc-saccharomyces cerevisiae] |
| CONTIG3957 | 2789050_f3_4 | 4602 | 18705 | 234 | 78 | YCR092C | 98 | 0.00067 | Saccharomyces cerevisiae | [ui:ycr092c] [pn:dna mismatch repair protein:muts protein homolog 3:mismatch binding protein:mbp] [gn:msh3:ycr92c:ycr1152] [gtcfc:10.1:10.2:10.8] [keggfc:14.2] [sgdfc:3.7.0.9.5.0] [db:gtc-saccharomyces cerevisiae] |
| CONTIG3957 | 14178130_f1_1 | 4603 | 18706 | 897 | 299 | YCR092C | 597 | 2.2(10)-57 | Saccharomyces cerevisiae | [ui:ycr092c] [pn:dna mismatch repair protein:muts protein homolog 3:mismatch binding protein:mbp] [gn:msh3:ycr92c:ycr1152] [gtcfc:10.1:10.2:10.8] [keggfc:14.2] [sgdfc:3.7.0.9.5.0] [db:gtc-saccharomyces cerevisiae] |
| CONTIG1046 | 13882630_f2_1 | 4604 | 18707 | 675 | 225 | YCR093W | 345 | 8.0(10)-30 | Saccharomyces cerevisiae | [ui:ycr093w] [pn:nuclear transmembrane protein:general negative regulator of transcription subunit 1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1046 | 203575_f2_2 | 4605 | 18708 | 282 | 94 | YCR093W | 111 | 6.0(10)-5 | Saccharomyces cerevisiae | [gn:not1:cdc39:ros1:ycr93w:ycr11 51] [gtcfc:10.1:10.2] [keggfc:14.2] [sgdfc:4.8.2:9.5.0] [dbgtc-saccharomyces cerevisiae] [ui:ycr093w] [pn:nuclear transmembrane protein:general negative regulator of transcription subunit 1] |
| CONTIG1166 | 176567_c3_4 | 4606 | 18709 | 957 | 319 | YCR093W | 602 | 3.7(10)-57 | Saccharomyces cerevisiae | [gn:not1:cdc39:ros1:ycr93w:ycr11 51] [gtcfc:10.1:10.2] [keggfc:14.2] [sgdfc:4.8.2:9.5.0] [dgtc-saccharomyces cerevisiae] [ui:ycr093w] [pn:nuclear transmembrane protein:general negative regulator of transcription subunit 1] |
| CONTIG895 | 2439831_f2_2 | 4607 | 18710 | 486 | 162 | YCR093W | 224 | 5.9(10)-17 | Saccharomyces cerevisiae | [gn:not1:cdc39:ros1:ycr93w:ycr11 51] [gtcfc:10.1:10.2] [keggfc:14.2] [sgdfc:4.8.2:9.5.0] [dgtc-saccharomyces cerevisiae] [ui:ycr093w] [pn:nuclear transmembrane protein:general negative regulator of transcription subunit 1] |
| CONTIG895 | 3150012_f1_1 | 4608 | 18711 | 678 | 226 | YCR093W | 220 | 1.6(10)-16 | Saccharomyces cerevisiae | [gn:not1:cdc39:ros1:ycr93w:ycr11 51] [gtcfc:10.1:10.2] [keggfc:14.2] [sgdfc:4.8.2:9.5.0] [dbgtc-saccharomyces cerevisiae] [ui:ycr093w] [pn:nuclear transmembrane protein:general negative regulator of transcription subunit 1] |
| CONTIG3229 | 4332802_f3_4 | 4609 | 18712 | 1761 | 587 | YCR106W | 142 | 3.7(10)-6 | Saccharomyces cerevisiae | [ui:ycr106w] [pn:weak similarity to transcription factor pip2p:putative 95.7 kd transcriptional regulatory protein in pau3 3"region] [gtcfc:10.1:10.2] [keggfc:14.2] [sgdfc:4.8.2:9.5.0] [dbgtc-saccharomyces cerevisiae] |
| CONTIG3945 | 2375030_c2_4 | 4610 | 18713 | 543 | 181 | YDL226C | 515 | 1.6(10)-49 | Saccharomyces cerevisiae | [ui:ydl226c] [pn:cell proliferation zinc finger protein:zinc finger protein] [gn:gcs1] [gtcfc:10.1:10.2:12.10:12.6:12.8] [keggfc:14.2] [sgdfc:3.8.0:8.6.0:8.7.0:9.5.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5742 | 23609806_f3_14 | 4611 | 18714 | 1542 | 514 | YDL207W | 666 | 1.6(10)-65 | Saccharomyces cerevisiae | [db:gtc-saccharomyces cerevisiae] [ui:ydl207w] [pn:rna export mediator] [gn:gle1] [gtcfc:10.1:10.2:12.3] [sgdfc:4.11.0:8.1.0:9.2.0:9.5.0] [keggfc:14.2] |
| CONTIG3352 | 2156415_c1_3 | 4612 | 18715 | 558 | 186 | YDL200C | 258 | 2.7(10)-22 | Saccharomyces cerevisiae | [db:gtc-saccharomyces cerevisiae] [ui:ydl200c] [pn:o6-methylguanine dna repair methyltransferase:methylated-dna--protein-cysteine methyltransferase:6-o-methylguanine-dna methyltransferase] [gn:mgt1:d1204] [gtcfc:10.1:10.10:10.2:14.1] [ec:2.1.1.63] [keggfc:14.1] |
| CONTIG5437 | 24350687_c3_23 | 4613 | 18716 | 561 | 187 | YDL165W | 324 | 2.7(10)-29 | Saccharomyces cerevisiae | [sgdfc [ui:ydl165w] [pn:transcription factor:general negative regulator of transcription subunit 2] [gn:not2:cdc36:cdna19] [gtcfc:10.1:10.2:12.8] [keggfc:14.2] |
| CONTIG5390 | 12896936_c1_14 | 4614 | 18717 | 198 | 66 | YDL164C | 112 | 1.5(10)-5 | Saccharomyces cerevisiae | [sgdfc:3.8.0:4.8.2:9.5.0] [db:gtc-saccharomyces cerevisiae] [ui:ydl164c] [pn:dna ligase:polydeoxyribonucleotide synthase:atp] [gn:cdc9] [gtcfc:10.1:10.10:10.2:10.8:14.1] [ec:6.5.1.1] [keggfc:14.1] [sgdfc:3.6.0:3.7.0:9.5.0:11.2.1] |
| CONTIG5736 | 203942_c3_27 | 4615 | 18718 | 939 | 313 | YDL164C | 1025 | 1.3(10)-103 | Saccharomyces cerevisiae | [db:gtc-saccharomyces cerevisiae] [ui:ydl164c] [pn:dna ligase:polydeoxyribonucleotide synthase:atp] [gn:cdc9] [gtcfc:10.1:10.10:10.2:10.8:14.1] [ec:6.5.1.1] [keggfc:14.1] [sgdfc:3.6.0:3.7.0:9.5.0:11.2.1] |
| CONTIG2856 | 23570399_c1_4 | 4616 | 18719 | 1107 | 369 | YDL164C | 693 | 2.2(10)-68 | Saccharomyces cerevisiae | [ui:ydl164c] [pn:dna ligase:polydeoxyribonucleotide synthase:atp] [gn:cdc9] [gtcfc:10.1:10.10:10.2:10.8:14.1] [ec:6.5.1.1] [keggfc:14.1] [sgdfc:3.6.0:3.7.0:9.5.0:11.2.1] |
| CONTIG2033 | 2234792_f1_1 | 4617 | 18720 | 1149 | 383 | YDL160C | 1002 | 3.8(10)-101 | Saccharomyces cerevisiae | [db:gtc-saccharomyces cerevisiae] [ui:ydl160c] [pn:strong similarity to rna helicases of the dead box family:putative atp-dependent rna |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3197 | 33209375_f1_2 | 4618 | 18721 | 621 | 207 | YDL160C | 739 | 2.8(10)-73 | Saccharomyces cerevisiae | helicase] [gn:dhh1] [gtcfc:10.1:10.2] [keggfc:14.2] [sgdfc:4.12.0:9.5.0] [db:gtc-saccharomyces cerevisiae] [ui:ydl160c] [pn:strong similarity to rna helicases of the dead box family:putative atp-dependent rna helicase] [gn:dhh1] [gtcfc:10.1:10.2] [keggfc:14.2] [sgdfc:4.12.0:9.5.0] [db:gtc-saccharomyces cerevisiae] |
| CONTIG5717 | 12695903_c1_8 | 4619 | 18722 | 1725 | 575 | YDL154W | 702 | 2.3(10)-69 | Saccharomyces cerevisiae | [ui:ydl154w] [pn:meiosis-specific protein] [gn:msh5] [gtcfc:10.1:10.2:12.8] [keggfc:14.2] [sgdfc:3.5.0:9.5.0] [db:gtc-saccharomyces cerevisiae] |
| CONTIG1929 | 23597567_f1_1 | 4620 | 18723 | 981 | 327 | YDL116W | 179 | 1.2(10)-25 | Saccharomyces cerevisiae | [ui:ydl116w] [pn:nucleoporin:nuclear pore protein] [gn:nup84] [gtcfc:10.1:10.2] [keggfc:14.2] [sgdfc:8.1.0:9.5.0] [db:gtc-saccharomyces cerevisiae] |
| CONTIG4692 | 14506511_f3_5 | 4621 | 18724 | 1479 | 493 | YDL106C | 339 | 6.0(10)-44 | Saccharomyces cerevisiae | [ui:ydl106c] [pn:homeodomain protein:regulatory protein pho2:general regulatory factor 10] [gn:pho2:bas2:grf10:cd2350] [gtcfc:10.1:10.2:12.8:13.10] [keggfc:13.5:.4.2:4.8.2:9.5.0] [sgdfc:1.3.5:.4.2:4.8.2:9.5.0] [db:gtc-saccharomyces cerevisiae] |
| CONTIG2064 | 10366327_f2_1 | 4622 | 18725 | 201 | 67 | YDL056W | 184 | 3.2(10)-13 | Saccharomyces cerevisiae | [ui:ydl056w] [pn:transcription factor, subunit of the mbf factor:transcription factor:mbf subunit p120] [gn:mbp1] [gtcfc:10.1:10.2:12.8] [keggfc:13.2] [sgdfc:3.8.0:4.8.2:9.5.0] [db:gtc-saccharomyces cerevisiae] |
| CONTIG3259 | 20751657_c1_4 | 4623 | 18726 | 555 | 185 | YDL056W | 282 | 1.1(10)-23 | Saccharomyces cerevisiae | [ui:ydl056w] [pn:transcription factor, subunit of the mbf factor:transcription factor:mbf subunit p120] [gn:mbp1] [gtcfc:10.1:10.2:12.8] [keggfc:13.2] [sgdfc:3.8.0:4.8.2:9.5.0] [db:gtc-saccharomyces cerevisiae] |
| CONTIG3884 | 20488905_f2_2 | 4624 | 18727 | 1461 | 487 | YDL056W | 95 | 0.28999 | Saccharomyces cerevisiae | [ui:ydl056w] [pn:transcription factor, subunit of the mbf factor:transcription factor:mbf |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4530 | 33789717_c1_8 | 4625 | 18728 | 2238 | 746 | YDL056W | 263 | 3.2(10)-25 | Saccharomyces cerevisiae | subunit p120 [gn:mbp1] [gtcfc:10.1:10.2:12.8] [keggfc:13.2] [sgdfc:3.8.0:4.8.2:9.5.0] [db:gtc-saccharomyces cerevisiae] [ui:ydl056w] [pn:transcription factor, subunit of the mbf factor:transcription factor:mbf subunit p120] [gn:mbp1] [gtcfc:10.1:10.2:12.8] [keggfc:13.2] |
| CONTIG973 | 22269759_c2_3 | 4626 | 18729 | 789 | 263 | YDL056W | 194 | 2.7(10)-14 | Saccharomyces cerevisiae | [sgdfc:3.8.0:4.8.2:9.5.0] [db:gtc-saccharomyces cerevisiae] [ui:ydl056w] [pn:transcription factor, subunit of the mbf factor:transcription factor:mbf subunit p120] [gn:mbp1] [gtcfc:10.1:10.2:12.8] [keggfc:13.2] [sgdfc:3.8.0:4.8.2:9.5.0] [db:gtc-saccharomyces cerevisiae] |
| CONTIG3237 | 4475386_c2_4 | 4627 | 18730 | 798 | 266 | YDL043C | 248 | 3.1(10)-21 | Saccharomyces cerevisiae | [ui:ydl043c] [pn:pre-mrna splicing factor] [gn:prp11] [gtcfc:10.1:10.2] [keggfc:14.2] [sgdfc:4.9.0:9.5.0] [db:gtc-saccharomyces cerevisiae] |
| CONTIG1026 | 12784405_f2_1 | 4628 | 18731 | 918 | 306 | YDL030W | 396 | 6.5(10)-37 | Saccharomyces cerevisiae | [ui:ydl030w] [pn:pre-mrna splicing factor:snrna-associated protein:pre-mrna splicing factor prp9] [gn:prp9:d2773] [gtcfc:10.1:10.2] [keggfc:14.2] [sgdfc:4.9.0:9.5.0] [db:gtc-saccharomyces cerevisiae] |
| CONTIG2121 | 29343840_f2_1 | 4629 | 18732 | 423 | 141 | YDL030W | 90 | 0.039 | Saccharomyces cerevisiae | [ui:ydl030w] [pn:pre-mrna splicing factor:snrna-associated protein:pre-mrna splicing factor prp9] [gn:prp9:d2773] [gtcfc:10.1:10.2] [keggfc:14.2] [sgdfc:4.9.0:9.5.0] [db:gtc-saccharomyces cerevisiae] |
| CONTIG2648 | 24851018_f3_2 | 4630 | 18733 | 1218 | 406 | YDL020C | 217 | 4.2(10)-17 | Saccharomyces cerevisiae | [ui:ydl020c] [pn:nuclear protein:nuclear protein son1:ub fusion degradation protein 5] [gn:son1:ufd5:d2840] [gtcfc:10.1:10.11:10.2] [keggfc:14.2] [sgdfc:6.5.1:9.5.0] [db:gtc-saccharomyces cerevisiae] |
| CONTIG5686 | 10759712_c2_23 | 4631 | 18734 | 1560 | 520 | YDL020C | 115 | 0.0014 | Saccharomyces cerevisiae | [ui:ydl020c] [pn:nuclear protein:nuclear protein son1:ub fusion degradation protein 5] [gn:son1:ufd5:d2840] [gtcfc:10.1:10.11:10.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5686 | 21890828_c3_27 | 4632 | 18735 | 1506 | 502 | YDL020C | 135 | 7.5(10)-6 | Saccharomyces cerevisiae | [keggfc:14.2] [sgdfc:6.5.1:9.5.0] [db:gtc-saccharomyces cerevisiae] [ui:ydl020c] [pn:nuclear protein:nuclear protein son1:ub fusion degradation protein 5] [gn:son1:ufd5:d2840] [gtcfc:10.1:10.11:10.2] [keggfc:14.2] [sgdfc:6.5.1:9.5.0] [db:gtc-saccharomyces cerevisiae] |
| CONTIG3726 | 20312937_f1_1 | 4633 | 18736 | 480 | 160 | YDL014W | 774 | 5.7(10)-77 | Saccharomyces cerevisiae | [ui:ydl014w] [pn:fibrillarin:nucleolar protein 1] [gn:nop1:d2870] [gtcfc:10.1:10.2:10.3] [keggfc:14.2] [sgdfc:4.2.0:9.5.0] [db:gtc-saccharomyces cerevisiae] |
| CONTIG3726 | 12345187_f2_2 | 4634 | 18737 | 297 | 99 | YDL014W | 105 | 2.5(10)-5 | Saccharomyces cerevisiae | [ui:ydl014w] [pn:fibrillarin:nucleolar protein 1] [gn:nop1:d2870] [gtcfc:10.1:10.2:10.3] [keggfc:14.2] [sgdfc:4.2.0:9.5.0] [db:gtc-saccharomyces cerevisiae] |
| CONTIG5426 | 490917_f3_6 | 4635 | 18738 | 1557 | 519 | YDR004W | 252 | 2.7(10)-29 | Saccharomyces cerevisiae | [ui:ydr004w] [pn:dna repair protein:dna repair protein rad57] [gn:rad57:yd8119] [gtcfc:10.1:10.10:10.2:10.8:12.8:1 2.9] [keggfc:14.2] [sgdfc:3.3.0:3.5.0:3.7.0:9.5.0:11.2. 1] [db:gtc-saccharomyces cerevisiae] |
| CONTIG4801 | 35803312_f3_5 | 4636 | 18739 | 1917 | 639 | YDR006C | 625 | 2.8(10)-98 | Saccharomyces cerevisiae | [ui:ydr006c] [pn:high copy suppressor of a cyclic amp-dependent protein kinase mutant:sok1 protein] [gn:sok1:yd8119] [gtcfc:10.1:10.2] [keggfc:14.2] [sgdfc:4.8.2:9.5.0] [db:gtc-saccharomyces cerevisiae] |
| CONTIG1119 | 30250927_f1_1 | 4637 | 18740 | 756 | 252 | YDR028C | 107 | 3.0(10)-7 | Saccharomyces cerevisiae | [ui:ydr028c] [pn:regulatory subunit for protein phosphatase glc7p:hex2 protein:srn1 protein:reg1 protein] [gn:hex2:srn1:reg1:spp43:yd9813] [gtcfc:10.1:10.2:12.13:12.8] [keggfc:13.1] [sgdfc:1.5.2:4.9.0:9.5.0] [db:gtc-saccharomyces cere |
| CONTIG2131 | 3929501_c1_3 | 4638 | 18741 | 621 | 207 | YDR028C | 105 | 0.00012 | Saccharomyces cerevisiae | [ui:ydr028c] [pn:regulatory subunit for protein phosphatase glc7p:hex2 protein:srn1 protein:reg1 protein] [gn:hex2:srn1:reg1:spp43:yd9813] [gtcfc:10.1:10.2:12.13:12.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2599 | 19632001_f1_1 | 4639 | 18742 | 1188 | 396 | YDR028C | 101 | 0.065 | Saccharomyces cerevisiae | [ui:ydr028c] [pn:regulatory subunit for protein phosphatase glc7p:hex2 protein:sm1 protein:reg1 protein] [gn:hex2:sm1:reg1:spp43:yd9813] [gtcfc:10.1:10.2:12.13:12.8] [keggfc:13.1] [sgdfc:1.5.2:4.9.0:9.5.0] [db:gtc-saccharomyces cere |
| CONTIG2946 | 10833263_c3_7 | 4640 | 18743 | 1953 | 651 | YDR028C | 168 | 1.5(10)-11 | Saccharomyces cerevisiae | [ui:ydr028c] [pn:regulatory subunit for protein phosphatase glc7p:hex2 protein:sm1 protein:reg1 protein] [gn:hex2:sm1:reg1:spp43:yd9813] [gtcfc:10.1:10.2:12.13:12.8] [keggfc:13.1] [sgdfc:1.5.2:4.9.0:9.5.0] [db:gtc-saccharomyces cere |
| CONTIG5418 | 19530_c3_20 | 4641 | 18744 | 222 | 74 | YDR028C | 117 | 6.0(10)-6 | Saccharomyces cerevisiae | [ui:ydr028c] [pn:regulatory subunit for protein phosphatase glc7p:hex2 protein:sm1 protein:reg1 protein] [gn:hex2:sm1:reg1:spp43:yd9813] [gtcfc:10.1:10.2:12.13:12.8] [keggfc:13.1] [sgdfc:1.5.2:4.9.0:9.5.0] [db:gtc-saccharomyces cere |
| CONTIG554 | 29550762_f1_1 | 4642 | 18745 | 807 | 269 | YDR028C | 381 | 2.1(10)-43 | Saccharomyces cerevisiae | [ui:ydr028c] [pn:regulatory subunit for protein phosphatase glc7p:hex2 protein:sm1 protein:reg1 protein] [gn:hex2:sm1:reg1:spp43:yd9813] [gtcfc:10.1:10.2:12.13:12.8] [keggfc:13.1] [sgdfc:1.5.2:4.9.0:9.5.0] [db:gtc-saccharomyces cere |
| CONTIG1778 | 11882013_c1_1 | 4643 | 18476 | 216 | 72 | YDR034C | 123 | 1.0(10)-6 | Saccharomyces cerevisiae | [ui:ydr034c] [pn:transcriptional activator of lysine pathway genes:lysine biosynthesis regulatory protein lys14] [gn:lys14:yd9673] [gtcfc:10.1:10.2] [keggfc:14.2] [sgdfc:1.1.2:4.8.2:9.5.0] [db:gtc-saccharomyces cerevisiae] |
| CONTIG2271 | 6821877_c1_3 | 4644 | 18747 | 948 | 316 | YDR034C | 103 | 0.0016 | Saccharomyces cerevisiae | [ui:ydr034c] [pn:transcriptional activator of lysine pathway genes:lysine biosynthesis regulatory protein lys14] [gn:lys14:yd9673] [gtcfc:10.1:10.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4112 | 398442_c3_6 | 4645 | 18748 | 696 | 232 | YDR034C | 122 | 1.3(10)-5 | Saccharomyces cerevisiae | [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |
| CONTIG2366 | 35287503_f1_1 | 4646 | 18749 | 873 | 291 | YDR034C | 108 | 0.00479 | Saccharomyces cerevisiae | [gtcfc:10.1:10.2] [keggfc:14.2] [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |
| CONTIG4015 | 4100626_f3_8 | 4647 | 18750 | 1917 | 639 | YDR034C | 113 | 0.0027 | Saccharomyces cerevisiae | [gtcfc:10.1:10.2] [keggfc:14.2] [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |
| CONTIG4450 | 35970266_c2_9 | 4648 | 18751 | 1863 | 621 | YDR034C | 109 | 0.01099 | Saccharomyces cerevisiae | [gtcfc:10.1:10.2] [keggfc:14.2] [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |
| CONTIG5002 | 6898551_c1_11 | 4649 | 18752 | 579 | 193 | YDR034C | 162 | 6.9(10)-11 | Saccharomyces cerevisiae | [gtcfc:10.1:10.2] [keggfc:14.2] [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |
| CONTIG5632 | 20597288_f1_1 | 4650 | 18753 | 2145 | 715 | YDR034C | 289 | 3.2(10)-28 | Saccharomyces cerevisiae | [gtcfc:10.1:10.2] [keggfc:14.2] [sgdfc:1.1.2:4.8.2:9.5.0] [db:gtc-saccharomyces cerevisiae] [ui:ydr034c] [pn:transcriptional activator of lysine pathway genes:lysine biosynthesis regulatory protein lys14] [gn:lys14;yd9673] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5632 | 33441375_f2_3 | 4651 | 18754 | 726 | 242 | YDR034C | 145 | 4.5(10)-9 | *Saccharomyces cerevisiae* | *saccharomyces cerevisiae* [ui:ydr034c] [pn:transcriptional activator of lysine pathway genes:lysine biosynthesis regulatory protein lys14] [gn:lys14;yd9673] [gtcfc:10.1:10.2] [keggfc:14.2] [sgdfc:1.1.2:4.8.2:9.5.0] [db:gtc-saccharomyces cerevisiae] |
| CONTIG5664 | 15751250_f3_6 | 4652 | 18755 | 1197 | 399 | YDR034C | 211 | 5.0(10)-24 | *Saccharomyces cerevisiae* | [ui:ydr034c] [pn:transcriptional activator of lysine pathway genes:lysine biosynthesis regulatory protein lys14] [gn:lys14;yd9673] [gtcfc:10.1:10.2] [keggfc:14.2] [sgdfc:1.1.2:4.8.2:9.5.0] [db:gtc-saccharomyces cerevisiae] |
| CONTIG5791 | 4957813_f3_18 | 4653 | 18756 | 2070 | 690 | YDR034C | 295 | 1.3(10)-31 | *Saccharomyces cerevisiae* | [ui:ydr034c] [pn:transcriptional activator of lysine pathway genes:lysine biosynthesis regulatory protein lys14] [gn:lys14;yd9673] [gtcfc:10.1:10.2] [keggfc:14.2] [sgdfc:1.1.2:4.8.2:9.5.0] [db:gtc-saccharomyces cerevisiae] |
| CONTIG5802 | 4402067_f1_1 | 4654 | 18757 | 786 | 262 | YDR034C | 116 | 0.00033 | *Saccharomyces cerevisiae* | [ui:ydr034c] [pn:transcriptional activator of lysine pathway genes:lysine biosynthesis regulatory protein lys14] [gn:lys14;yd9673] [gtcfc:10.1:10.2] [keggfc:14.2] [sgdfc:1.1.2:4.8.2:9.5.0] [db:gtc-saccharomyces cerevisiae] |
| b9x11f38.x | 10751640_f2_1 | 4655 | 18758 | 672 | 224 | YDR034C | 90 | 0.22 | *Saccharomyces cerevisiae* | [ui:ydr034c] [pn:transcriptional activator of lysine pathway genes:lysine biosynthesis regulatory protein lys14] [gn:lys14;yd9673] [gtcfc:10.1:10.2] [keggfc:14.2] [sgdfc:1.1.2:4.8.2:9.5.0] [db:gtc-saccharomyces cerevisiae] |
| CONTIG2456 | 24323411_c3_4 | 4656 | 18759 | 1194 | 398 | YDR052C | 340 | 3.0(10)-34 | *Saccharomyces cerevisiae* | [ui:ydr052c] [pn:regulatory subunit for cdc7p protein kinase:dbf4 protein:dna52 protein] [gn:dbf4:dna52;yd9609] [gtcfc:10.1:10.2:10.8:12.8] [keggfc:13.2] [sgdfc:3.6.0:3.8.0:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3705 | 182761_c3_10 | 4657 | 18760 | 786 | 262 | YDR054C | 622 | 7.2(10)-61 | Saccharomyces cerevisiae | [ui:ydr054c] [pn:ubiquitin-conjugating enzyme:ubiquitin-conjugating enzyme e2-34 kd:ubiquitin-protein ligase:ubiquitin carrier protein:cell division control protein 34] [gn:ubc3:cdc34:dna6:yd9609] [gtcfc:10.1:10.11:10.2:10.7:10.8.1 2.8] |
| CONTIG611 | 4882186_c2_4 | 4658 | 18761 | 972 | 324 | YDR088C | 104 | 2.5(10)-8 | Saccharomyces cerevisiae | [ui:ydr088c] [pn:pre-mrna splicing factor affecting 3" splice site choice:pre-mrna splicing factor slu7] [gn:slu7:d4483] [gtcfc:10.1:10.2] [keggfc:14.2] [sgdfc:4.9.0:9.5.0] [db:gtc-saccharomyces cerevisiae] |
| CONTIG5779 | 4178300_f3_12 | 4659 | 18762 | 1764 | 588 | YDR097C | 940 | 1.5(10)-94 | Saccharomyces cerevisiae | [ui:ydr097c] [pn:dna mismatch repair protein] [gn:msh6] [gtcfc:10.1:10.2:10.8] [keggfc:14.2] [sgdfc:3.7.0:9.5.0] [db:gtc-saccharomyces cerevisiae] |
| CONTIG5779 | 978202_f3_13 | 4660 | 18763 | 1671 | 557 | YDR097C | 1524 | 1.8(10)-156 | Saccharomyces cerevisiae | [ui:ydr097c] [pn:dna mismatch repair protein] [gn:msh6] [gtcfc:10.1:10.2:10.8] [keggfc:14.2] [sgdfc:3.7.0:9.5.0] [db:gtc-saccharomyces cerevisiae] |
| CONTIG5779 | 9946877_f1_3 | 4661 | 18764 | 261 | 87 | YDR097C | 142 | 1.7(10)-8 | Saccharomyces cerevisiae | [ui:ydr097c] [pn:dna mismatch repair protein] [gn:msh6] [gtcfc:10.1:10.2:10.8] [keggfc:14.2] [sgdfc:3.7.0:9.5.0] [db:gtc-saccharomyces cerevisiae] |
| CONTIG4241 | 4772125_f1_2 | 4662 | 18765 | 1719 | 573 | YDR159W | 1095 | 5.5(10)-111 | Saccharomyces cerevisiae | [ui:ydr159w] [pn:leucine permease transcriptional regulator] [gn:sac3:lep1:yd8358] [gtcfc:10.1:10.2] [keggfc:14.2] [sgdfc:1.1.2:4.8.2:9.5.0] [db:gtc-saccharomyces cerevisiae] |
| CONTIG864 | 20901562_f2_2 | 4663 | 18766 | 711 | 237 | YDR159W | 210 | 1.0(10)-15 | Saccharomyces cerevisiae | [ui:ydr159w] [pn:leucine permease transcriptional regulator] [gn:sac3:lep1:yd8358] [gtcfc:10.1:10.2] [keggfc:14.2] [sgdfc:1.1.2:4.8.2:9.5.0] [db:gtc-saccharomyces cerevisiae] |
| CONTIG4895 | 7206462_c3_6 | 4664 | 18767 | 954 | 318 | YDR173C | 463 | 5.2(10)-44 | Saccharomyces cerevisiae | [ui:ydr173c] [pn:arginine metabolism transcription factor:arginine metabolism regulation protein iii] [gn:argr3:arg82:yd9395] [gtcfc:10.1:10.2:12.15] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG969 | 24335417_c3_4 | 4665 | 18768 | 891 | 297 | YDR176W | 470 | 1.8(10)-44 | Saccharomyces cerevisiae | [keggfc:14.2] [sgdfc:1.1.2:3.4.0:4.8.2:9.5.0] [db:gtc-saccharomyces cerevisiae] [ui:ydr176w] [pn:general transcriptional adaptor or co-activator:ada3 protein:ngg1 protein] [gn:ada3:ngg1:yd9395] [gtcfc:10.1:10.2:12.13] |
| CONTIG1884 | 975012_f1_1 | 4666 | 18769 | 876 | 292 | YDR217C | 132 | 3.5(10)-6 | Saccharomyces cerevisiae | [keggfc:14.2] [sgdfc:1.5.2:4.8.2:9.5.0] [db:gtc-saccharomyces cerevisiae] [ui:ydr217c] [pn:dna repair checkpoint protein:dna repair protein] [gn:rad9] [gtcfc:10.1:10.2:12.8] |
| CONTIG3962 | 16835925_c2_7 | 4667 | 18770 | 399 | 133 | YDR224C | 466 | 2.5(10)-44 | Saccharomyces cerevisiae | [keggfc:14.2] [sgdfc:3.8.0:4.8.2:9.5.0] [db:gtc-saccharomyces cerevisiae] [ui:ydr224c] [pn:histone h2b.1] [gn:htb1:h2b1:spt12:yd9934] [gtcfc:10.1:10.2] [keggfc:14.2] [gtcfc:4.8.2:9.5.0:9.6.0] [db:gtc-saccharomyces cerevisiae] |
| CONTIG4359 | 4741062_f1_1 | 4668 | 18771 | 549 | 183 | YDR225W | 518 | 7.7(10)-50 | Saccharomyces cerevisiae | [ui:ydr225w] [pn:histone h2a.1] [gn:hta1:h2a1:spt11:yd9934] [gtcfc:10.1:10.2] [keggfc:14.2] [gtcfc:4.8.2:9.5.0:9.6.0] [db:gtc-saccharomyces cerevisiae] |
| CONTIG3853 | 11117280_f3_4 | 4669 | 18772 | 1134 | 378 | YDR228C | 154 | 2.8(10)-22 | Saccharomyces cerevisiae | [ui:ydr228c] [pn:component of pre-mrna 3"-end processing factor cf i] [gn:pcf11] [gtcfc:10.1:10.2:10.9] [keggfc:14.2] [sgdfc:4.10.0:9.5.0] [db:gtc-saccharomyces cerevisiae] |
| CONTIG5337 | 4812525_f3_2 | 4670 | 18773 | 954 | 318 | YDR228C | 242 | 1.2(10)-19 | Saccharomyces cerevisiae | [ui:ydr228c] [pn:component of pre-mrna 3"-end processing factor cf i] [gn:pcf11] [gtcfc:10.1:10.2:10.9] [keggfc:14.2] [sgdfc:4.10.0:9.5.0] [db:gtc-saccharomyces cerevisiae] |
| CONTIG5312 | 9922131_f3_7 | 4671 | 18774 | 912 | 304 | YDR216W | 204 | 4.5(10)-15 | Saccharomyces cerevisiae | [ui:ydr216w] [pn:zinc-finger transcription factor:regulatory protein adr1] [gn:adr1:yd8142] [gtcfc:10.1:10.2:12.13] [keggfc:14.2] [sgdfc:1.5.2:4.8.2:9.5.0] [db:gtc-saccharomyces cerevisiae] |
| CONTIG927 | 11828957_f1_1 | 4672 | 18775 | 873 | 291 | YDR216W | 225 | 2.6(10)-17 | Saccharomyces cerevisiae | [ui:ydr216w] [pn:zinc-finger transcription factor:regulatory |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3333 | 13867037_c1_4 | 4673 | 18776 | 957 | 319 | YDR243C | 426 | 4.2(10)-40 | Saccharomyces cerevisiae | [ui:ydr243c] [pn:pre-mrna splicing factor rna helicase of dead box family:pre-mrna splicing factor rna helicase prp28:helicase ca8] [gn:prp28:yd8419] [gtcfc:10.1:10.2] [kegfc:14.2] [sgdfc:4.9.0.9.5.0] [db:gtc-saccharomyces cerevisiae] |
| CONTIG4458 | 11737891_c2_6 | 4674 | 18777 | 381 | 127 | YDR243C | 188 | 7.0(10)-14 | Saccharomyces cerevisiae | [ui:ydr243c] [pn:pre-mrna splicing factor rna helicase of dead box family:pre-mrna splicing factor rna helicase prp28:helicase ca8] [gn:prp28:yd8419] [gtcfc:10.1:10.2] [kegfc:14.2] [sgdfc:4.9.0.9.5.0] [db:gtc-saccharomyces cerevisiae] |
| CONTIG2065 | 167625_f3_2 | 4675 | 18778 | 591 | 197 | YDR254W | 140 | 7.0(10)-9 | Saccharomyces cerevisiae | [ui:ydr254w] [pn:chromosome segregation protein:putative cell segregation machinery component ch14] [gn:ch14:ctf17:yd9320a] [gtcfc:10.1:10.2:12.8] [kegfc:14.2] [sgdfc:3.8.0.9.5.0] [db:gtc-saccharomyces cerevisiae] |
| CONTIG4619 | 12506512_f2_4 | 4676 | 18779 | 564 | 188 | YDR254W | 208 | 2.8(10)-16 | Saccharomyces cerevisiae | [ui:ydr254w] [pn:chromosome segregation protein:putative cell segregation machinery component ch14] [gn:ch14:ctf17:yd9320a] [gtcfc:10.1:10.2:12.8] [kegfc:14.2] [sgdfc:3.8.0.9.5.0] [db:gtc-saccharomyces cerevisiae] |
| CONTIG1848 | 10814002_c1_2 | 4677 | 18780 | 210 | 70 | YDR257C | 97 | 0.00034 | Saccharomyces cerevisiae | [ui:ydr257c] [pn:regulatory protein] [gn:rms1] [gtcfc:10.1:10.2] [kegfc:14.2] [sgdfc:4.8.2.9.5.0] [db:gtc-saccharomyces cerevisiae] |
| CONTIG3873 | 120157_c2_3 | 4678 | 18781 | 1167 | 389 | YDR257C | 253 | 1.8(10)-40 | Saccharomyces cerevisiae | [ui:ydr257c] [pn:regulatory protein] [gn:rms1] [gtcfc:10.1:10.2] [kegfc:14.2] [sgdfc:4.8.2.9.5.0] [db:gtc-saccharomyces cerevisiae] |
| CONTIG1274 | 9797251_f1_1 | 4679 | 18782 | 762 | 254 | YDR285W | 94 | 0.14999 | Saccharomyces cerevisiae | [ui:ydr285w] [pn:synaptonemal complex protein:synaptonemal complex protein zip1] [gn:zip1:d9819] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4344 | 12118760_c2_8 | 4680 | 18783 | 543 | 181 | YDR285W | 113 | 0.00036 | Saccharomyces cerevisiae | [gtcfc:10.1:10.2:12.8] [keggfc:14.2] [sgdfc:3.5.0:3.8.0:9.5.0:9.6.0] [db:gtc-saccharomyces cerevisiae] [ui:ydr285w] [pn:synaptonemal complex protein:synaptonemal complex protein zip1] [gn:zip1:d9819] |
| CONTIG4822 | 30117187_c2_12 | 4681 | 18784 | 1350 | 450 | YDR285W | 106 | 0.023 | Saccharomyces cerevisiae | [gtcfc:10.1:10.2:12.8] [keggfc:14.2] [sgdfc:3.5.0:3.8.0:9.5.0:9.6.0] [db:gtc-saccharomyces cerevisiae] [ui:ydr285w] [pn:synaptonemal complex protein:synaptonemal complex protein zip1] [gn:zip1:d9819] |
| CONTIG5780 | 16147626_f1_1 | 4682 | 18785 | 405 | 135 | YDR285W | 93 | 0.01499 | Saccharomyces cerevisiae | [gtcfc:10.1:10.2:12.8] [keggfc:14.2] [sgdfc:3.5.0:3.8.0:9.5.0:9.6.0] [db:gtc-saccharomyces cerevisiae] [ui:ydr285w] [pn:synaptonemal complex protein:synaptonemal complex protein zip1] [gn:zip1:d9819] |
| CONTIG270 | 10005011_c3_2 | 4683 | 18786 | 387 | 129 | YDR301W | 234 | 3.0(10)-18 | Saccharomyces cerevisiae | [db:gtc-saccharomyces cerevisiae] [ui:ydr301w] [pn:pre-mrna 3"-end processing factor cf ii] [gn:cft1] [gtcfc:10.1:10.2:10.9] [keggfc:14.2] [sgdfc:4.10.0:9.5.0] |
| CONTIG3074 | 4892288_c3_6 | 4684 | 18787 | 1587 | 529 | YDR301W | 694 | 4.5(10)-74 | Saccharomyces cerevisiae | [db:gtc-saccharomyces cerevisiae] [ui:ydr301w] [pn:pre-mrna 3"-end processing factor cf ii] [gn:cft1] [gtcfc:10.1:10.2:10.9] [keggfc:14.2] [sgdfc:4.10.0:9.5.0] |
| CONTIG3248 | 29882938_f1_2 | 4685 | 18788 | 1107 | 369 | YDR301W | 185 | 8.5(10)-18 | Saccharomyces cerevisiae | [db:gtc-saccharomyces cerevisiae] [ui:ydr301w] [pn:pre-mrna 3"-end processing factor cf ii] [gn:cft1] [gtcfc:10.1:10.2:10.9] [keggfc:14.2] [sgdfc:4.10.0:9.5.0] |
| b2x18140.y | 26375442_f1_1 | 4686 | 18789 | 465 | 155 | YDR301W | 141 | 2.3(10)-8 | Saccharomyces cerevisiae | [db:gtc-saccharomyces cerevisiae] [ui:ydr301w] [pn:pre-mrna 3"-end processing factor cf ii] [gn:cft1] [gtcfc:10.1:10.2:10.9] [keggfc:14.2] [sgdfc:4.10.0:9.5.0] |
| CONTIG4614 | 33773307_c2_6 | 4687 | 18790 | 672 | 224 | YDR308C | 165 | 2.0(10)-12 | Saccharomyces cerevisiae | [ui:ydr308c] [pn:dna-directed |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | polymerase ii holoenzyme and kornberg's mediator srb subcomplex subunit:suppressor of rna polymerase b srb7 [gn:srb7:d9740] [gtcfc:10.1:10.2] [keggfc:14.2] [sgdfc:4.8.1:9.5.0] [db:gtc-saccharomyces c |
| CONTIG5785 | 7228218_c3_34 | 4688 | 18791 | 1716 | 572 | YDR311W | 433 | 6.4(10)-58 | Saccharomyces cerevisiae | [ui:ydr311w] [pn:tfiih subunit:transcription initiation factor, 75 kd:rna polymerase ii transcription factor b 73 kd subunit] [gn:tfb1:d9740] [gtcfc:10.1:10.10:10.2] [keggfc:14.2] [sgdfc:4.8.1:9.5.0:11.2.1] [db:gtc-saccharomyces cerev |
| CONTIG5785 | 21875078_c1_24 | 4689 | 18792 | 423 | 141 | YDR311W | 125 | 4.7(10)-7 | Saccharomyces cerevisiae | [ui:ydr311w] [pn:tfiih subunit:transcription initiation factor, 75 kd:rna polymerase ii transcription factor b 73 kd subunit] [gn:tfb1:d9740] [gtcfc:10.1:10.10:10.2] [keggfc:14.2] [sgdfc:4.8.1:9.5.0:1.2.1] [db:gtc-saccharomyces cerev |
| CONTIG4764 | 9782136_f1_1 | 4690 | 18793 | 549 | 183 | YDR328C | 469 | 1.5(10)-54 | Saccharomyces cerevisiae | [ui:ydr328c] [pn:kinetochore protein complex cbf3, subunit d:centromere dna-binding protein complex cbf3 subunit d:suppressor of kinetochore protein 1] [gn:cbf3d:skp1:d9798] [gtcfc:10.1:10.2:12.8] [keggfc:14.2] [sgdfc:3.8.0:9.5.0:9.6. |
| CONTIG1200 | 1267200_f2_1 | 4691 | 18794 | 714 | 238 | YDR356W | 132 | 3.3(10)-6 | Saccharomyces cerevisiae | [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8.0:9.3.0:9.5.0] [db:gtc-saccharomyces cerevisiae] |
| CONTIG3798 | 2909500_f3_5 | 4692 | 18795 | 690 | 230 | YDR356W | 106 | 0.00719 | Saccharomyces cerevisiae | [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8.0:9.3.0:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4570 | 4800451_f2_3 | 4693 | 18796 | 1449 | 483 | YDR356W | 102 | 0.05299 | *Saccharomyces cerevisiae* | *saccharomyces cerevisiae* [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8:0:9.3:0:9.5.0] [db:gtc-saccharomyces cerevisiae] |
| CONTIG4836 | 15042311_c3_6 | 4694 | 18797 | 900 | 300 | YDR356W | 98 | 0.095 | *Saccharomyces cerevisiae* | *saccharomyces cerevisiae* [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8:0:9.3:0:9.5.0] [db:gtc-saccharomyces cerevisiae] |
| CONTIG4987 | 30352067_f1_3 | 4695 | 18798 | 2775 | 925 | YDR356W | 315 | 1.7(10)-24 | *Saccharomyces cerevisiae* | *saccharomyces cerevisiae* [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8:0:9.3:0:9.5.0] [db:gtc-saccharomyces cerevisiae] |
| CONTIG5315 | 991577_f3_5 | 4696 | 18799 | 1011 | 337 | YDR356W | 95 | 0.22 | *Saccharomyces cerevisiae* | *saccharomyces cerevisiae* [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8:0:9.3:0:9.5.0] [db:gtc-saccharomyces cerevisiae] |
| CONTIG5767 | 6034681_c1_33 | 4697 | 18800 | 2166 | 722 | YDR356W | 128 | 0.00017 | *Saccharomyces cerevisiae* | *saccharomyces cerevisiae* [ui:ydr356w] [pn:spindle pole body component:nuf1 protein:spindle poly body spacer protein spc110] [gn:nuf1:spc110:d9476] [gtcfc:10.1:10.2:12.16:12.8] [keggfc:14.2] [sgdfc:3.8:0:9.3:0:9.5.0] [db:gtc-saccharomyces cerevisiae] |
| CONTIG3581 | 954436_f1_1 | 4698 | 18801 | 813 | 271 | YDR364C | 451 | 2.7(10)-49 | *Saccharomyces cerevisiae* | *saccharomyces cerevisiae* [ui:ydr364c] [pn:cell division control protein:cell division control protein 40] [gn:cdc40:xrs2] [gtcfc:10.1:10.2:10.8:12.8] [keggfc:14.2] [sgdfc:3.6:0:3.8:0:9.5.0] [db:gtc-saccharomyces cerevisiae] |
| CONTIG2012 | 2922000_f3_2 | 4699 | 18802 | 984 | 328 | YDR390C | 685 | 7.7(10)-76 | *Saccharomyces cerevisiae* | *saccharomyces cerevisiae* [ui:ydr390c] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4290 | 875288_c2_9 | 4700 | 18803 | 777 | 259 | YDR390C | 175 | 2.0(10)-12 | Saccharomyces cerevisiae | ubalp and human ubiquitin-activating enzyme e1:ubiquitin-activating enzyme e1-like:polymerase-interacting protein 2] [gn:uba2:ua11:pip2:d9509] [gtcfc:10.1:10.11:10.2:10.9] [keggfc:14.2] [sgdfc:4.10.0:6.5 [ui:ydr390c] [pn:similarity to ubalp and human ubiquitin-activating enzyme e1:ubiquitin-activating enzyme e1-like:polymerase-interacting protein 2] [gn:uba1:ua11:pip2:d9509] [gtcfc:10.1:10.11:10.2:10.9] [keggfc:14.2] [sgdfc:4.10.0:6.5 |
| CONTIG2068 | 4102290_f2_1 | 4701 | 18804 | 828 | 276 | YDR392W | 784 | 5.0(10)-78 | Saccharomyces cerevisiae | [ui:ydr392w] [pn:regulatory protein:spt3 protein:positive regulator of ty transcription] [gn:spt3:d9509] [gtcfc:10.1:10.2:12.9] [keggfc:14.2] [sgdfc:3.3.0:4.8.2:9.5.0] [db:gtc-saccharomyces cerevisiae] |
| CONTIG5754 | 29554682_c3_37 | 4702 | 18805 | 1026 | 342 | YDR432W | 237 | 1.3(10)-19 | Saccharomyces cerevisiae | [ui:ydr432w] [pn:nucleolar protein:nucleolar protein:mitochondrial targeting suppressor 1 protein] [gn:nop3:mts1:d9461] [gtcfc:10.1:10.2:10.3:10.7:11.1:12.3] [keggfc:14.2] [sgdfc:4.2.0:4.11.0:6.2.0:8.1.0:9.5.0] [db:gtc-saccharom |
| CONTIG3941 | 605208_f2_1 | 4703 | 18806 | 2769 | 923 | YDR443C | 119 | 1.8(10)-12 | Saccharomyces cerevisiae | [ui:ydr443c] [pn:dna-directed rna polymerase ii holoenzyme and kornberg"s mediator:srb subcomplex subunit:suppressor of rna polymerase b srb9:sca1 protein] [gn:srb9:sca1:ssn2] [gtcfc:10.1:10.2:12.13] [keggfc:14.2] [sgdfc:1.5.2:4.8.1.9 |
| CONTIG5734 | 9792001_f1_2 | 4704 | 18807 | 1734 | 578 | YDR443C | 262 | 4.9(10)-19 | Saccharomyces cerevisiae | [ui:ydr443c] [pn:dna-directed rna polymerase ii holoenzyme and kornberg"s mediator:srb subcomplex subunit:suppressor of rna polymerase b srb9:sca1 protein] [gn:srb9:sca1:ssn2] [gtcfc:10.1:10.2:12.13] [keggfc:14.2] [sgdfc:1.5.2:4.8.1.9 |
| CONTIG2067 | 33364063_c3_8 | 4705 | 18808 | 630 | 210 | YDR448W | 369 | 4.7(10)-34 | Saccharomyces | [ui:ydr448w] [pn:transcriptional |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2067 | 20507813_c1_6 | 4706 | 18809 | 768 | 256 | YDR448W | 803 | 4.7(10)-80 | Saccharomyces cerevisiae | [ui:ydr448w] [pn:transcriptional adaptor:potential transcriptional adaptor] [gn:ada2:d9461] [gtcfc:10.1:10.2] [keggfc:4.2] [sgdfc:4.8.2:9.5.0] [db:gtc-saccharomyces cerevisiae] |
| CONTIG3191 | 4945755_f2_1 | 4707 | 18810 | 1497 | 499 | YEL061C | 463 | 1.8(10)-47 | Saccharomyces cerevisiae | [ui:yel061c] [pn:kinesin-related protein:kinesin-like protein cin8] [gn:cin8:ks12] [gtcfc:10.1:10.2:12.16:12.8] [keggfc:14.2] [sgdfc:3.8.0:9.3.0:9.5.0] [db:gtc-saccharomyces cerevisiae] |
| CONTIG5049 | 14537503_f2_4 | 4708 | 18811 | 1083 | 361 | YEL037C | 297 | 3.2(10)-35 | Saccharomyces cerevisiae | [ui:yel037c] [pn:nucleotide excision repair protein:uv excision repair protein rad23] [gn:rad23:sygp-orf29] [gtcfc:10.1:10.10.2] [keggfc:9.5.0:11.2.1] [db:gtc-saccharomyces cerevisiae] |
| CONTIG1546 | 250700_c1_3 | 4709 | 18812 | 798 | 266 | YEL032W | 315 | 4.0(10)-27 | Saccharomyces cerevisiae | [ui:yel032w] [pn:replication initiation protein:minichromosome maintenance protein 3] [gn:mcm3:sygp-orf23] [gtcfc:10.1:10.2:10.8] [keggfc:14.2] [sgdfc:3.6.0:9.5.0] [db:gtc-saccharomyces cerevisiae] |
| CONTIG2343 | 10022567_c3_5 | 4710 | 18813 | 186 | 62 | YEL032W | 98 | 0.00062 | Saccharomyces cerevisiae | [ui:yel032w] [pn:replication initiation protein:minichromosome maintenance protein 3] [gn:mcm3:sygp-orf23] [gtcfc:10.1:10.2:10.8] [keggfc:4.2] [sgdfc:3.6.0:9.5.0] [db:gtc-saccharomyces cerevisiae] |
| CONTIG2767 | 26600302_c1_2 | 4711 | 18814 | 1305 | 435 | YEL032W | 1162 | 1.8(10)-125 | Saccharomyces cerevisiae | [ui:yel032w] [pn:replication initiation protein:minichromosome maintenance protein 3] [gn:mcm3:sygp-orf23] [gtcfc:10.1:10.2:10.8] [keggfc:14.2] [sgdfc:3.6.0:9.5.0] [db:gtc-saccharomyces cerevisiae] |
| CONTIG4538 | 79808_c3_4 | 4712 | 18815 | 945 | 315 | YEL009C | 239 | 2.7(10)-20 | Saccharomyces cerevisiae | [ui:yel009c] [pn:transcriptional activator of amino acid biosynthetic genes:general control |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1851 | 5175257_c1_2 | 4713 | 18816 | 1176 | 392 | YER013W | 346 | 2.6(10)-30 | Saccharomyces cerevisiae | protein gcn4:amino acid biosynthesis regulatory protein] [gn:gcn4:arg9:aas3] [gcfc:10.1:10.2] [keggfc:14.2] [sgdfc:1.1.2:4.8.2:9.5.0] [db:gtc [ui:yer013w] [pn:pre-mrna splicing factor:pre-mrna splicing factor rna helicase] [gn:prp22] [gcfc:10.1:10.2] [keggfc:14.2] [sgdfc:4.9.0:9.5.0] [db:gtc-saccharomyces cerevisiae] |
| CONTIG5798 | 7120932_c3_41 | 4714 | 18817 | 1857 | 619 | YER013W | 2018 | 8.5(10)-209 | Saccharomyces cerevisiae | [ui:yer013w] [pn:pre-mrna splicing factor:pre-mrna splicing factor rna helicase] [gn:prp22] [gcfc:10.1:10.2] [keggfc:14.2] [sgdfc:4.9.0:9.5.0] [db:gtc-saccharomyces cerevisiae] |
| CONTIG5798 | 22454051_c2_35 | 4715 | 18818 | 1287 | 429 | YER013W | 314 | 8.3(10)-52 | Saccharomyces cerevisiae | [ui:yer013w] [pn:pre-mrna splicing factor:pre-mrna splicing factor rna helicase] [gn:prp22] [gcfc:10.1:10.2] [keggfc:14.2] [sgdfc:4.9.0:9.5.0] [db:gtc-saccharomyces cerevisiae] |
| CONTIG4666 | 2401009_c1_10 | 4716 | 18819 | 558 | 186 | YER013W | 248 | 75(10)-20 | Saccharomyces cerevisiae | [ui:yer013w] [pn:pre-mrna splicing factor:pre-mrna splicing factor rna helicase] [gn:prp22] [gcfc:10.1:10.2] [keggfc:14.2] [sgdfc:4.9.0:9.5.0] [db:gtc-saccharomyces cerevisiae] |
| CONTIG5728 | 23649056_f2_8 | 4717 | 18820 | 1467 | 489 | YER022W | 457 | 4.5(10)-43 | Saccharomyces cerevisiae | [ui:yer022w] [pn:dna-directed rna polymerase ii holoenzyme and kornberg"s mediator:srb subcomplex subunit:suppressor of rna polymerase b] [gn:srb4] [gcfc:10.1:10.2] [keggfc:14.2] [sgdfc:4.8.1:9.5.0] [db:gtc-saccharomyces cerevisiae] |
| CONTIG5601 | 26605093_c2_27 | 4718 | 18821 | 858 | 286 | YLR045C | 114 | 1.2(10)-9 | Saccharomyces cerevisiae | [ui:yer045c] [pn:weak similarity to transcription factor skolp:hypothetical 54.6 kd protein in mei4-caj1 intergenic region] [gcfc:10.2] [keggfc:14.2] [sgdfc:9.5.0:13.0.0] [db:gtc-saccharomyces cerevisiae] |
| CONTIG5813 | 34422150_f3_28 | 4719 | 18822 | 1734 | 578 | YER068W | 737 | 4.7(10)-73 | Saccharomyces cerevisiae | [ui:yer068w] [pn:transcriptional repressor:general negative regulator of transcription subunit 4] [gn:not4:mot2:ssf1:sig1:cc11] [gcfc:1.10.2:12.9] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3009 | 12580327_c2_6 | 4720 | 18823 | 774 | 258 | YER088C | 248 | 3.1(10)-20 | Saccharomyces cerevisiae | [keggfc:14.2] [sgdfc:3.3.0:4.8.2:9.5.0] [db:gtc-saccharomyces cerevisiae] [ui:yre088c] [pn:weak similarity human transforming proteins:b-myb:hypothetical 73.0 kd protein in seb1-trp2 intergenic region] [gtcfc:10.1:10.2] [keggfc:14.2] [sgdfc:4.8.2:9.5.0] [db:gtc-saccharomyces cerevisiae] |
| CONTIG3394 | 10442711_f2_2 | 4721 | 18824 | 651 | 217 | YER095W | 866 | 1.0(10)-86 | Saccharomyces cerevisiae | [ui:yer095w] [pn:dna repair protein] [gn:rad51] [gtcfc:10.1:10.10:10.2:10.8:12.9] [keggfc:4.2] [sgdfc:3.3.0:3.7.0:9.5.0:11.2.1] [db:gtc-saccharomyces cerevisiae] |
| CONTIG5655 | 468950_c3_21 | 4722 | 18825 | 1152 | 384 | YER107C | 159 | 2.8(10)-9 | Saccharomyces cerevisiae | [ui:yer107c] [pn:required for nuclear pore complex structure and function:hypothetical 40.5 kd protein in nup157-pdh5 intergenic region] [gn:gle2] [gtcfc:10.1:10.2:12.3] [keggfc:14.2] [sgdfc:4.11.0:8.1.0:9.2.0:9.5.0] [db:gtc-saccharom |
| CONTIG3390 | 14113300_c1_2 | 4723 | 18826 | 1773 | 591 | YER111C | 114 | 0.00449 | Saccharomyces cerevisiae | [ui:yer111c] [pn:transcription factor:regulatory protein swi4:cell-cycle box factor, chain swi4:art1 protein] [gn:swi4:art1] [gtcfc:10.1:10.2:12.8] [keggfc:13.1] [sgdfc:3.8.0:4.8.2:9.5.0] [db:gtc-saccharomyces cerevisiae] |
| CONTIG3587 | 433332_f2_1 | 4724 | 18827 | 711 | 237 | YER111C | 194 | 4.0(10)-14 | Saccharomyces cerevisiae | [ui:yer111c] [pn:transcription factor:regulatory protein swi4:cell-cycle box factor, chain swi4:art1 protein] [gn:swi4:art1] [gtcfc:10.1:10.2:12.8] [keggfc:13.1] [sgdfc:3.8.0:4.8.2:9.5.0] [db:gtc-saccharomyces cerevisiae] |
| CONTIG2567 | 20319501_f2_3 | 4725 | 18828 | 390 | 130 | YER112W | 196 | 1.0(10)-15 | Saccharomyces cerevisiae | [ui:yer112w] [pn:u6 snrna-associated protein] [gn:uss1:sdb23] [gtcfc:10.1:10.2] [keggfc:14.2] [sgdfc:4.9.0:9.5.0] [db:gtc-saccharomyces cerevisiae] |
| CONTIG2741 | 598342_c3_12 | 4726 | 18829 | 1455 | 485 | YER122C | 488 | 5.5(10)-71 | Saccharomyces cerevisiae | [ui:yer122c] [pn:zinc finger protein] [gn:glo3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5574 | 7226587_f1_1 | 4727 | 18830 | 951 | 317 | YER142C | 398 | 4.0(10)-37 | Saccharomyces cerevisiae | [gtcfc:10.1:10.2:12.8] [keggfc:14.2] [sgdfc:3.8:0:4.8.2:9.5.0] [db:gtc-saccharomyces cerevisiae] [ui:yer142c] [pn:dna-3-methyladenine glycosidase;3-methyladenine dna glycosylase] [gn:mag1:mag] [gtcfc:10.1:10.10:10.2:14.1] [ec:3.2.2.21] [keggfc:14.1] [sgdfc:9.5:0.11.2.1] [db:gtc-saccharomyces cerevisiae] |
| CONTIG4776 | 15718812_f3_4 | 4728 | 18831 | 759 | 253 | YLR148W | 813 | 4.2(10)-81 | Saccharomyces cerevisiae | [ui:yer148w] [pn:tfiid and tfiiib subunit.;transcription initiation factor tfiid:tata-box factor:tata sequence-binding protein:tbp:transcription factor d] [gn:spt15:btf1] [gtcfc:10.1:10.2:10.3] [keggfc:14.2] |
| CONTIG2031 | 16485801_f3_4 | 4729 | 18832 | 1038 | 346 | YER161C | 163 | 1.1(10)-11 | Saccharomyces cerevisiae | [sgdfc:4.1:0:4.4.0:4.8.1.9] [ui:yer161c] [pn:multifunctional hmg-like chromatin protein;spt2 protein;negative regulator of ty transcription] [gn:sp12:spm2:sin1] [gtcfc:10.1:10.2] [keggfc:14.2] [sgdfc:4.8.2:9.5.0:9.6.0] [db:gtc-saccharomyces cerevisiae] |
| CONTIG2681 | 20410150_f1_1 | 4730 | 18833 | 1179 | 393 | YER162C | 476 | 7.0(10)-45 | Saccharomyces cerevisiae | [ui:yer162c] [pn:excision repair protein;dna repair protein] [gn:rad4] [gtcfc:10.1:10.10:10.2] [keggfc:14.2] [sgdfc:9.5.0.11.2.1] [db:gtc-saccharomyces cerevisiae] |
| CONTIG4672 | 35798416_c3_9 | 4731 | 18834 | 774 | 258 | YER162C | 279 | 1.8(10)-23 | Saccharomyces cerevisiae | [ui:yer162c] [pn:excision repair protein;dna repair protein] [gn:rad4] [gtcfc:10.1:10.10:10.2] [keggfc:14.2] [sgdfc:9.5.0.11.2.1] [db:gtc-saccharomyces cerevisiae] |
| CONTIG4715 | 9930401_f3_6 | 4732 | 18835 | 894 | 298 | YER165W | 574 | 8.9(10)-56 | Saccharomyces cerevisiae | [ui:yer165w] [pn:mrna polyadenylate-binding protein;polyadenylate-binding protein, cytoplasmic and nuclear;pabp:ars consensus binding protein acbp-67;polyadenylate tail-binding protein] [gn:pab1] [gtcfc:10.1:10.2:10.7:10.9] [keggfc:14] |
| CONTIG479 | 10975405_f2_1 | 4733 | 18836 | 531 | 177 | YER165W | 509 | 6.9(10)-49 | Saccharomyces cerevisiae | [ui:yer165w] [pn:mrna polyadenylate-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4129 | 30085927_c1_12 | 4734 | 18837 | 2121 | 707 | YER171W | 2837 | 1.3(10)-295 | *Saccharomyces cerevisiae* | protein:polyadenylate-binding protein, cytoplasmic and nuclear:pabp:ars consensus binding protein acbp-67:polyadenylate tail-binding protein] [gn:pab1] [gtcfc:10.1:10.2:10.7:10.9] [keggfc:14] [ui:yer171w] [pn:dna helicase/atpase:dna repair helicase rad3] [gn:rad3:rem1] [gtcfc:10.1:10.10.2] [keggfc:14.2] [sgdfc:4.8.1.9.5.0:11.2.1] [db:gtc-saccharomyces cerevisiae] |
| CONTIG1980 | 36226442_f2_2 | 4735 | 18838 | 564 | 188 | YER179W | 767 | 3.1(10)-76 | *Saccharomyces cerevisiae* | [ui:yer179w] [pn:meiosis-specific protein:meiotic recombination protein dmc1] [gn:dmc1:isc2] [gtcfc:10.1:10.2:10.8:12.8] [keggfc:14.2] [sgdfc:3.5.0:3.7.0:3.8.0:9.5.0] [db:gtc-saccharomyces cerevisiae] |
| CONTIG820 | 6423252_f1_1 | 4736 | 18839 | 711 | 237 | YER184C | 98 | 0.021 | *Saccharomyces cerevisiae* | [ui:yer184c] [pn:similarity to multidrug resistance proteins pdr3p and pdr1p:putative 91.1 kd transcriptional regulatory protein in isc10 3''region] [gtcfc:10.1:10.2] [keggfc:14.2] [sgdfc:4.8.2.9.5.0] [db:gtc-saccharomyces cerevisiae] |
| CONTIG2763 | 2736251_f1_1 | 4737 | 18840 | 744 | 248 | YFL031W | 230 | 2.5(10)-19 | *Saccharomyces cerevisiae* | [ui:yfl031w] [pn:transcription factor:hac1 protein] [gn:hac1:ire2] [gtcfc:10.1:10.2] [keggfc:14.2] [sgdfc:4.8.2.9.5.0] [db:gtc-saccharomyces cerevisiae] |
| CONTIG5803 | 14488952_c1_20 | 4738 | 18841 | 1416 | 472 | YFL008W | 831 | 1.5(10)-82 | *Saccharomyces cerevisiae* | [ui:yfl008w] [pn:chromosome segregation protein:chromosome segregation protein smc1:da-box protein smc1] [gn:smc1:chl10] [gtcfc:10.1:10.2:12.8] [keggfc:14.2] [sgdfc:3.8.0:9.5.0] [db:gtc-saccharomyces cerevisiae] |
| CONTIG5803 | 10656932_c3_33 | 4739 | 18842 | 2379 | 793 | YFL008W | 1224 | 1.2(10)-124 | *Saccharomyces cerevisiae* | [ui:yfl008w] [pn:chromosome segregation protein:chromosome segregation protein smc1:da-box protein smc1] [gn:smc1:chl10] [gtcfc:10.1:10.2:12.8] [keggfc:14.2] [sgdfc:3.8.0:9.5.0] [db:gtc-saccharomyces cerevisiae] |
| CONTIG5276 | 14631563_f1_2 | 4740 | 18843 | 2481 | 827 | YFL003C | 1155 | 23(10)-17 | *Saccharomyces cerevisiae* | [ui:yfl003c] [pn:meiosis-specific protein:muts protein homolog 4] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | [gn:msh4] [gtcfc:10.1:10.2:10.8:12.8] [keggfc:14.2] [sgdfc:3.5.0:3.7.0:9.5.0] [db:gtc-saccharomyces cerevisiae] |
| CONTIG413 | 33406877_c3_5 | 4741 | 18844 | 489 | 163 | YFL002C | 344 | 8.8(10)-31 | Saccharomyces cerevisiae | [ui:yfl002c] [pn:atp-dependent rna helicase of deah box family:atp-gtcfc:10.1:10.2:10.3] [keggfc:14.2] [sgdfc:4.2.0:9.5.0] [db:gtc-saccharomyces cerevisiae] |
| CONTIG413 | 24410682_c3_4 | 4742 | 18845 | 315 | 105 | YFL002C | 216 | 7.2(10)-17 | Saccharomyces cerevisiae | [ui:yfl002c] [pn:atp-dependent rna helicase of deah box family:atp-dependent rna helicase] [gn:spb4] [gtcfc:10.1:10.2:10.3] [keggfc:14.2] [sgdfc:4.2.0:9.5.0] [db:gtc-saccharomyces cerevisiae] |
| CONTIG500 | 30367268_f1_1 | 4743 | 18846 | 384 | 128 | YFL002C | 109 | 2.2(10)-5 | Saccharomyces cerevisiae | [ui:yfl002c] [pn:atp-dependent rna helicase of deah box family:atp-dependent rna helicase] [gn:spb4] [gtcfc:10.1:10.2:10.3] [keggfc:14.2] [sgdfc:4.2.0:9.5.0] [db:gtc-saccharomyces cerevisiae] |
| CONTIG5037 | 19953762_f2_2 | 4744 | 18847 | 1233 | 411 | YFR002W | 367 | 7.7(10)-33 | Saccharomyces cerevisiae | [ui:yfr002w] [pn:nuclear pore protein:96 kd nucleoporin-interacting component] [gn:nic96] [gtcfc:10.1:10.2] [keggfc:14.2] [sgdfc:8.1.0:9.5.0] [db:gtc-saccharomyces cerevisiae] |
| CONTIG5037 | 24062751_f3_3 | 4745 | 18848 | 1839 | 613 | YFR002W | 608 | 2.2(10)-59 | Saccharomyces cerevisiae | [ui:yfr002w] [pn:nuclear pore protein:96 kd nucleoporin-interacting component] [gn:nic96] [gtcfc:10.1:10.2] [keggfc:14.2] [sgdfc:8.1.0:9.5.0] [db:gtc-saccharomyces cerevisiae] |
| CONTIG4980 | 1195277_c1_5 | 4746 | 18849 | 2469 | 823 | YFR031C | 1751 | 1.7(10)-180 | Saccharomyces cerevisiae | [ui:yfr031c] [pn:chromosome segregation protein:da-box protein] [gn:smc2] [gtcfc:10.1:10.2:12.8] [keggfc:14.2] [sgdfc:3.8.0:9.5.0] [db:gtc-saccharomyces cerevisiae] |
| CONTIG5730 | 22141556_c2_13 | 4747 | 18850 | 903 | 301 | YFR031C | 1054 | 1.2(10)-106 | Saccharomyces cerevisiae | [ui:yfr031c] [pn:chromosome segregation protein:da-box protein] [gn:smc2] [gtcfc:10.1:10.2:12.8] [keggfc:14.2] [sgdfc:3.8.0:9.5.0] [db:gtc-saccharomyces cerevisiae] |
| CONTIG3742 | 13846061_c1_7 | 4748 | 18851 | 711 | 237 | YFR034C | 109 | 0.00023 | Saccharomyces cerevisiae | [ui:yfr034c] [pn:transcription factor:phosphate system positive regulatory protein] [gn:pho4] [gtcfc:10.1:10.2:12.8:13.10] [keggfc:13.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1011 | 26172255_c2_3 | 4749 | 18852 | 840 | 280 | YGL251C | 443 | 9.0(10)-41 | Saccharomyces cerevisiae | [sgdfc:1.4.2:4.8.2:9.5.0] [db:gtc-saccharomyces cerevisiae] [ui:ygl251c] [pn:dna/rna helicase:hfm1 protein] [gn:hfm1:nre1046] [gtcfc:10.1:10.2] [keggfc:14.2] [sgdfc:4.12.0:9.5.0] [db:gtc-saccharomyces cerevisiae] |
| CONTIG5468 | 26223519_c1_13 | 4750 | 18853 | 906 | 302 | YGL251C | 170 | 8.3(10)-10 | Saccharomyces cerevisiae | [ui:ygl251c] [pn:dna/rna helicase:hfm1 protein] [gn:hfm1:nre1046] [gtcfc:10.1:10.2] [keggfc:14.2] [sgdfc:4.12.0:9.5.0] [db:gtc-saccharomyces cerevisiae] |
| b3x11387.y | 26188424_c1_4 | 4751 | 18854 | 594 | 198 | YGL251C | 441 | 1.5(10)-40 | Saccharomyces cerevisiae | [ui:ygl251c] [pn:dna/rna helicase:hfm1 protein] [gn:hfm1:nre1046] [gtcfc:10.1:10.2] [keggfc:14.2] [sgdfc:4.12.0:9.5.0] [db:gtc-saccharomyces cerevisiae] |
| CONTIG2495 | 4119381_f3_1 | 4752 | 18855 | 1392 | 464 | YGL238W | 515 | 1.2(10)-48 | Saccharomyces cerevisiae | [ui:ygl238w] [pn:probable kinetochore protein:chromosome segregation protein] [gn:cse1] [gtcfc:10.1:10.2:12.8] [keggfc:14.2] [sgdfc:3.8.0:9.50:9.6.0] [db:gtc-saccharomyces cerevisiae] |
| CONTIG4965 | 25428812_c2_7 | 4753 | 18856 | 192 | 64 | YGL238W | 161 | 1.2(10)-10 | Saccharomyces cerevisiae | [ui:ygl238w]0 [pn:probable kinetochore protein:chromosome segregation protein] [gn:cse1] [gtcfc:10.1:10.2:12.5] [keggfc:14.2] [sgdfc:3.8.0:9.5.0:9.6.0] [db:gtc-saccharomyces cerevisiae] |
| b9x13e15.y | 14896887_f1_1 | 4754 | 18857 | 906 | 302 | YGL238W | 641 | 1.8(10)-62 | Saccharomyces cerevisiae | [ui:ygl238w] [pn:probable kinetochore protein:chromosome segregation protein] [gn:cse1] [gtcfc:10.1:10.2:12.8] [keggfc:14.2] [sgdfc:3.8.0:9.5.0:9.6.0] [db:gtc-saccharomyces cerevisiae] |
| CONTIG2187 | 39511_f3_3 | 4755 | 18858 | 642 | 214 | YGL237C | 195 | 1.3(10)-15 | Saccharomyces cerevisiae | [ui:ygl237c] [pn:ccaat-binding factor subunit:transcriptional activator] [gn:hap2] [gtcfc:10.1:10.2] [keggfc:14.2] [sgdfc:4.8.2:9.5.0] [db:gtc-saccharomyces cerevisiae] |
| CONTIG2563 | 14882907_f3_2 | 4756 | 18859 | 840 | 280 | YGL237C | 279 | 1.6(10)-24 | Saccharomyces cerevisiae | [ui:ygl237c] [pn:ccaat-binding factor subunit:transcriptional |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2845 | 23595207_c3_4 | 4757 | 18860 | 1605 | 535 | YGL208W | 185 | 1.1(10)-11 | Saccharomyces cerevisiae | activator1 [gn:hap2] [gtcfc:10.1:10.2] [keggfc:14.2] [sgdfc:4.8.2:9.5.0] [db:gtc-saccharomyces cerevisiae [ui:ygl208w] [pn:dominant suppressor of some ts mutations in rpo21 and ppr4:sip2 protein:spm2 protein] [gn:sip2:spm2] [gtcfc:10.1:10.2] [keggfc:14.2] [sgdfc:4.8.2:9.5.0] [db:gtc-saccharomyces cerevisiae |
| CONTIG4654 | 24410451_f3_8 | 4758 | 18861 | 182 | 394 | YGL207W | 611 | 6.5(10)-59 | Saccharomyces cerevisiae | [ui:ygl207w] [pn:general chromatin factor:cell division control protein 68] [gn:cdc68:spt16:ssf1] [gtcfc:10.1:10.2:12.8] [keggfc:14.2] [sgdfc:3.8.0:4.8.3:9.5.0] [db:gtc-saccharomyces cerevisiae |
| CONTIG4654 | 9978176_f1_3 | 4759 | 18862 | 1350 | 450 | YGL207W | 1013 | 2.7(10)-102 | Saccharomyces cerevisiae | [ui:ygl207w] [pn:general chromatin factor:cell division control protein 68] [gn:cdc68:spt16:ssf1] [gtcfc:10.1:10.2:12.8] [keggfc:14.2] [sgdfc:3.8.0:4.8.3:9.5.0] [db:gtc-saccharomyces cerevisiae |
| CONTIG4654 | 1993950_f2_6 | 4760 | 18863 | 291 | 97 | YGL207W | 327 | 2.3(10)-28 | Saccharomyces cerevisiae | [ui:ygl207w] [pn:general chromatin factor:cell division control protein 68] [gn:cdc68:spt16:ssf1] [gtcfc:10.1:10.2:12.8] [keggfc:14.2] [sgdfc:3.8.0:4.8.3:9.5.0] [db:gtc-saccharomyces cerevisiae |
| CONTIG563 | 12207031_c3_5 | 4761 | 18864 | 234 | 78 | YGL207W | 209 | 9.5(10)-16 | Saccharomyces cerevisiae | [ui:ygl207w] [pn:general chromatin factor:cell division control protein 68] [gn:cdc68:spt16:ssf1] [gtcfc:10.1:10.2:12.8] [keggfc:14.2] [sgdfc:3.8.0:4.8.3:9.5.0] [db:gtc-saccharomyces cerevisiae |
| CONTIG5011 | 5120427_c3_11 | 4762 | 18865 | 1638 | 546 | YGL192W | 1023 | 2.2(10)-103 | Saccharomyces cerevisiae | [ui:ygl192w] [pn:positive transcriptional regulator ime2:transcription factor for spo8] [gn:spo8:ime4:g1337] [gtcfc:10.1:10.2:12.15] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4386 | 12000402_f1_1 | 4763 | 18866 | 1023 | 341 | YGL172W | 221 | 1.0(10)-26 | Saccharomyces cerevisiae | [sgdfc:3.4.0:4.8.2:9.5.0] [db:gtc-saccharomyces cerevisiae] [ui:ygl172w] [pn:nuclear pore protein:nucleoporin nup49/nsp49:nuclear pore protein nup49/nsp49] [gn:nup49/nsp49:g1648] [gtcfc:10.1:10.2:12.3] [keggfc:14.2] |
| b9x10w60.x | 29847157_f1_1 | 4764 | 18867 | 528 | 176 | YGL172W | 101 | 0.00012 | Saccharomyces cerevisiae | [sgdfc:4.11.0:8.1.0:9.5.0] [db:gtc-saccharomyces cerevisiae] [ui:ygl172w] [pn:nuclear pore protein:nucleoporin nup49/nsp49:nuclear pore protein nup49/nsp49] [gn:nup49/nsp49:g1648] [gtcfc:10.1:10.2:12.3] [keggfc:14.2] |
| CONTIG3057 | 12782292_f3_2 | 4765 | 18868 | 1212 | 404 | YGL166W | 118 | 5.9(10)-5 | Saccharomyces cerevisiae | [sgdfc:4.11.0:8.1.0:9.5.0] [db:gtc-saccharomyces cerevisiae] [ui:ygl166w] [pn:copper-dependent transcription factor:transcriptional activator protein ace1:copper-fist transcription factor] [gn:ace1:cup2:g1810] [gtcfc:10.1:10.2:12.6] [keggfc:14.2] |
| CONTIG1666 | 480126_f1_1 | 4766 | 18869 | 816 | 272 | YGL163C | 1014 | 2.1(10)-102 | Saccharomyces cerevisiae | [sgdfc:1.8.1:4.8.2:9.5.0] [db:gtc-saccharomyces cerevisiae] [ui:ygl163c] [pn:dna-dependent atpase of the snf2p family:dna repair and recombination protein rad54] [gn:rad54:g1821] [gtcfc:10.1:10.10:10.2:10.8:12.8] [keggfc:14.2] |
| CONTIG2995 | 11723211_c2_8 | 4767 | 18870 | 1257 | 419 | YGL163C | 486 | 3.8(10)-82 | Saccharomyces cerevisiae | [sgdfc:3.5.0:3.7.0:9.5.0:11.2.1] [db:gtc-saccharomyces cerevisiae] [ui:ygl163c] [pn:dna-dependent atpase of the snf2p family:dna repair and recombination protein rad54] [gn:rad54:g1821] [gtcfc:10.1:10.10:10.2:10.8:12.8] [keggfc:14.2] |
| b3x16060.y | 35838517_f3_1 | 4768 | 18871 | 378 | 126 | YGL163C | 129 | 2.7(10)-7 | Saccharomyces cerevisiae | [sgdfc:3.5.0:3.7.0:9.5.0:11.2.1] [db:gtc-saccharomyces cerevisiae] [ui:ygl163c] [pn:dna-dependent atpase of the snf2p family:dna repair and recombination protein rad54] [gn:rad54:g1821] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2515 | 25509687_c3_3 | 4769 | 18872 | 762 | 254 | YGL115W | 763 | 8.3(10)-76 | Saccharomyces cerevisiae | [gtcfc:10.1:10.10.2:10.8:12.8] [keggfc:14.2] [sgdfc:3.5.0:3.7.0:9.5.0:1 1.2.1] [db:gtc-saccharomyces cerevisiae] [ui:ygl115w] [pn:nuclear regulatory protein:nuclear protein snf4:regulatory protein cat3] [gn:snf4:cat3] [gtcfc:10.1:10.2:12.12.13:13.2] [keggfc:14.2] [sgdfc:1.5.2:4.8.2:9.5.0:11.1.0] [db:gtc-saccharomyces cerevisiae] |
| CONTIG2496 | 33754007_c1_5 | 4770 | 18873 | 906 | 302 | YGL112C | 653 | 3.7(10)-64 | Saccharomyces cerevisiae | [ui:ygl112c] [pn:tfiid subunit:tbp-associated protein complex, 60 kd:transcription initiation factor tfiid 60 kd subunit:tafii-60] [gn:taf60:g2985] [gtcfc:10.1:10.2] [keggfc:14.2] [sgdfc:4.8.1:9.5.0] [db:gtc-saccharomyces cerevisiae] |
| CONTIG4476 | 31921888_f1_1 | 4771 | 18874 | 528 | 176 | YGL112C | 95 | 0.01099 | Saccharomyces cerevisiae | [ui:ygl112c] [pn:tfiid subunit:tbp-associated protein complex, 60 kd:transcription initiation factor tfiid 60 kd subunit:tafii-60] [gn:taf60:g2985] [gtcfc:10.1:10.2] [keggfc:14.2] [sgdfc:4.8.1:9.5.0] [db:gtc-saccharomyces cerevisiae] |
| CONTIG5761 | 33207500_c1_18 | 4772 | 18875 | 1140 | 380 | YGL100W | 735 | 9.0(10)-94 | Saccharomyces cerevisiae | [ui:ygl100w] [pn:nuclear pore protein] [gn:sch1] [gtcfc:10.1:10.2] [keggfc:14.2] [sgdfc:8.10.9.5.0] [db:gtc-saccharomyces cerevisiae] |
| CONTIG1734 | 15664163_f2_1 | 4773 | 18876 | 462 | 154 | YGL097W | 479 | 1.0(10)-45 | Saccharomyces cerevisiae | [ui:ygl097w] [pn:gdp/gtp exchange factor for gsp1p/gsp2p:regulator of chromosome condensation:prp20 protein:pheromone response pathway component srm1] [gn:prp20:srm1:mtr1] [gtcfc:10.1:10.2:10.3:10.6:10.9:12.3:12.8:12.9] [keggfc:13.3] |
| CONTIG4261 | 16853436_c3_6 | 4774 | 18877 | 1014 | 338 | YGL097W | 839 | 7.4(10)-84 | Saccharomyces cerevisiae | [ui:ygl097w] [pn:gdp/gtp exchange factor for gsp1p/gsp2p:regulator of chromosome condensation:prp20 protein:pheromone response pathway component srm1] [gn:prp20:srm1:mtr1] [gtcfc:10.1:10.2:10.3:10.6:10.9:12.3:12.8:12.9] [keggfc:13.3] |
| CONTIG4989 | 5254555_c3_7 | 4775 | 18878 | 1215 | 405 | YGL097W | 109 | 5.2(10)-5 | Saccharomyces cerevisiae | [ui:ygl097w] [pn:gdp/gtp exchange factor for gsp1p/gsp2p:regulator of chromosome condensation:prp20 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5116 | 14885931_c1_6 | 4776 | 18879 | 1464 | 488 | YGL097W | 134 | 1.0(10)-5 | Saccharomyces cerevisiae | protein:pheromone response pathway component srm1] [gn:prp20:srm1:mtr1] [gcfc:10.1:10.2:10.3:10.6:10.9:12.3:12.8:12.9] [keggfc:13.3] [ui:ygl097w] [pn:gdp/gtp exchange factor for gsp1p/gsp2p:regulator of chromosome condensation:prp20 protein:pheromone response pathway component srm1] [gn:prp20:srm1:mtr1] [gcfc:10.1:10.2:10.3:10.6:10.9:12.3:12.8:12.9] [keggfc:13.3] |
| CONTIG1557 | 24788942_f1_1 | 4777 | 18880 | 942 | 314 | YGL092W | 111 | 4.5(10)-7 | Saccharomyces cerevisiae | [ui:ygl092w] [pn:nucleoporin:nuclear pore protein] [gn:nup145] [gcfc:10.1:10.2:10.6:12.3] [keggfc:14.2] [sgdfc:4.5.0:4.11.0:8.1.0:9.5.0] [db:gtc-saccharomyces cerevisiae] |
| CONTIG2555 | 23524192_c3_3 | 4778 | 18881 | 1656 | 552 | YGL092W | 231 | 1.3(10)-15 | Saccharomyces cerevisiae | [ui:ygl092w] [pn:nucleoporin:nuclear pore protein] [gn:nup145] [gcfc:10.1:10.2:10.6:12.3] [keggfc:14.2] [sgdfc:4.5.0:4.11.0:8.1.0:9.5.0] [db:gtc-saccharomyces cerevisiae] |
| CONTIG2189 | 19734676_f1_2 | 4779 | 18882 | 1194 | 398 | YGL086W | 121 | 0.00029 | Saccharomyces cerevisiae | [ui:ygl086w] [pn:spindle assembly checkpoint protein:spindle assembly checkpoint component:mitotic protein] [gn:mad1] [gcfc:10.1:10.2:12.8] [keggfc:14.2] [sgdfc:3.8.0:9.5.0] [db:gtc-saccharomyces cerevisiae] |
| CONTIG2444 | 4806436_c2_3 | 4780 | 18883 | 1923 | 641 | YGL086W | 346 | 1.2(10)-28 | Saccharomyces cerevisiae | [ui:ygl086w] [pn:spindle assembly checkpoint protein:spindle assembly checkpoint component:mitotic protein] [gn:mad1] [gcfc:10.1:10.2:12.8] [keggfc:14.2] [sgdfc:3.8.0:9.5.0] [db:gtc-saccharomyces cerevisiae] |
| CONTIG5431 | 26692299_c1_9 | 4781 | 18884 | 960 | 320 | YGL078C | 1095 | 5.5(10)-111 | Saccharomyces cerevisiae | [ui:ygl078c] [pn:putative rna helicase required for pre-rrna processing:probable atp-dependent rna helicase ca3] [gn:dbp3] [gcfc:10.1:10.2:10.3] [keggfc:14.2] [sgdfc:4.2.0:9.5.0] [db:gtc-saccharomyces cerevisiae] |
| CONTIG5275 | 33407202_c1_17 | 4782 | 18885 | 915 | 305 | YGL071W | 95 | 6.5(10)-6 | Saccharomyces cerevisiae | [ui:ygl071w] [pn:iron-regulated |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | transcriptional repressor:iron-regulated transcriptional repressor aft1] [gn:aft1:rcs1] [gtcfc:10.1:10.2:12.6] [keggfc:14.2] [sgdfc:1.8.1:4.8.2:9.5.0] [db:gtc-saccharomyces cerevisiae] |
| CONTIG4253 | 12611055_c3_8 | 4783 | 18886 | 411 | 137 | YGL058W | 483 | 3.8(10)-46 | Saccharomyces cerevisiae | [ui:ygl058w] [pn:ubiquitin conjugating enzyme:ubiquitin-conjugating enzyme e2-20 kd:ubiquitin protein ligase:ubiquitin carrier protein] [gn:ubc2:rad6] [gtcfc:10.1:10.10:10.2:10.7:10.8:1 2.15:14.1] [ecc:6.3.2.19] [keggfc:14.1] [sgdfc:3. |
| CONTIG4173 | 9801537_c2_9 | 4784 | 18887 | 1122 | 374 | YGL044C | 112 | 0.00052 | Saccharomyces cerevisiae | [ui:ygl044c] [pn:component of pre-mrna 3"-end processing factor cf i:mrna 3"-end processing protein] [gn:rna15] [gtcfc:10.1:10.2:10.9] [keggfc:14.2] [sgdfc:4.10.0:9.5.0] [db:gtc-saccharomyces cerevisiae] |
| CONTIG5749 | 20742187_c2_22 | 4785 | 18888 | 837 | 279 | YGL044C | 218 | 4.7(10)-18 | Saccharomyces cerevisiae | [ui:ygl044c] [pn:component of pre-mrna 3"-end processing factor cf i:mrna 3"-end processing protein] [gn:rna15] [gtcfc:10.1:10.2:10.9] [keggfc:14.2] [sgdfc:4.10.0:9.5.0] [db:gtc-saccharomyces cerevisiae] |
| CONTIG5749 | 19615635_f3_10 | 4786 | 18889 | 939 | 313 | YGL043W | 455 | 5.5(10)-63 | Saccharomyces cerevisiae | [ui:ygl043w] [pn:tfiis:transcription elongation factor:transcription elongation factor s-ii:dna strand transfer protein alpha:stp-alpha:dna strand transferase 1:pyrimidine pathway regulator protein 2] [gn:dst1:ppr2] [gtcfc:10.1:10.2:1 |
| CONTIG1873 | 785627_f1_3 | 4787 | 18890 | 753 | 251 | YGL035C | 241 | 9.1(10)-20 | Saccharomyces cerevisiae | [ui:ygl035c] [pn:transcriptional repressor:regulatory protein mig1:regulatory protein cat4] [gn:mig1:cat4:ssn1] [gtcfc:10.1:10.2:12.13] [keggfc:14.2] [sgdfc:1.5.2:4.8.2:9.5.0] [db:gtc-saccharomyces cerevisiae] |
| CONTIG2619 | 783132_c3_9 | 4788 | 18891 | 1527 | 509 | YGL035C | 241 | 1.3(10)-18 | Saccharomyces cerevisiae | [ui:ygl035c] [pn:transcriptional repressor:regulatory protein mig1:regulatory protein cat4] [gn:mig1:cat4:ssn1] [gtcfc:10.1:10.2:12.13] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5297 | 24407812_f2_7 | 4789 | 18892 | 528 | 176 | YGL035C | 273 | 2.7(10)-23 | *Saccharomyces cerevisiae* | [sgdfc:1.5.2:4.8.2:9.5.0] [db:gtc-*saccharomyces cerevisiae*] [ui:ygl035c] [pn:transcriptional repressor:regulatory protein mig1:regulatory protein cat4] [gn:mig1:cat4:ssn1] [gtcfc:10.1:10.2:12.13] [keggfc:14.2] [sgdfc:1.5.2:4.8.2:9.5.0] [db:gtc-*saccharomyces cerevisiae*] |
| CONTIG5245 | 15630261_c3_23 | 4790 | 18893 | 909 | 303 | YGL019W | 667 | 1.2(10)-65 | *Saccharomyces cerevisiae* | [ui:ygl019w] [pn:casein kinase ii, beta subunit:casein kinase ii beta chain:ck kb1] [gn:ckb1] [gtcfc:10.1:10.2:12.13:14.1] [ec:2.7.1.37] [keggfc:14.1] [sgdfc:4.4.0:9.5.0:15.0.0] [db:gtc-*saccharomyces cerevisiae*] |
| CONTIG3649 | 260_c2_7 | 4791 | 18894 | 696 | 232 | YGL013C | 113 | 0.00027 | *Saccharomyces cerevisiae* | [ui:ygl013c] [pn:transcription factor:pleiotropic drug resistance regulatory protein 1] [gn:pdr1:ant1:bor2:cyh3:nra2:smr2] [gtcfc:10.1:10.2:12.12] [keggfc:14.2] [sgdfc:4.8.2:9.5.0:11.3.0] [db:gtc-*saccharomyces cerevisiae*] |
| CONTIG4336 | 476550_c1_7 | 4792 | 18895 | 564 | 188 | YGL013C | 117 | 6.5(10)-6 | *Saccharomyces cerevisiae* | [ui:ygl013c] [pn:transcription factor:pleiotropic drug resistance regulatory protein 1] [gn:pdr1:ant1:bor2:cyh3:nra2:smr2] [gtcfc:10.1:10.2:12.12] [keggfc:14.2] [sgdfc:4.8.2:9.5.0:11.3.0] [db:gtc-*saccharomyces cerevisiae*] |
| CONTIG1472 | 4797027_f1_1 | 4793 | 18896 | 909 | 303 | YGR005C | 325 | 2.2(10)-29 | *Saccharomyces cerevisiae* | [ui:ygr005c] [pn:tfiif subunit:transcription initiation factor, 54 kd:transcription initiation factor rif:beta subunit:tfiif-beta:tfiif medium subunit] [gn:tfg2] [gtcfc:10.1:10.2] [keggfc:14.2] |
| CONTIG1981 | 5875001_f2_2 | 4794 | 18897 | 684 | 228 | YGR006W | 123 | 4.5(10)-6 | *Saccharomyces cerevisiae* | [ui:ygr006w] [pn:u5 snrna-associated protein:pre-mrna splicing factor] [gn:prp18] [gtcfc:10.1:10.2] [keggfc:14.2] [sgdfc:4.9.0:9.5.0] [db:gtc-*saccharomyces cerevisiae*] |
| CONTIG3978 | 35332807_f1_1 | 4795 | 18898 | 1218 | 406 | YGR044C | 154 | 1.3(10)-8 | *Saccharomyces cerevisiae* | [ui:ygr044c] [pn:zinc-finger transcription factor:zinc finger |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5713 | 13706525_c3_21 | 4796 | 18899 | 351 | 117 | YGR063C | 259 | 2.1(10)-22 | Saccharomyces cerevisiae | protein] [gn:rme1] [gtcfc:10.1:10.2:12.8] [keggfc:13.1] [sgdfc:3.5.0:3.8.0:4.8.2:9.5.0] [db:gtc-saccharomyces cerevisiae] [ui:ygr063c] [pn:transcription initiation protein] [gn:spt4] [gtcfc:10.1:10.2:10.8] [keggfc:14.2] [sgdfc:3.7.0:4.8.1:4.8.3:9.5.0] [db:gtc-saccharomyces cerevisiae] |
| CONTIG5447 | 22054035_c1_13 | 4797 | 18900 | 366 | 122 | YGR074W | 100 | 1.5(10)-5 | Saccharomyces cerevisiae | [ui:ygr074w] [pn:snrna-associated protein:small nuclear ribonucleoprotein d1 homolog] [gn:smd1] [gtcfc:10.1:10.2:12.16] [keggfc:14.2] [sgdfc:4.9.0:6.4.0:9.5.0] [db:gtc-saccharomyces cerevisiae] |
| CONTIG1368 | 25502175_f2_1 | 4798 | 18901 | 942 | 314 | YGR091W | 345 | 1.5(10)-35 | Saccharomyces cerevisiae | [ui:ygr091w] [pn:pre-mrna splicing protein:pre-mrna splicing factor] [gn:prp31] [gtcfc:10.1:10.2] [keggfc:14.2] [sgdfc:4.9.0:9.5.0] [db:gtc-saccharomyces cerevisiae] |
| CONTIG3144 | 448957_f1_1 | 4799 | 18902 | 2007 | 669 | YGR098C | 237 | 5.2(10)-16 | Saccharomyces cerevisiae | [ui:ygr098c] [pn:required for normal spindle structure:protein] [gn:esp1] [gtcfc:10.1:10.2:12.8] [keggfc:14.2] [sgdfc:3.8.0:9.5.0] [db:gtc-saccharomyces cerevisiae] |
| CONTIG582 | 4695411_c1_3 | 4800 | 18903 | 735 | 245 | YGR098C | 255 | 2.2(10)-20 | Saccharomyces cerevisiae | [ui:ygr098c] [pn:required for normal spindle structure:protein] [gn:esp1] [gtcfc:10.1:10.2:12.8] [keggfc:14.2] [sgdfc:3.8.0:9.5.0] [db:gtc-saccharomyces cerevisiae] |
| CONTIG4432 | 6407830_f3_8 | 4801 | 18904 | 753 | 251 | YGR099W | 144 | 1.1(10)-7 | Saccharomyces cerevisiae | [ui:ygr099w] [pn:involved in controlling telomere length and position effect:telomer length regulation protein] [gn:tel2] [gtcfc:10.1:10.2] [keggfc:14.2] [sgdfc:9.5.0:9.6.0] [db:gtc-saccharomyces cerevisiae] |
| CONTIG4432 | 21666581_f1_1 | 4802 | 18905 | 585 | 195 | YGR099W | 103 | 0.00489 | Saccharomyces cerevisiae | [ui:ygr099w] [pn:involved in controlling telomere length and position effect:telomer length regulation protein] [gn:tel2] [gtcfc:10.1:10.2] [keggfc:14.2] [sgdfc:9.5.0:9.6.0] [db:gtc-saccharomyces cerevisiae] |
| CONTIG5789 | 6855033_c3_30 | 4803 | 18906 | 897 | 299 | YGR104C | 143 | 8.9(10)-13 | Saccharomyces cerevisiae | [ui:ygr104c] [pn:dna-directed rna polymerase ii holoenzyme and |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | kornberg's mediator:srb subcomplex subunit:supressor of rna polymerase b] [gn:srb5] [gtcfc:10.1:10.2] [keggfc:14.2] [sgdfc:4.8.1:9.5.0] [db:gtc-saccharomyces cerevisiae] |
| CONTIG801 | 26750450_c3_3 | 4804 | 18907 | 1119 | 373 | YGR116W | 501 | 1.1(10)-46 | Saccharomyces cerevisiae | [ui:ygr116w] [pn:transcription initiation protein:transcription initiation protein spt6] [gn:spt6:ssn20:cre2:g6169] [gtcfc:10.1:10.2:10.8] [keggfc:14.2] [sgdfc:3.7.0:4.8.1:4.8.3:9.5.0] [db:gtc-saccharomyces cerevisiae] |
| b2x10868.y | 10828302_f1_1 | 4805 | 18908 | 522 | 174 | YGR116W | 203 | 6.5(10)-15 | Saccharomyces cerevisiae | [ui:ygr116w] [pn:transcription initiation protein:transcription initiation protein spt6] [gn:spt6:ssn20:cre2:g6169] [gtcfc:10.1:10.2:10.8] [keggfc:14.2] [sgdfc:3.7.0:4.8.1:4.8.3:9.5.0] [db:gtc-saccharomyces cerevisiae] |
| CONTIG892 | 10347312_f1_1 | 4806 | 18909 | 606 | 202 | YGR119C | 192 | 2.2(10)-14 | Saccharomyces cerevisiae | [ui:ygr119c] [pn:nuclear pore protein:nucleoporin nup57:nuclear pore protein nup57] [gn:nup57:g6320] [gtcfc:10.1:10.2] [keggfc:14.2] [sgdfc:8.1.0:9.5.0] [db:gtc-saccharomyces cerevisiae] |
| CONTIG5795 | 16829705_c3_42 | 4807 | 18910 | 1209 | 403 | YGR159C | 698 | 6.4(10)-69 | Saccharomyces cerevisiae | [ui:ygr159c] [pn:nuclear localization sequence binding protein:p67] [gn:nsr1:g7001] [gtcfc:10.1:10.2:10.3:13.2] [keggfc:14.2] [sgdfc:4.2.0:9.5.0:11.1.0] [db:gtc-saccharomyces cerevisiae] |
| CONTIG4405 | 15019625_f1_1 | 4808 | 18911 | 1635 | 545 | YGR186W | 387 | 2.5(10)-56 | Saccharomyces cerevisiae | [ui:ygr186w] [pn:tfiif subunit:transcription initiation factor, 105 kd:transcription initiation factor iif, alpha subunit:tfiif-alpha:tfiif large subunit:transcription factor g 105 kd subunit:p105] [gn:tfg1:ssu71:g7526] [gtcfc:10.1:10.] |
| CONTIG1831 | 819637_c3_4 | 4809 | 18912 | 633 | 211 | YGR229C | 131 | 5.4(10)-7 | Saccharomyces cerevisiae | [ui:ygr229c] [pn:beta-1,3-glucan synthesis protein:smi1 protein:killer toxin resistant protein 4] [gn:smi1:knr4:ktr4:g8553] [gtcfc:10.1:10.2:12.13] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3039 | 33250311_c1_3 | 4810 | 18913 | 1296 | 432 | YGR229C | 306 | 6.0(10)-27 | Saccharomyces cerevisiae | [keggfc:14.2] [sgdfc:1.5.2:9.5.0] [db:gtc-saccharomyces cerevisiae] [ui:ygr229c] [pn:beta-1,3-glucan synthesis protein:smi1 protein:killer toxin resistant protein 4] [gn:smi1:knr4:ktr4:g8553] [gtcfc:10.1:10.2:12.13] |
| CONTIG3039 | 2907182_c3_4 | 4811 | 18914 | 426 | 142 | YGR229C | 106 | 3.7(10)-5 | Saccharomyces cerevisiae | [keggfc:14.2] [sgdfc:1.5.2:9.5.0] [db:gtc-saccharomyces cerevisiae] [ui:ygr229c] [pn:beta-1,3-glucan synthesis protein:smi1 protein:killer toxin resistant protein 4] [gn:smi1:knr4:ktr4:g8553] [gtcfc:10.1:10.2:12.13] |
| CONTIG3774 | 24432937_f1_2 | 4812 | 18915 | 693 | 231 | YGR229C | 244 | 4.2(10)-20 | Saccharomyces cerevisiae | [keggfc:14.2] [sgdfc:1.5.2:9.5.0] [db:gtc-saccharomyces cerevisiae] [ui:ygr229c] [pn:beta-1,3-glucan synthesis protein:smi1 protein:killer toxin resistant protein 4] [gn:smi1:knr4:ktr4:g8553] [gtcfc:10.1:10.2:12.13] |
| CONTIG4159 | 23829656_f3_2 | 4813 | 18916 | 1083 | 361 | YGR252W | 1398 | 4.2(10)-143 | Saccharomyces cerevisiae | [keggfc:14.2] [sgdfc:1.5.2:9.5.0] [db:gtc-saccharomyces cerevisiae] [ui:ygr252w] [pn:histone acetyltransferase:transcriptional activator gen5] [gn:gen5:ada4] [gtcfc:10.1:10.2:10.7] |
| CONTIG360 | 10757661_f1_1 | 4814 | 18917 | 948 | 316 | YGR258C | 104 | 0.024 | Saccharomyces cerevisiae | [keggfc:14.2] [sgdfc:4.8.2:4.8.3:6.3.0:9.5.0] [db:gtc-saccharomyces cerevisiae] [ui:ygr258c] [pn:structure-specific nuclease of the nucleotide excision repair:osome:dna repair protein] [gn:rad2] [gtcfc:10.1:10.10:10.2:12.8] |
| CONTIG5692 | 6812900_f1_3 | 4815 | 18918 | 447 | 149 | YGR258C | 448 | 2.5(10)-41 | Saccharomyces cerevisiae | [keggfc:14.2] [sgdfc:3.5.0:9.5.0:11.2.1] [db:gtc-saccharomyces cerevisiae] [ui:ygr258c] [pn:structure-specific nuclease of the nucleotide excision repair:osome:dna repair protein] [gn:rad2] [gtcfc:10.1:10.10:10.2:12.8] |
| CONTIG5692 | 21660937_f2_5 | 4816 | 18919 | 2385 | 795 | YGR258C | 647 | 4.2(10)-103 | Saccharomyces cerevisiae | [keggfc:14.2] [sgdfc:3.5.0:9.5.0:11.2.1] [db:gtc-saccharomyces cerevisiae] [ui:ygr258c] [pn:structure-specific nuclease of the nucleotide excision repair:osome:dna repair protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1591 | 24429567_f2_1 | 4817 | 18920 | 1089 | 363 | YGR274C | 241 | 2.0(10)-29 | Saccharomyces cerevisiae | [ui:ygr274c] [pn:tfiid subunit:tbp-associated factor, 145 kd:transcription initiation factor tfiid 145 kd subunit:tafii-145:tafii-130] [gn:taf145] [gtcfc:10.1:10.2] [keggfc:14.2] [sgdfc:4.8.1:4.8.3:9.5.0: gtcfc:10.1:10.10.2:12.8] [keggfc:14.2] [sgdfc:3.5.0:9.5.0:11.2.1] [db:gtc-saccharomyces cerevisiae] |
| CONTIG3332 | 35433287_f2_1 | 4818 | 18921 | 564 | 188 | YGR274C | 167 | 3.0(10)-11 | Saccharomyces cerevisiae | [ui:ygr274c] [pn:tfiid subunit:tbp-associated factor, 145 kd:transcription initiation factor tfiid 145 kd subunit:tafii-145:tafii-130] [gn:taf145] [gtcfc:10.1:10.2] [keggfc:14.2] [sgdfc:4.8.1:4.8.3:9.5.0: |
| b3x13754.x | 196075_c3_5 | 4819 | 18922 | 528 | 176 | YGR285C | 320 | 7.2(10)-29 | Saccharomyces cerevisiae | [ui:ygr285c] [pn:zuotin, a putative z-dna binding protein:zuotin] [gn:zuo1] [gtcfc:10.1:10.2] [keggfc:14.2] [sgdfc:9.5.0:9.6.0] [db:gtc-saccharomyces cerevisiae] |
| CONTIG5554 | 1406325_c3_21 | 4820 | 18923 | 615 | 205 | YGR288W | 134 | 3.2(10)-8 | Saccharomyces cerevisiae | [ui:ygr288w] [pn:maltose pathway regulatory protein:maltose fermentation regulatory protein mal1r] [gn:mal1r:mal13:g9591] [gtcfc:10.1:10.2:12.13] [keggfc:14.2] [sgdfc:1.5.2:4.8.2:9.5.0] [db:gtc-saccharomyces cerevisiae] |
| CONTIG4046 | 10972175_c3_8 | 4821 | 18924 | 855 | 285 | YHL034C | 116 | 6.0(10)-5 | Saccharomyces cerevisiae | [ui:yhl034c] [pn:single-strand nucleic acid binding protein:single-stranded nucleic acid-binding protein] [gn:ssbr1:ssb1:sbp1] [gtcfc:10.1:10.2:10.3] [keggfc:14.2] [sgdfc:4.2.0:9.5.0] [db:gtc-saccharomyces cerevisiae] |
| CONTIG3312 | 24298461_f2_4 | 4822 | 18925 | 342 | 114 | YHL027W | 92 | 0.0016 | Saccharomyces cerevisiae | [ui:yhl027w] [pn:meiotic regulatory protein] [gn:rim101] [gtcfc:10.1:10.2:12.8] [keggfc:14.2] |
| CONTIG3535 | 19728432_f1_1 | 4823 | 18926 | 1062 | 354 | YHL027W | 358 | 2.8(10)-32 | Saccharomyces cerevisiae | [sgdfc:3.5.0:4.8.2:9.5.0] [db:gtc-saccharomyces cerevisiae] [ui:yhl027w] [pn:meiotic regulatory protein] [gn:rim101] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3064 | 33985001_f2_3 | 4824 | 18927 | 993 | 331 | YHL022C | 139 | 8.5(10)-7 | Saccharomyces cerevisiae | [gtcfc:10.1:10.2:12.8] [keggfc:14.2] [sgdfc:3.5.0:4.8.2:9.5.0] [db:gtc-saccharomyces cerevisiae] [ui:yhl022c] [pn:meiosis specific protein:meiosis-specific sporulation protein] [gn:spo1] [gtcfc:10.1:10.2:10.8:12.8] [keggfc:14.2] [sgdfc:3.5.0:3.7.0:9.5.0] [db:gtc-saccharomyces cerevisiae] |
| CONTIG5717 | 10939550_f3_3 | 4825 | 18928 | 624 | 208 | YHR041C | 146 | 7.2(10)-10 | Saccharomyces cerevisiae | [ui:yhr041c] [pn:dna-directed rna polymerase ii holoenzyme and kornberg"s mediator:srb subcomplex subunit:supressor of rna polymerase b] [gn:srb2] [gtcfc:10.1:10.2] [keggfc:14.2] [sgdfc:4.8.1:9.5.0] [db:gtc-saccharomyces cerevisiae] |
| CONTIG5621 | 975077_f1_2 | 4826 | 18929 | 453 | 151 | YHR089C | 286 | 2.8(10)-25 | Saccharomyces cerevisiae | [ui:yhr089c] [pn:nucleolar rrna processing protein:protein] [gn:gar1] [gtcfc:10.1:10.2:10.3] [keggfc:14.2] [sgdfc:4.2.0:9.5.0] [db:gtc-saccharomyces cerevisiae] |
| CONTIG1193 | 10315750_c2_9 | 4827 | 18930 | 567 | 189 | YHR118C | 104 | 0.0002 | Saccharomyces cerevisiae | [ui:yhr118c] [pn:origin recognition complex, 50 kd subunit:origin recognition complex protein, subunit 6:origin recognition complex protein 50 kd subunit:acs associated protein 1] [gn:orc6:aap1] [gtcfc:10.1:10.2:10.8:12.8:12.9] [keggf |
| CONTIG5259 | 14472916_f2_1 | 4828 | 18931 | 2652 | 884 | YHR119W | 715 | 8.5(10)-105 | Saccharomyces cerevisiae | [ui:yhr119w] [pn:regulatory protein:hypothetical 123.9 kd protein in orc6-msh1 intergenic region] [gn:ytx1] [gtcfc:10.1:10.2] [keggfc:14.2] [sgdfc:4.8.3:9.5.0] [db:gtc-saccharomyces cerevisiae] |
| CONTIG5721 | 5864036_c2_23 | 4829 | 18932 | 258 | 86 | YHR129C | 178 | 3.5(10)-13 | Saccharomyces cerevisiae | [ui:yhr129c] [pn:centractin:actin-like protein] [gn:act5:act3] [gtcfc:10.1:10.2:12.16:12.8] [keggfc:14.2] [sgdfc:3.8.0:9.3.0:9.5.0] [db:gtc-saccharomyces cerevisiae] |
| CONTIG3192 | 4687927_c3_6 | 4830 | 18933 | 660 | 220 | YHR164C | 368 | 1.8(10)-32 | Saccharomyces cerevisiae | [ui:yhr164c] [pn:dna helicase:dna replication helicase] [gn:dna2] [gtcfc:10.1:10.2:10.8] [keggfc:14.2] [sgdfc:3.6.0:9.5.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x10687.x | 10829568_f1_1 | 4831 | 18934 | 765 | 255 | YHR164C | 231 | 7.2(10)-18 | *Saccharomyces cerevisiae* | [db:gtc-*saccharomyces cerevisiae*] [ui:yhr164c] [pn:dna helicase:dna replication helicase] [gn:dna2] [gtcfc:10.1:10.2:10.8] [keggfc:14.2] [sgdfc:3.6.0:9.5.0] |
| b2x12186.x | 444801_f3_1 | 4832 | 18935 | 519 | 173 | YHR164C | 240 | 7.9(10)-19 | *Saccharomyces cerevisiae* | [db:gtc-*saccharomyces cerevisiae*] [ui:yhr164c] [pn:dna helicase:dna replication helicase] [gn:dna2] [gtcfc:10.1:10.2:10.8] [keggfc:14.2] [sgdfc:3.6.0:9.5.0] |
| b3x15670.y | 12756438_f2_1 | 4833 | 18936 | 486 | 162 | YHR164C | 255 | 2.8(10)-25 | *Saccharomyces cerevisiae* | [db:gtc-*saccharomyces cerevisiae*] [ui:yhr164c] [pn:dna helicase:dna replication helicase] [gn:dna2] [gtcfc:10.1:10.2:10.8] [keggfc:14.2] [sgdfc:3.6.0:9.5.0] |
| CONTIG1677 | 433332_f2_1 | 4834 | 18937 | 1128 | 376 | YHR165C | 723 | 6.2(10)-70 | *Saccharomyces cerevisiae* | [db:gtc-*saccharomyces cerevisiae*] [ui:yhr165c] [pn:u5 snmp protein, pre-mrna splicing factor:pre-mrna splicing factor prp8] [gn:prp8:rna8:dbf3:dna39] [gtcfc:10.1:10.2:12.8] [keggfc:14.2] [sgdfc:3.8.0:4.9.0:9.5.0] |
| CONTIG1685 | 21521891_c1_5 | 4835 | 18938 | 846 | 282 | YHR165C | 895 | 3.1(10)-88 | *Saccharomyces cerevisiae* | [db:gtc-*saccharomyces cerevisiae*] [ui:yhr165c] [pn:u5 snmp protein, pre-mrna splicing factor:pre-mrna splicing factor prp8] [gn:prp8:rna8:dbf3:dna39] [gtcfc:10.1:10.2:12.8] [keggfc:14.2] [sgdfc:3.8.0:4.9.0:9.5.0] |
| CONTIG606 | 5900312_f3_2 | 4836 | 18939 | 1254 | 418 | YHR165C | 1602 | 7.5(10)-164 | *Saccharomyces cerevisiae* | [db:gtc-*saccharomyces cerevisiae*] [ui:yhr165c] [pn:u5 snmp protein, pre-mrna splicing factor:pre-mrna splicing factor prp8] [gn:prp8:rna8:dbf3:dna39] [gtcfc:10.1:10.2:12.8] [keggfc:14.2] [sgdfc:3.8.0:4.9.0:9.5.0] |
| b9x13c15.x | 4428442_c3_3 | 4837 | 18940 | 201 | 67 | YHR166C | 131 | 1.1(10)-7 | *Saccharomyces cerevisiae* | [db:gtc-*saccharomyces cerevisiae*] [ui:yhr166c] [pn:subunit of anaphase-promoting complex:cyclosome:cell division control protein 23] [gn:cdc23] [gtcfc:10.1:10.11:10.2:12.16:12.8] [keggfc:13.3] [sgdfc:3.8.0:6.5.1:9.3.0:9.5.0] |
| b9x13c15.x | 2917251_c2_2 | 4838 | 18941 | 477 | 159 | YHR166C | 523 | 2.2(10)-50 | *Saccharomyces cerevisiae* | [db:gtc-*saccharomyces cerevisiae*] [ui:yhr166c] [pn:subunit of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | anaphase-promoting complex:cyclosome:cell division control protein 23] [gn:cdc23] [gtcfc:10.1:10.11:10.2:12.16:12.8] [keggfc:13.3] [sgdfc:3.8:0:6.5.1:9.3:0:9.5.0] [db:gtc-saccharomyces cerevisiae] |
| CONTIG549 | 19782885_f3_1 | 4839 | 18942 | 516 | 172 | YHR193C | 338 | 9.0(10)-31 | Saccharomyces cerevisiae | [ui:yhr193c] [pn:similarity to human alpha-nac:protein] [gn:egd2] [gtcfc:10.1:10.2:12.13] [keggfc:14.2] [sgdfc:1.5.2:4.8.2:9.5.0] [db:gtc-saccharomyces cerevisiae] |
| CONTIG4001 | 12683582_c2_12 | 4840 | 18943 | 240 | 80 | YHR206W | 221 | 2.2(10)-17 | Saccharomyces cerevisiae | [ui:yhr206w] [pn:transcription factor with similarity to hsf1p:putative transcription factor skn7:pos9 protein] [gn:skn7:pos9] [gtcfc:10.1:10.2:12.8:13.2] [keggfc:14.2] [sgdfc:3.1.0:3.8.0:4.8.2:9.5.0:11.1.0] [db:gtc-saccharomyces cere] |
| CONTIG4001 | 34563212_c3_15 | 4841 | 18944 | 948 | 316 | YHR206W | 184 | 1.8(10)-19 | Saccharomyces cerevisiae | [ui:yhr206w] [pn:transcription factor with similarity to hsf1p:putative transcription factor skn7:pos9 protein] [gn:skn7:pos9] [gtcfc:10.1:10.2:12.8:13.2] [keggfc:14.2] [sgdfc:3.1.0:3.8.0:4.8.2:9.5.0:11.1.0] [db:gtc-saccharomyces cere] |
| CONTIG5462 | 860077_f3_7 | 4842 | 18945 | 477 | 159 | YHR206W | 383 | 4.7(10)-35 | Saccharomyces cerevisiae | [ui:yhr206w] [pn:transcription factor with similarity to hsf1p:putative transcription factor skn7:pos9 protein] [gn:skn7:pos9] [gtcfc:10.1:10.2:12.8:13.2] [keggfc:14.2] [sgdfc:3.1.0:3.8.0:4.8.2:9.5.0:11.1.0] [db:gtc-saccharomyces cere] |
| CONTIG1455 | 4490885_c3_6 | 4843 | 18946 | 942 | 314 | YIL143C | 1435 | 5.0(10)-147 | Saccharomyces cerevisiae | [ui:yil143c] [pn:dna helicase:dna repair helicase rad25] [gn:rad25:ss12:uvsl12] [gtcfc:10.1:10.10:10.2] [keggfc:14.2] [sgdfc:4.8.1:9.5.0:11.2.1] [db:gtc-saccharomyces cerevisiae] |
| CONTIG2685 | 15792336_c1_5 | 4844 | 18947 | 708 | 236 | YIL143C | 823 | 3.7(10)-82 | Saccharomyces cerevisiae | [ui:yil143c] [pn:dna helicase:dna repair helicase rad25] [gn:rad25:ss12:uvsl12] [gtcfc:10.1:10.10:10.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5706 | 10970255_c1_19 | 4845 | 18948 | 831 | 277 | YIL143C | 714 | 1.3(10)-70 | *Saccharomyces cerevisiae* | [sgdfc:4.8.1:9.5.0:11.2.1] [db:gtc-*saccharomyces cerevisiae*] [ui:yil143c] [pn:dna helicase:dna repair helicase rad25] [gn:rad25:ssl2:uvsl12] [gtcfc:10.1:10.10:10.2] [keggfc:14.2] [sgdfc:4.8.1:9.5.0:11.2.1] [db:gtc-*saccharomyces cerevisiae*] |
| CONTIG1299 | 20597211_f3_3 | 4846 | 18949 | 1272 | 424 | YIL126W | 588 | 4.9(10)-56 | *Saccharomyces cerevisiae* | [ui:yil126w] [pn:subunit of the rsc complex:nuclear protein sth1/nps1] [gn:sth1:nps1] [gtcfc:10.1:10.2:12.8] [keggfc:14.2] [sgdfc:3.8.0:4.8.2:4.8.3:9.5.0:9.6.0] [db:gtc-*saccharomyces cerevisiae*] |
| CONTIG3504 | 39756_f1_1 | 4847 | 18950 | 1722 | 574 | YIL126W | 1555 | 1.7(10)-169 | *Saccharomyces cerevisiae* | [ui:yil126w] [pn:subunit of the rsc complex:nuclear protein sth1/nps1] [gn:sth1:nps1] [gtcfc:10.1:10.2:12.8] [keggfc:14.2] [sgdfc:3.8.0:4.8.2:4.8.3:9.5.0:9.6.0] [db:gtc-*saccharomyces cerevisiae*] |
| CONTIG4330 | 16453251_c2_6 | 4848 | 18951 | 1254 | 418 | YIL115C | 218 | 2.0(10)-14 | *Saccharomyces cerevisiae* | [ui:yil115c] [pn:nuclear pore protein:nucleoporin nup159:nuclear pore protein nup159] [gn:nup159:rat7] [gtcfc:10.1:10.2] [keggfc:14.2] [sgdfc:8.1.0:9.5.0] [db:gtc-*saccharomyces cerevisiae*] |
| CONTIG3472 | 22050877_c3_6 | 4849 | 18952 | 786 | 262 | YIL061C | 193 | 2.3(10)-15 | *Saccharomyces cerevisiae* | [ui:yil061c] [pn:u1 small nuclear ribonucleoprotein:u1 small nuclear ribonucleoprotein 70 kd homolog] [gn:snp1] [gtcfc:10.1:10.2] [keggfc:14.2] [sgdfc:4.9.0:9.5.0] [db:gtc-*saccharomyces cerevisiae*] |
| CONTIG1816 | 25433132_c1_3 | 4850 | 18953 | 1119 | 373 | YIL046W | 718 | 1.2(10)-83 | *Saccharomyces cerevisiae* | [ui:yil046w] [pn:involved in regulation of sulfur assimilation genes:protein] [gn:met30] [gtcfc:10.1:10.2] [keggfc:14.2] [sgdfc:1.1.2:4.8.2:9.5.0] [db:gtc-*saccharomyces cerevisiae*] |
| CONTIG4732 | 23944625_c1_12 | 4851 | 18954 | 1149 | 383 | YIL038C | 214 | 2.0(10)-16 | *Saccharomyces cerevisiae* | [ui:yil038c] [pn:general negative regulator of transcription, subunit 3:general negative regulator of transcription subunit 3] [gn:not3:cdc39] [gtcfc:10.1:10.2] [keggfc:14.2] [sgdfc:4.8.2:9.5.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5775 | 26370317_c2_27 | 4852 | 18955 | 2334 | 778 | YIL038C | 94 | 1.1(10)-15 | Saccharomyces cerevisiae | [ui:yil038c] [pn:general negative regulator of transcription, subunit 3/general negative regulator of transcription subunit 3] [gn:not3;cdc39] [gtcfc:10.1:1:10.2] [keggfc:14.2] [sgdfc:4.8.2:9.5.0] [db:gtc-saccharomyces cerevisiae] |
| CONTIG4311 | 4431966_f3_4 | 4853 | 18956 | 633 | 211 | YIL035C | 777 | 2.7(10)-77 | Saccharomyces cerevisiae | [ui:yil035c] [pn:casein kinase ii catalytic alpha chain/case in kinase ii, alpha chain;ck ii] [gn:cka1] [gtcfc:10.1:1:10.2:12.13:12.8] [ec:2.7.1.37] [keggfc:14.1] [sgdfc:3.8.0:4.7.0:9.5.0:15.0.0] [db:gtc-saccharomyces cerevisiae] |
| CONTIG3781 | 2735001_f3_1 | 4854 | 18957 | 1491 | 497 | YIL194W | 240 | 6.2(10)-31 | Saccharomyces cerevisiae | [ui:yil194w] [pn:cell division control protein:cell division control protein 6] [gn:cdc6;j0347] [gtcfc:10.1:1:10.2:10.8:12.8] [keggfc:13.2] [sgdfc:3.6.0:3.8.0:9.5.0] [db:gtc-saccharomyces cerevisiae] |
| CONTIG20 | 25587825_c3_1 | 4855 | 18958 | 561 | 187 | YIL176C | 218 | 7.5(10)-17 | Saccharomyces cerevisiae | [ui:yjl176c] [pn:transcription regulatory protein:transcription regulatory protein swi3:swi/snf complex component swi3:transcription factor tye2] [gn:swi3:tye2;j0495] [gtcfc:10.1:1:10.2:12.13:12.9] [keggfc:14.2] [sgdfc:1.5.2:3.3.0:4.8.2] |
| CONTIG3498 | 36382067_c1_6 | 4856 | 18959 | 1686 | 562 | YIL176C | 103 | 0.05 | Saccharomyces cerevisiae | [ui:yjl176c] [pn:transcription regulatory protein:transcription regulatory protein swi3:swi/snf complex component swi3:transcription factor tye2] [gn:swi3:tye2;j0495] [gtcfc:10.1:1:10.2:12.13:12.9] [keggfc:14.2] [sgdfc:1.5.2:3.3.0:4.8.2] |
| CONTIG4493 | 24508433_f2_3 | 4857 | 18960 | 2754 | 918 | YIL176C | 414 | 2.1(10)-65 | Saccharomyces cerevisiae | [ui:yjl176c] [pn:transcription regulatory protein:transcription regulatory protein swi3:swi/snf complex component swi3:transcription factor tye2] [gn:swi3:tye2;j0495] [gtcfc:10.1:1:10.2:12.13:12.9] [keggfc:14.2] [sgdfc:1.5.2:3.3.0:4.8.2] |
| CONTIG4854 | 36025277_f2_1 | 4858 | 18961 | 1413 | 471 | YIL127C | 475 | 6.2(10)-66 | Saccharomyces cerevisiae | [ui:yjl127c] [pn:transcription |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x13313.y | 53836_c3_3 | 4859 | 18962 | 576 | 192 | YJL127C | 108 | 0.00092 | Saccharomyces cerevisiae | regulatory protein:spt10 protein [gn:spt10sud1cre1;j0702] [gtcfc:10.1:10.2] [keggfc:14.2] [sgdfc:4.8.2:9.5.0] [db:gtc-saccharomyces cerevisiae] [ui:yjl127c] [pn:transcription regulatory protein:spt10 protein [gn:spt10sud1cre1;j0702] [gtcfc:10.1:10.2] [keggfc:14.2] [sgdfc:4.8.2:9.5.0] [db:gtc-saccharomyces cerevisiae] |
| CONTIG5539 | 3913925_f1_1 | 4860 | 18963 | 2226 | 742 | YJL090C | 255 | 1.2(10)-22 | Saccharomyces cerevisiae | [ui:yjl090c] [pn:involved in dna replication and s-phase checkpoint:hypothetical 87.2 kd protein in srs2-sip4 intergenic region] [gn:dpb11;j0918] [gtcfc:10.1:10.2:10.8:12.8] [keggfc:13.2] [sgdfc:3.6.0:3.8.0:9.5.0] [db:gtc-saccharomyc |
| CONTIG2690 | 4882175_f1_1 | 4861 | 18964 | 1317 | 439 | YJL089W | 209 | 6.0(10)-14 | Saccharomyces cerevisiae | [ui:yjl089w] [pn:interacts with snf1 protein kinase:sip4 protein] [gn:sip4;j0922] [gtcfc:10.1:10.2] [keggfc:14.2] [sgdfc:4.8.2:9.5.0] [db:gtc-saccharomyces cerevisiae] |
| CONTIG2958 | 14650187_c1_2 | 4862 | 18965 | 1491 | 497 | YJL081C | 505 | 1.3(10)-71 | Saccharomyces cerevisiae | [ui:yjl081c] [pn:actin-related protein:actin-like protein act3] [gn:arp4:act3;j1012] [gtcfc:10.1:10.2] [keggfc:14.2] [sgdfc:9.5.0:9.6.0] [db:gtc-saccharomyces cerevisiae] |
| CONTIG5135 | 36354678_c1_17 | 4863 | 18966 | 510 | 170 | YJL080C | 257 | 9.0(10)-21 | Saccharomyces cerevisiae | [ui:yjl1080c] [pn:histone-like protein:scp160 protein:protein hx] [gn:scp160:hx;j1017] [gtcfc:10.1:10.2:12.8] [keggfc:14.2] [sgdfc:3.8.0:9.5.0] [db:gtc-saccharomyces cerevisiae] |
| CONTIG5135 | 12922152_c3_20 | 4864 | 18967 | 2499 | 833 | YJL080C | 914 | 8.3(10)-92 | Saccharomyces cerevisiae | [ui:yjl080c] [pn:histone-like protein:scp160 protein:protein hx] [gn:scp160:hx;j1017] [gtcfc:10.1:10.2:12.8] [keggfc:14.2] [sgdfc:3.8.0:9.5.0] [db:gtc-saccharomyces cerevisiae] |
| CONTIG5522 | 507186_c1_20 | 4865 | 18968 | 1635 | 545 | YJL061W | 132 | 3.6(10)-5 | Saccharomyces cerevisiae | [ui:yjl061w] [pn:nuclear pore protein:nucleoporin nup82:nuclear pore protein nup82] [gn:nup82;j1135:hrb187] [gtcfc:10.1:10.2:12.3] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG140 | 515762_c2_2 | 4866 | 18969 | 243 | 81 | YJL050W | 187 | 2.2(10)-13 | *Saccharomyces cerevisiae* | [sgdfc:4.11.0:8.1.0:9.5.0] [db:gtc-saccharomyces cerevisiae] [ui:yjl050w] [pn:involved in nucleocytoplasmic transport of mrna:hypothetical helicase in tdh1-gyp6 intergenic region] [gn:mtr4;j1158] [gcfc:10.1:10.2:12.3] [keggfc:14.2] |
| CONTIG4785 | 33492200_f2_2 | 4867 | 18970 | 516 | 172 | YJL050W | 494 | 3.2(10)-46 | *Saccharomyces cerevisiae* | [sgdfc:4.11.0:8.1.0:9.5.0] [db:gtc-saccharomyces cerevisiae] [ui:yjl050w] [pn:involved in nucleocytoplasmic transport of mrna:hypothetical helicase in tdh1-gyp6 intergenic region] [gn:mtr4;j1158] [gcfc:10.1:10.2:12.3] [keggfc:14.2] |
| CONTIG5293 | 26351677_f2_2 | 4868 | 18971 | 2757 | 919 | YJL050W | 2832 | 4.7(10)-295 | *Saccharomyces cerevisiae* | [sgdfc:4.11.0:8.1.0:9.5.0] [db:gtc-saccharomyces cerevisiae] [ui:yjl050w] [pn:involved in nucleocytoplasmic transport of mrna:hypothetical helicase in tdh1-gyp6 intergenic region] [gn:mtr4;j1158] [gcfc:10.1:10.2:12.3] [keggfc:14.2] |
| CONTIG3153 | 32553328_f3_1 | 4869 | 18972 | 366 | 122 | YJL041W | 109 | 3.3(10)-5 | *Saccharomyces cerevisiae* | [sgdfc:4.11.0:8.1.0:9.5.0] [db:gtc-saccharomyces cerevisiae] [ui:yjl041w] [pn:nuclear pore protein:nucleoporin nsp1:nuclear pore protein nsp1:nucleoskeletal-like protein:p110] [gn:nsp1;j1207] [gcfc:10.11] [keggfc:14.2] |
| CONTIG5819 | 225522577_f2_7 | 4870 | 18973 | 1314 | 438 | YJL025W | 322 | 1.0(10)-28 | *Saccharomyces cerevisiae* | [sgdfc:4.7.0:8.1.0:9.5.0] [db:gtc-saccharomyces cerevisiae] [ui:yjl025w] [pn:polymerase i specific transcription initiation factor:rna polymerase i specific transcription initiation factor rrn7] [gn:rrn7;j1273] [gcfc:10.1:10.2:10.3] [keggfc:14.2] [sgdfc:4.1.0:9.5.0] |
| CONTIG4926 | 23554843_f2_3 | 4871 | 18974 | 1041 | 347 | YJR035W | 1128 | 1.8(10)-114 | *Saccharomyces cerevisiae* | [db:gtc-saccharomyces cere [ui:yjr035w] [pn:dna repair and recombination protein:dna repair and recombination protein rad26] [gn:rad26;gta1085;j1606] [gcfc:10.1:10.2:10.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4926 | 1212937_f3_5 | 4872 | 18975 | 1575 | 525 | YJR035W | 921 | 1.5(10)-92 | Saccharomyces cerevisiae | [keggfc:14.2] [sgdfc:3.7.0:9.5.0] [db:gtc-saccharomyces cerevisiae] [ui:yjr035w] [pn:dna repair and recombination protein:dna repair and recombination protein rad26] [gn:rad26;gta1085:j1606] [gtcfc:10.1:10.2:10.8] |
| CONTIG3117 | 14542311_c3_9 | 4873 | 18976 | 1101 | 367 | YJR042W | 154 | 6.4(10)-8 | Saccharomyces cerevisiae | [keggfc:14.2] [sgdfc:3.7.0:9.5.0] [db:gtc-saccharomyces cerevisiae] [ui:yjr042w] [pn:nuclear pore protein:nucleoporin nup85:nuclear pore protein nup85] [gn:nup85;rat9:j1624] [gtcfc:10.1:10.2:10.6] [keggfc:14.2] [sgdfc:4.5.0:8.1.0:9.5.0] [db:gtc-saccharomyces cerevisiae] |
| CONTIG4183 | 14640660_f1_1 | 4874 | 18977 | 1191 | 397 | YJR042W | 283 | 8.5(10)-23 | Saccharomyces cerevisiae | [ui:yjr042w] [pn:nuclear pore protein:nucleoporin nup85:nuclear pore protein nup85] [gn:nup85;rat9:j1624] [gtcfc:10.1:10.2:10.6] [keggfc:14.2] [sgdfc:4.5.0:8.1.0:9.5.0] [db:gtc-saccharomyces cerevisiae] |
| CONTIG5049 | 23834438_c1_13 | 4875 | 18978 | 366 | 122 | YJR052W | 192 | 2.5(10)-14 | Saccharomyces cerevisiae | [ui:yjr052w] [pn:nucleotide excision repair protein:dna repair protein rad7] [gn:rad7;j1665] [gtcfc:10.1:10.10:10.2] [keggfc:14.2] [sgdfc:9.5.0:11.2.1] [db:gtc-saccharomyces cerevisiae] |
| CONTIG5049 | 33337805_c1_12 | 4876 | 18979 | 1596 | 532 | YJR052W | 524 | 2.7(10)-55 | Saccharomyces cerevisiae | [ui:yjr052w] [pn:nucleotide excision repair protein:dna repair protein rad7] [gn:rad7;j1665] [gtcfc:10.1:10.10:10.2] [keggfc:14.2] [sgdfc:9.5.0:11.2.1] [db:gtc-saccharomyces cerevisiae] |
| CONTIG5280 | 32220142_f2_5 | 4877 | 18980 | 747 | 249 | YJR060W | 324 | 2.7(10)-29 | Saccharomyces cerevisiae | [ui:yjr060w] [pn:kinetochore protein:centromere-binding protein 1:cbp-1:centromere-binding factor 1:centromere promoter factor 1] [gn:cbf1:cpf1:cp1:cep1:j1730] [gtcfc:10.1:10.2:12.8] [keggfc:14.2] |
| CONTIG1577 | 2066431_c2_5 | 4878 | 18981 | 186 | 62 | YJR068W | 126 | 1.3(10)-7 | Saccharomyces cerevisiae | [sgdfc:1.1.2:3.8.0:4.8.2:9.5.0:9.6.0] [ui:yjr068w] [pn:dna replication factor c, 41 kd subunit:activator 1 41 kd subunit:replication factor c 41 kd subunit] [gn:rfc2;j1808] |

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3110 | 12597803_c3_8 | 4879 | 18982 | 741 | 247 | YJR068W | 622 | 7.2(10)-61 | *Saccharomyces cerevisiae* | [gtcfc:10.1:10.2:10.8] [keggfc:14.2] [sgdfc:3.6.0:9.5.0] [db:gtc-*saccharomyces cerevisiae*] [ui:yjr068w] [pn:dna replication factor c, 41 kd subunit:activator 1 41 kd subunit:replication factor c 41 kd subunit] [gn:rfc2;j1808] [gtcfc:10.1:10.2:10.8] [keggfc:14.2] [sgdfc:3.6.0:9.5.0] [db:gtc-*saccharomyces cerevisiae*] |
| CONTIG3182 | 448958_c2_8 | 4880 | 18983 | 693 | 231 | YJR093C | 202 | 3.7(10)-16 | *Saccharomyces cerevisiae* | [ui:yjr093c] [pn:component of pre-mrna polyadenylation factor pf i:flp1 protein] [gn:flp1;j1911] [gtcfc:10.1:10.2:10.9] [keggfc:14.2] [sgdfc:4.10.0:9.5.0] [db:gtc-*saccharomyces cerevisiae*] |
| CONTIG5518 | 36503155_f1_1 | 4881 | 18984 | 654 | 218 | YJR112W | 177 | 1.0(10)-13 | *Saccharomyces cerevisiae* | [ui:yjr112w] [pn:nuclear envelope protein:hypothetical 23.6 kd protein in cpa2-atp2 intergenic region] [gn:nnf1;j2011] [gtcfc:10.1:10.2:12.8] [keggfc:14.2] [sgdfc:3.8.0:9.5.0] [db:gtc-*saccharomyces cerevisiae*] |
| CONTIG5351 | 19562875_c3_13 | 4882 | 18985 | 1023 | 341 | YJR122W | 280 | 4.5(10)-24 | *Saccharomyces cerevisiae* | [ui:yjr122w] [pn:ccr4 associated factor:hypothetical 57.1 kd protein in atp2-rps5 intergenic region] [gn:caf17;j2043] [gtcfc:10.1:10.2] [keggfc:14.2] [sgdfc:4.8.2:9.5.0] [db:gtc-*saccharomyces cerevisiae*] |
| CONTIG11075 | 24666043_f2_1 | 4883 | 18986 | 870 | 290 | YKL210W | 924 | 7.2(10)-93 | *Saccharomyces cerevisiae* | [ui:ykl210w] [pn:ubiquitin-protein ligase:ubiquitin-activating enzyme e1 1] [gn:uba1] [gtcfc:10.1:10.11:10.2:10.7:13.2] [keggfc:14.2] [sgdfc:6.3.0:6.5.1:9.2.0:9.5.0:11.1.0] [db:gtc-*saccharomyces cerevisiae*] |
| blx13259.x | 11024166_f2_2 | 4884 | 18987 | 216 | 72 | YKL210W | 122 | 1.8(10)-6 | *Saccharomyces cerevisiae* | [ui:ykl210w] [pn:ubiquitin-protein ligase:ubiquitin-activating enzyme e1 1] [gn:uba1] [gtcfc:10.1:10.11:10.2:10.7:13.2] [keggfc:14.2] [sgdfc:6.3.0:6.5.1:9.2.0:9.5.0:11.1.0] [db:gtc-*saccharomyces cerevisiae*] |
| blx13259.x | 3923451_f3_3 | 4885 | 18988 | 747 | 249 | YKL210W | 808 | 1.3(10)-80 | *Saccharomyces cerevisiae* | [ui:ykl210w] [pn:ubiquitin-protein ligase:ubiquitin-activating enzyme e1 1] [gn:uba1] [gtcfc:10.1:10.11:10.2:10.7:13.2] [keggfc:14.2] [sgdfc:6.3.0:6.5.1:9.2.0:9.5.0:11.1.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5818 | 34491277_c1_32 | 4886 | 18989 | 1080 | 360 | YKL205W | 214 | 1.2(10)-14 | Saccharomyces cerevisiae | [keggfc:14.2] [sgdfc:6.3:0:6.5.1:9.2.0:9.5.0:11.1.0] [db:gtc-saccharomyces cerevisiae] [ui:ykl205w] [pn:pre-trna splicing protein:protein] [gn:los1] [gtcfc:10.1:10.2:10.6:12.3] [keggfc:14.2] [sgdfc:4.5:0:4.11.0:9.5.0] [db:gtc-saccharomyces cerevisiae] |
| CONTIG5818 | 272813_c2_41 | 4887 | 18990 | 1773 | 591 | YKL205W | 488 | 1.5(10)-45 | Saccharomyces cerevisiae | [ui:ykl205w] [pn:pre-trna splicing protein:protein] [gn:los1] [gtcfc:10.1:10.2:10.6:12.3] [keggfc:14.2] [sgdfc:4.5:0:4.11.0:9.5.0] [db:gtc-saccharomyces cerevisiae] |
| CONTIG2637 | 33725012_f3_1 | 4888 | 18991 | 1083 | 361 | YKL193C | 91 | 0.16 | Saccharomyces cerevisiae | [ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] [sgdfc:3.8:0:6.3:0:9.5.0] [db:gtc-saccharomyces cerevisiae] |
| CONTIG4464 | 470306_f2_2 | 4889 | 18992 | 1512 | 504 | YKL193C | 149 | 1.2(10)-7 | Saccharomyces cerevisiae | [ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] [sgdfc:3.8:0:6.3:0:9.5.0] [db:gtc-saccharomyces cerevisiae] |
| CONTIG4718 | 32206956_f2_1 | 4890 | 18993 | 2154 | 718 | YKL193C | 139 | 2.2(10)-6 | Saccharomyces cerevisiae | [ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] [sgdfc:3.8:0:6.3:0:9.5.0] [db:gtc-saccharomyces cerevisiae] |
| CONTIG5101 | 26375392_f1_1 | 4891 | 18994 | 1431 | 477 | YKL193C | 100 | 0.014 | Saccharomyces cerevisiae | [ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] [sgdfc:3.8:0:6.3:0:9.5.0] [db:gtc-saccharomyces cerevisiae] |
| CONTIG5479 | 20157632_f2_6 | 4892 | 18995 | 657 | 219 | YKL193C | 94 | 0.032 | Saccharomyces | [ui:ykl193c] [pn:regulatory subunit |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | for the mitotic function of type i protein phosphatase:protein phosphatases pp1 regulatory subunit sds22] [gn:sds22:egp1] [gtcfc:10.1:10.2:10.7:12.8] [keggfc:13.3] |
| CONTIG5506 | 25523502_c3_15 | 4893 | 18996 | 918 | 306 | YKL193C | 342 | 5.5(10)-55 | Saccharomyces cerevisiae | [sgdfc:3.8:0:6.3:0:9.5.0] [db:gtc-ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] |
| CONTIG5644 | 4394002_f1_2 | 4894 | 18997 | 2145 | 715 | YKL193C | 90 | 0.46 | Saccharomyces cerevisiae | [sgdfc:3.8:0:6.3:0:9.5.0] [db:gtc-ui:ykl193c] [pn:regulatory subunit for the mitotic function of type i protein phosphatase:protein phosphatases pp1 regulatory subunit sds22] [gn:sds22:egp1] [gtcfc:10.1:10.2:10.7:12.8] [keggfc:13.3] |
| CONTIG5815 | 16438261_c3_48 | 4895 | 18998 | 540 | 180 | YKL186C | 222 | 1.8(10)-18 | Saccharomyces cerevisiae | [sgdfc:3.8:0:6.3:0:9.5.0] [db:gtc-ui:ykl186c] [pn:mrna transport protein:mrna transport regulator] [gn:mtr2] [gtcfc:12.3:10.1:10.2] [keggfc:14.2] |
| CONTIG5667 | 5945317_f1_2 | 4896 | 18999 | 1083 | 361 | YKL114C | 1098 | 2.6(10)-111 | Saccharomyces cerevisiae | [sgdfc:4.11.0:8.1.0:9.5.0] [db:gtc-ui:ykl114c] [pn:dna-apurinic or apyrimidinic site lyase:ap endonuclease:apurinic-apyrimidinic endonuclease] [gn:apn1:ykl513] [gtcfc:10.1:10.10.2:14.1] [ec:4.2.99.18] [keggfc:14.1] [sgdfc:9.5.0:11.2.1] [db:gtc-saccharomyces cerevi |
| CONTIG2060 | 16204092_f1_1 | 4897 | 19000 | 1104 | 368 | YKL109W | 95 | 0.12 | Saccharomyces cerevisiae | [ui:ykl109w] [pn:ccaat-binding factor subunit:hap4 transcriptional activator] [gn:hap4:ykl465] [gtcfc:10.1:10.2] [keggfc:14.2] [sgdfc:4.8.2:9.5.0] [db:gtc-saccharomyces cerevisiae] |
| CONTIG3756 | 11756587_c2_7 | 4898 | 19001 | 1575 | 525 | YKL109W | 95 | 0.19 | Saccharomyces cerevisiae | [ui:ykl109w] [pn:ccaat-binding factor subunit:hap4 transcriptional activator] [gn:hap4:ykl465] [gtcfc:10.1:10.2] [keggfc:14.2] [sgdfc:4.8.2:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5791 | 165882_f1_1 | 4899 | 19002 | 1566 | 522 | YKL089W | 207 | 4.9(10)-21 | Saccharomyces cerevisiae | [ui:ykl089w] [pn:required for normal chromosome segregation and spindle integrity:protein] [gn:mif2] [gtcfc:10.1:10.2:12.8:14.1] [ec:3.4.24.64] [keggfc:14.1] [sgdfc:3.8.0:9.5.0:9.6.0] [db:gtc-saccharomyces cerevisiae] |
| CONTIG5100 | 14073342_c3_8 | 4900 | 19003 | 309 | 103 | YKL074C | 125 | 3.6(10)-7 | Saccharomyces cerevisiae | [ui:ykl074c] [pn:pre-mrna splicing factor:splicing factor mud2] [gn:mud2;ykl3358] [gtcfc:10.1:10.2] [keggfc:14.2] [sgdfc:4.9.0:9.5.0] [db:gtc-saccharomyces cerevisiae] |
| CONTIG5189 | 13103542_f1_1 | 4901 | 19004 | 387 | 129 | YKL062W | 153 | 4.5(10)-10 | Saccharomyces cerevisiae | [ui:ykl062w] [pn:transcriptional activator:zinc finger protein:multicopy supressor of snf1 protein 4] [gn:msn4] [gtcfc:10.1:10.2:12.13:13.2] [keggfc:14.2] [sgdfc:1.5.2:4.8.2:9.5.0:11.1.0] [db:gtc-saccharomyces cerevisiae] |
| CONTIG5755 | 10970308_f3_10 | 4902 | 19005 | 2283 | 761 | YKL062W | 181 | 9.0(10)-11 | Saccharomyces cerevisiae | [ui:ykl062w] [pn:transcriptional activator:zinc finger protein:multicopy supressor of snf1 protein 4] [gn:msn4] [gtcfc:10.1:10.2:12.13:13.2] [keggfc:14.2] [sgdfc:1.5.2:4.8.2:9.5.0:11.1.0] [db:gtc-saccharomyces cerevisiae] |
| CONTIG4060 | 11878775_f3_3 | 4903 | 19006 | 492 | 164 | YKL058W | 318 | 1.2(10)-28 | Saccharomyces cerevisiae | [ui:ykl058w] [pn:tfiia subunit:transcription initiation factor, 13.5 kd:transcription initiation factor iia small chain:tfiia 13.5 kd subunit] [gn:toa2] [gtcfc:10.1:10.2] [keggfc:14.2] [sgdfc:4.8.1:9.5.0] [db:gtc-saccharomyces cerevis |
| CONTIG3752 | 21507692_c2_4 | 4904 | 19007 | 2121 | 707 | YKL038W | 167 | 6.5(10)-9 | Saccharomyces cerevisiae | [ui:ykl038w] [pn: regulator of glucose-induced genes:putative 128.2 kd transcriptional regulatory protein in ptm1-ixr1 intergenic region] [gn:rgt1:ykl251] [gtcfc:10.1:10.2:12.13] [keggfc:14.2] [sgdfc:1.5.2:4.8.2:9.5.0] [db:gtc-saccharo |
| CONTIG4152 | 26443927_c1_6 | 4905 | 19008 | 1230 | 410 | YKL028W | 639 | 1.2(10)-62 | Saccharomyces cerevisiae | [ui:ykl028w] [pn:tfiie subunit:transcription initiation |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | factor, 66 kd:transcription initiation factor iie, alpha subunit:tfiie-alpha:transcription factor a large subunit:factor a 66 kd subunit] [gn:tfa1] [gtcfc:10.1:10.2] [keggfc.14. |
| CONTIG3951 | 14553275_c1_5 | 4906 | 19009 | 1401 | 467 | YKL022C | 748 | 3.2(10)-74 | Saccharomyces cerevisiae | [ui:ykl022c] [pn:subunit of anaphase-promoting complex:cyclosome:cell division control protein 16] [gn:cdc16] [gtcfc:10.1:10.11:10.2:12.16:12.8] [keggfc:13.3] [sgdfc:3.8:0:6.5.1:9.3:0:9.5.0] [db:gtc-saccharomyces cerevisiae] |
| CONTIG2112 | 26290902_f3_3 | 4907 | 19010 | 1443 | 481 | YKL020C | 244 | 2.6(10)-37 | Saccharomyces cerevisiae | [ui:ykl020c] [pn:dosage-dependent suppressor of ty-induced promotor mutations:protein] [gn:spt23] [gtcfc:10.2] [keggfc:14.2] [sgdfc:9.5.0:13.0.0] [db:gtc-saccharomyces cerevisiae] |
| CONTIG1305 | 1961462_c3_4 | 4908 | 19011 | 1089 | 363 | YKL015W | 802 | 6.2(10)-80 | Saccharomyces cerevisiae | [ui:ykl015w] [pn:positive activator of the proline utilization pathway:proline utilization trans-activator] [gn:put3] [gtcfc:10.1:10.2] [keggfc:14.2] [sgdfc:1.1.2:4.8.2:9.5.0] [db:gtc-saccharomyces cerevisiae] |
| CONTIG3445 | 54187_c3_6 | 4909 | 19012 | 1524 | 508 | YKL015W | 95 | 0.33 | Saccharomyces cerevisiae | [ui:ykl015w] [pn:positive activator of the proline utilization pathway:proline utilization trans-activator] [gn:put3] [gtcfc:10.1:10.2] [keggfc:14.2] [sgdfc:1.1.2:4.8.2:9.5.0] [db:gtc-saccharomyces cerevisiae] |
| CONTIG3566 | 29376655_c2_9 | 4910 | 19013 | 627 | 209 | YKL015W | 220 | 5.9(10)-17 | Saccharomyces cerevisiae | [ui:ykl015w] [pn:positive activator of the proline utilization pathway:proline utilization trans-activator] [gn:put3] [gtcfc:10.1:10.2] [keggfc:14.2] [sgdfc:1.1.2:4.8.2:9.5.0] [db:gtc-saccharomyces cerevisiae] |
| CONTIG3982 | 18760890_c3_8 | 4911 | 19014 | 1914 | 638 | YKL015W | 131 | 7.5(10)-5 | Saccharomyces cerevisiae | [ui:ykl015w] [pn:positive activator of the proline utilization pathway:proline utilization trans-activator] [gn:put3] [gtcfc:10.1:10.2] [keggfc:14.2] [sgdfc:1.1.2:4.8.2:9.5.0] [db:gtc-saccharomyces cerevisiae] |
| CONTIG4660 | 21884677_c1_8 | 4912 | 19015 | 696 | 232 | YKL015W | 125 | 1.7(10)-10 | Saccharomyces | [ui:ykl015w] [pn:positive activator |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | of the proline utilization pathway:proline utilization transactivator] [gn:put3] [gtcfc:10.1:10.2] [keggfc:14.2] [sgdfc:1.1.2..4.8.2:9.5.0] [db:gtc-saccharomyces cerevisiae] |
| CONTIG5235 | 35432156_c2_17 | 4913 | 19016 | 1128 | 376 | YKL015W | 94 | 0.29999 | Saccharomyces cerevisiae | [ui:ykl015w] [pn:positive activator of the proline utilization pathway:proline utilization transactivator] [gn:put3] [gtcfc:10.1:10.2] [keggfc:14.2] [sgdfc:1.1.2..4.8.2:9.5.0] [db:gtc-saccharomyces cerevisiae] |
| CONTIG5732 | 4085937_c2_30 | 4914 | 19017 | 2490 | 830 | YKL015W | 126 | 0.0004 | Saccharomyces cerevisiae | [ui:ykl015w] [pn:positive activator of the proline utilization pathway:proline utilization transactivator] [gn:put3] [gtcfc:10.1:10.2] [keggfc:14.2] [sgdfc:1.1.2..4.8.2:9.5.0] [db:gtc-saccharomyces cerevisiae] |
| CONTIG2948 | 2613901_c1_4 | 4915 | 19018 | 1203 | 401 | YKL005C | 107 | 0.0051 | Saccharomyces cerevisiae | [ui:ykl005c] [pn:weak similarity to ykr029c and d.melanogaster transcription elongation factor dms-ii:hypothetical 67.9 kd protein rpl14a-aur1 intergenic region] [gn:ykl150] [gtcfc:10.1:10.2] [keggfc:14.2] [sgdfc:4.12.0:9.5.0] [db:gtc] |
| CONTIG4205 | 976013_c3_7 | 4916 | 19019 | 888 | 296 | YKL005C | 94 | 0.13 | Saccharomyces cerevisiae | [ui:ykl005c] [pn:weak similarity to ykr029c and d.melanogaster transcription elongation factor dms-ii:hypothetical 67.9 kd protein rpl14a-aur1 intergenic region] [gn:ykl150] [gtcfc:10.1:10.2] [keggfc:14.2] [sgdfc:4.12.0:9.5.0] [db:gtc] |
| CONTIG5102 | 26441557_c2_5 | 4917 | 19020 | 387 | 129 | YKL005C | 172 | 3.7(10)-12 | Saccharomyces cerevisiae | [ui:ykl005c] [pn:weak similarity to ykr029c and d.melanogaster transcription elongation factor dms-ii:hypothetical 67.9 kd protein rpl14a-aur1 intergenic region] [gn:ykl150] [gtcfc:10.1:10.2] [keggfc:14.2] [sgdfc:4.12.0:9.5.0] [db:gtc] |
| CONTIG1056 | 21490677_c2_2 | 4918 | 19021 | 738 | 246 | YKR002W | 892 | 1.8(10)-89 | Saccharomyces cerevisiae | [ui:ykr002w] [pn:poly:a polymerase] [gn:pap1] [gtcfc:10.1:10.2:10.9:14.1] [keggfc:14.1] [ec:2.7.7.19] [sgdfc:4.10.0:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2615 | 393775_f2_1 | 4919 | 19022 | 1353 | 451 | YKR002W | 1446 | 3.5(10)-148 | *Saccharomyces cerevisiae* | [ui:ykr002w] [pn:poly:a polymerase] [gn:pap1] [gtcfc:10.1:10.2:10.9:14.1] [ec:2.7.7.19] [keggfc:14.1] [sgdfc:4.10.0:9.5.0] [db:gtc-*saccharomyces cerevisiae*] |
| CONTIG911 | 24609517_f3_1 | 4920 | 19023 | 453 | 151 | YKR002W | 128 | 1.8(10)-7 | *Saccharomyces cerevisiae* | [ui:ykr002w] [pn:poly:a polymerase] [gn:pap1] [gtcfc:10.1:10.2:10.9:14.1] [ec:2.7.7.19] [keggfc:14.1] [sgdfc:4.10.0:9.5.0] [db:gtc-*saccharomyces cerevisiae*] |
| b2x15963.y | 4792178_f3_1 | 4921 | 19024 | 492 | 164 | YKR008W | 149 | 1.2(10)-9 | *Saccharomyces cerevisiae* | [ui:ykr008w] [pn:similarity to s.pombe and chicken bromodomain proteins:hypothetical 72.3 kd protein in mpl13-fox2 intergenic region] [gn:yk107] [gtcfc:10.1:10.2] [keggfc:14.2] [sgdk:4.8.2:9.5.0] [db:gtc-*saccharomyces cerevisiae*] |
| CONTIG1427 | 7111541_f1_1 | 4922 | 19025 | 252 | 84 | YKR054C | 98 | 0.00289 | *Saccharomyces cerevisiae* | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8.0:8.3.0:8.8.0:9.3.0:9.5.0] [db:gtc-*saccharomyces cerevisiae*] |
| CONTIG1427 | 29330380_f1_2 | 4923 | 19026 | 1104 | 368 | YKR054C | 648 | 1.2(10)-61 | *Saccharomyces cerevisiae* | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8.0:8.3.0:8.8.0:9.3.0:9.5.0] [db:gtc-*saccharomyces cerevisiae*] |
| CONTIG1148 | 6303188_c2_2 | 4924 | 19027 | 612 | 204 | YKR054C | 401 | 2.0(10)-35 | *Saccharomyces cerevisiae* | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8.0:8.3.0:8.8.0:9.3.0:9.5.0] [db:gtc-*saccharomyces cerevisiae*] |
| CONTIG4169 | 19822202_c2_3 | 4925 | 19028 | 2328 | 776 | YKR054C | 1077 | 3.5(10)-107 | *Saccharomyces cerevisiae* | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8.0:8.3.0:8.8.0:9.3.0:9.5.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2880 | 972203_f3_1 | 4926 | 19029 | 1224 | 408 | YKR054C | 271 | 1.2(10)-27 | Saccharomyces cerevisiae | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8:0:8.3:0:8.8:0:9.3:0:9.5.0] [db:gtc-saccharomyces cerevisiae] |
| CONTIG4797 | 4801525_c3_4 | 4927 | 19030 | 1467 | 489 | YKR054C | 248 | 4.5(10)-17 | Saccharomyces cerevisiae | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8:0:8.3:0:8.8:0:9.3:0:9.5.0] [db:gtc-saccharomyces cerevisiae] |
| CONTIG5802 | 22476703_c3_36 | 4928 | 19031 | 423 | 141 | YKR054C | 169 | 8.5(10)-11 | Saccharomyces cerevisiae | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8:0:8.3:0:8.8:0:9.3:0:9.5.0] [db:gtc-saccharomyces cerevisiae] |
| b9x13s62.x | 23555426_f3_1 | 4929 | 19032 | 396 | 132 | YKR054C | 293 | 5.9(10)-24 | Saccharomyces cerevisiae | [ui:ykr054c] [pn:dynein heavy chain, cytosolic:dyhc] [gn:dyn1:dhc1] [gtcfc:10.1:10.2:12.10:12.16:12.8] [keggfc:14.2] [sgdfc:3.8:0:8.3:0:8.8:0:9.3:0:9.5.0] [db:gtc-saccharomyces cerevisiae] |
| CONTIG5328 | 7070312_c3_18 | 4930 | 19033 | 1665 | 555 | YKR056W | 1260 | 1.8(10)-128 | Saccharomyces cerevisiae | [ui:ykr056w] [pn:endo-exonuclease:endo-exonuclease nucr] [gn:rnc1:nud1] [gtcfc:10.1:10.10:10.2:10.8:14.1] [ec:3.-.-.-] [keggfc:14.1] [sgdfc:3.7:0:9.5.0:11.2.1] [db:gtc-saccharomyces cerevisiae] |
| CONTIG3280 | 6064135_f3_4 | 4931 | 19034 | 423 | 141 | YKR062W | 352 | 3.0(10)-32 | Saccharomyces cerevisiae | [ui:ykr062w] [pn:tfiie subunit:transcription initiation factor, 43 kd:transcription initiation factor iie, beta subunit:tfiie-beta:transcription factor a small subunit:factor a 43 kd subunit] [gn:tfa2] [gtcfc:10.1:10.2] [keggfc:14.2] |
| CONTIG5588 | 14157757_c2_13 | 4932 | 19035 | 771 | 257 | YKR063C | 381 | 2.5(10)-35 | Saccharomyces cerevisiae | [ui:ykr063c] [pn:involved in cell morphogenesis, cytoskeletal regulation and bud formation:protein] [gn:las1] [gtcfc:10.1:10.2:12.8] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3308 | 3020818_c3_4 | 4933 | 19036 | 1377 | 459 | YKR072C | 292 | 7.0(10)-24 | *Saccharomyces cerevisiae* | [sgdfc:3.2.0:3.8.0:9.5.0] [db:gtc-*saccharomyces cerevisiae*] [ui:ykr072c] [pn:involved in cell cycle-specific gene expression;sis2 protein;halotolerance protein hal3] [gn:sis2:hal3] [gtcfc:10.1:10.2:12.8] [keggfc:14.2] |
| CONTIG1054 | 957875_f3_4 | 4934 | 19037 | 621 | 207 | YKR082W | 99 | 0.041 | *Saccharomyces cerevisiae* | [sgdfc:3.8.0:4.8.2:9.5.0] [db:gtc-*saccharomyces cerevisiae*] [ui:ykr082w] [pn:nuclear pore protein;nucleoporin nup133] [gn:nup133;ykr402] [gtcfc:10.1:10.2:12.3] [keggfc:14.2] |
| CONTIG2223 | 23673186_c1_4 | 4935 | 19038 | 819 | 273 | YKR082W | 102 | 0.03699 | *Saccharomyces cerevisiae* | [sgdfc:4.11.0:8.1.0:9.5.0] [db:gtc-*saccharomyces cerevisiae*] [ui:ykr082w] [pn:nuclear pore protein;nucleoporin nup133] [gn:nup133;ykr402] [gtcfc:10.1:10.2:12.3] [keggfc:14.2] |
| CONTIG5159 | 12286705_f2_3 | 4936 | 19039 | 726 | 242 | YKR086W | 372 | 3.7(10)-33 | *Saccharomyces cerevisiae* | [sgdfc:4.11.0:8.1.0:9.5.0] [db:gtc-*saccharomyces cerevisiae*] [ui:ykr086w] [pn:rna-dependent atpase;pre-mrna splicing factor rna helicase prp16] [gn:prp16;ykr406] [gtcfc:10.1:10.2] [keggfc:14.2] [sgdfc:4.9.0:9.5.0] [db:gtc-*saccharomyces cerevisiae*] |
| CONTIG3107 | 35291466_f2_1 | 4937 | 19040 | 2172 | 724 | YKR086W | 1200 | 1.8(10)-127 | *Saccharomyces cerevisiae* | [ui:ykr086w] [pn:rna-dependent atpase;pre-mrna splicing factor rna helicase prp16] [gn:prp16;ykr406] [gtcfc:10.1:10.2] [keggfc:14.2] [sgdfc:4.9.0:9.5.0] [db:gtc-*saccharomyces cerevisiae*] |
| CONTIG4377 | 34172162_f2_1 | 4938 | 19041 | 2262 | 754 | YKR092C | 98 | 0.00048 | *Saccharomyces cerevisiae* | [ui:ykr092c] [pn:supressor of mutant ac40 of rna polymerase i and iii;supressor protein srp40] [gn:srp40;ykr412a] [gtcfc:10.1:10.2] [keggfc:14.2] [sgdfc:4.12.0:9.5.0] [db:gtc-*saccharomyces cerevisiae*] |
| CONTIG4393 | 24018807_c1_7 | 4939 | 19042 | 1248 | 416 | YKR092C | 98 | 0.047 | *Saccharomyces cerevisiae* | [ui:ykr092c] [pn:supressor of mutant ac40 of rna polymerase i and iii;supressor protein srp40] [gn:srp40;ykr412a] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5299 | 4867180_f1_2 | 4940 | 19043 | 3681 | 1227 | YKR092C | 108 | 0.01499 | *Saccharomyces cerevisiae* | [gtcfc:10.1:1:10.2] [kegglc:14.2] [sgdfc:4.12.0:9.5.0] [db:gtc-*saccharomyces cerevisiae*] [ui:ykr092c] [pn:supressor of mutant ac40 of rna polymerase i and iii:supressor protein srp40] [gn:srp40:ykr412a] |
| CONTIG5594 | 43550787_f3_8 | 4941 | 19044 | 2511 | 837 | YKR092C | 107 | 0.012 | *Saccharomyces cerevisiae* | [gtcfc:10.1:1:10.2] [kegglc:14.2] [sgdfc:4.12.0:9.5.0] [db:gtc-*saccharomyces cerevisiae*] [ui:ykr092c] [pn:supressor of mutant ac40 of rna polymerase i and iii:supressor protein srp40] [gn:srp40:ykr412a] |
| CONTIG5660 | 24020325_c2_22 | 4942 | 19045 | 2130 | 710 | YKR092C | 99 | 0.04299 | *Saccharomyces cerevisiae* | [gtcfc:10.1:1:10.2] [kegglc:14.2] [sgdfc:4.12.0:9.5.0] [db:gtc-*saccharomyces cerevisiae*] [ui:ykr092c] [pn:supressor of mutant ac40 of rna polymerase i and iii:supressor protein srp40] [gn:srp40:ykr412a] |
| CONTIG5706 | 26772711_c3_25 | 4943 | 19046 | 1245 | 415 | YKR092C | 358 | 6.9(10)-33 | *Saccharomyces cerevisiae* | [gtcfc:10.1:1:10.2] [kegglc:14.2] [sgdfc:4.12.0:9.5.0] [db:gtc-*saccharomyces cerevisiae*] [ui:ykr092c] [pn:supressor of mutant ac40 of rna polymerase i and iii:supressor protein srp40] [gn:srp40:ykr412a] |
| CONTIG759 | 10945193_f1_1 | 4944 | 19047 | 1185 | 395 | YKR092C | 98 | 0.047 | *Saccharomyces cerevisiae* | [gtcfc:10.1:1:10.2] [kegglc:14.2] [sgdfc:4.12.0:9.5.0] [db:gtc-*saccharomyces cerevisiae*] [ui:ykr092c] [pn:supressor of mutant ac40 of rna polymerase i and iii:supressor protein srp40] [gn:srp40:ykr412a] |
| CONTIG1263 | 979711_f1_4 | 4945 | 19048 | 378 | 126 | YKR095W | 99 | 0.001 | *Saccharomyces cerevisiae* | [ui:ykr095w] [pn:myosin-like protein related to uso1p:myosin-like protein mlp1] [gn:mlp1:ykr415] |
| CONTIG1719 | 23438942_f2_1 | 4946 | 19049 | 855 | 285 | YKR095W | 91 | 0.65 | *Saccharomyces cerevisiae* | [kegglc:14.2] [sgdfc:9.5.0:11.2.1] [db:gtc-*saccharomyces cerevisiae*] [ui:ykr095w] [pn:myosin-like protein related to uso1p:myosin-like protein mlp1] [gn:mlp1:ykr415] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2276 | 24431336_f3_2 | 4947 | 19050 | 1062 | 354 | YKR095W | 106 | 0.028 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mtp1] [gn:mlp1:ykr415] |
| CONTIG2699 | 24492005_f1_1 | 4948 | 19051 | 738 | 246 | YKR095W | 123 | 0.00012 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG3289 | 19573957_f1_1 | 4949 | 19052 | 1110 | 370 | YKR095W | 133 | 4.5(10)-5 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG3870 | 9861078_f3_1 | 4950 | 19053 | 2229 | 743 | YKR095W | 176 | 1.5(10)-12 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG4435 | 1379415_f2_5 | 4951 | 19054 | 792 | 264 | YKR095W | 123 | 0.00019 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG5711 | 34187660_f3_7 | 4952 | 19055 | 2574 | 858 | YKR095W | 93 | 0.68 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| b9x10449.y | 26773516_c3_2 | 4953 | 19056 | 516 | 172 | YKR095W | 163 | 1.6(10)-10 | Saccharomyces cerevisiae | [gtcfc:10.1:10.10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11865.x | 1050933_c1_2 | 4954 | 19057 | 819 | 273 | YKR095W | 182 | 1.5(10)-12 | Saccharomyces cerevisiae | [gtcfc:10.1:10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG5679 | 25594034_c2_19 | 4955 | 19058 | 690 | 230 | YKR095W | 93 | 0.29999 | Saccharomyces cerevisiae | [gtcfc:10.1:10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| b2x10471.y | 98079969_c2_2 | 4956 | 19059 | 789 | 263 | YKR095W | 103 | 0.033 | Saccharomyces cerevisiae | [gtcfc:10.1:10:10.2] [keggfc:14.2] [sgdfc:9.5.0:11.2.1] [db:gtc-saccharomyces cerevisiae] [ui:ykr095w] [pn:myosin-like protein related to uso1p:myosin-like protein mlp1] [gn:mlp1:ykr415] |
| CONTIG5544 | 4098427_c1_16 | 4957 | 19060 | 951 | 317 | YKR099W | 551 | 4.7(10)-53 | Saccharomyces cerevisiae | [ui:ykr099w] [pn:transcription factor:myb-like dna-binding protein] [gn:bas1] [gtcfc:10.1:10.2] [keggfc:14.2] [sgdfc:1.1.2:1.3.5:4.8.2:9.5.0] [db:gtc-saccharomyces cerevisiae] |
| CONTIG4661 | 10626412_f2_2 | 4958 | 19061 | 273 | 91 | YLL039C | 164 | 1.2(10)-11 | Saccharomyces cerevisiae | [ui:yll039c] [pn:ubiquitin precursor] [gn:ubi4] [gtcfc:10.1:10.11:10.2:10.7:12.15:12.16:13.2] [keggfc:14.2] [sgdfc:3.4.0:5.5.0:6.4.0:6.5.1:9.2.0:9.5.0:11.1.0] [db:gtc-saccharomyces cerevisiae] |
| CONTIG5683 | 13834636_c2_22 | 4959 | 19062 | 714 | 238 | YLL039C | 1141 | 7.2(10)-116 | Saccharomyces cerevisiae | [ui:yll039c] [pn:ubiquitin precursor] [gn:ubi4] [gtcfc:10.1:10.11:10.2:10.7:12.15:12.16.13.2] [keggfc:14.2] [sgdfc:3.4.0:5.5.0:6.4.0:6.5.1:9.2.0:9.5.0:11.1.0] [db:gtc-saccharomyces cerevisiae] |
| CONTIG4777 | 3907830_c3_10 | 4960 | 19063 | 891 | 297 | YLL036C | 252 | 5.7(10)-21 | Saccharomyces cerevisiae | [ui:yll036c] [pn:non-snrnp sliceosome component required for dna repair:pre-mrna splicing factor prp19] [gn:prp19:pso4] [gtcfc:10.1:10.2] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1469 | 26692142_f3_2 | 4961 | 19064 | 444 | 148 | YLL011W | 95 | 0.01 | Saccharomyces cerevisiae | [sgdfc:4.9.0:9.5.0] [db:gtc-saccharomyces cerevisiae] [ui:yll011w] [pn:involved in 18s pre-rrna production:sof1 protein] [gn:sof1:11339] [gtcfc:10.1:10.2:10.3] [keggfc:14.2] [sgdfc:4.2.0:9.5.0] |
| CONTIG5367 | 23865811_c1_11 | 4962 | 19065 | 741 | 247 | YLL011W | 637 | 1.8(10)-62 | Saccharomyces cerevisiae | [db:gtc-saccharomyces cerevisiae] [ui:ll011w] [pn:involved in 18s pre-rrna production:sof1 protein] [gn:sof1:11339] [gtcfc:10.1:10.2:10.3] [keggfc:14.2] [sgdfc:4.2.0:9.5.0] |
| CONTIG5792 | 5079717_f2_6 | 4963 | 19066 | 1719 | 573 | YLL008W | 1466 | 5.7(10)-156 | Saccharomyces cerevisiae | [db:gtc-saccharomyces cerevisiae] [ui:yll008w] [pn:rna helicase of the dead box family:putative atp-dependent rna helicase drs1] [gn:drs1:11345] [gtcfc:10.1:10.2:10.3:12.16] [keggfc:14.2] [sgdfc:4.2.0:6.4.0:9.5.0] [db:gtc-saccharomyces cerevisiae] |
| CONTIG5612 | 10553426_f2_4 | 4964 | 19067 | 1758 | 586 | YLL004W | 120 | 0.00056 | Saccharomyces cerevisiae | [ui:yll004w] [pn:origin recognition complex, 62 kda subunit:origin recognition complex protein, subunit 3:origin recognition complex protein 62 kd subunit] [gn:orc3:oaf1:oif1:11365] [gtcfc:10.1:10.2:10.8:12.8:12.9] [keggfc:13.2] [sgdf |
| CONTIG5612 | 672342_f3_6 | 4965 | 19068 | 330 | 110 | YLL004W | 149 | 1.2(10)-9 | Saccharomyces cerevisiae | [ui:yll004w] [pn:origin recognition complex, 62 kda subunit:origin recognition complex protein, subunit 3:origin recognition complex protein 62 kd subunit] [gn:orc3:oaf1:oif1:11365] [gtcfc:10.1:10.2:10.8:12.8:12.9] [keggfc:13.2] [sgdf |
| CONTIG4626 | 19938160_c1_4 | 4966 | 19069 | 2445 | 815 | YLR014C | 449 | 6.9(10)-87 | Saccharomyces cerevisiae | [ui:ylr014c] [pn:transcription factor regulating pyrimidine pathway:pyrimidine pathway regulatory protein 1] [gn:ppr1] [gtcfc:10.1:10.2] [keggfc:14.2] [sgdfc:1.3.5:4.8.2:9.5.0] [db:gtc-saccharomyces cerevisiae] |
| CONTIG3082 | 6027043_f1_1 | 4967 | 19070 | 483 | 161 | YLR025W | 135 | 5.0(10)-9 | Saccharomyces cerevisiae | [ui:ylr025w] [pn:nuclear protein] [gn:snf7] [gtcfc:10.1:10.2:12.13:12.15] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4349 | 4491052_c3_5 | 4968 | 19071 | 690 | 230 | YLR025W | 204 | 1.3(10)-16 | Saccharomyces cerevisiae | [sgdfc:1.5:2:3.4:0:9.5.0] [db:gtc-saccharomyces cerevisiae] [ui:ylr025w] [pn:nuclear protein] [gn:snf7] [gtcfc:10.1:10.2:12.13:12.15] [keggfc:14.2] |
| CONTIG5645 | 24488443_c3_22 | 4969 | 19072 | 3270 | 1090 | YLR032W | 1383 | 8.6(10)-162 | Saccharomyces cerevisiae | [sgdfc:1.5:2:3.4:0:9.5.0] [db:gtc-saccharomyces cerevisiae] [ui:ylr032w] [pn:dna helicase:dna repair protein rad5] [gn:rad5:rev2:snm2] [gtcfc:10.1:10:10:10.2:10.8] [keggfc:14.2] |
| CONTIG5212 | 33406553_c3_19 | 4970 | 19073 | 1671 | 557 | YLR055C | 279 | 7.0(10)-22 | Saccharomyces cerevisiae | [sgdfc:3.7:0:9.5:0:11.2.1] [db:gtc-saccharomyces cerevisiae] [ui:ylr055c] [pn:transcription factor:transcription factor spt8] [gn:spt8:|2144] [gtcfc:10.1:10.2] [keggfc:14.2] [sgdfc:4.8.2:9.5.0] [db:gtc-saccharomyces cerevisiae] |
| CONTIG5484 | 12304525_c3_20 | 4971 | 19074 | 4026 | 1342 | YLR086W | 1879 | 4.5(10)-194 | Saccharomyces cerevisiae | [ui:ylr086w] [pn:similarity to chromosome condensation proteins] [gtcfc:10.1:10.2] [keggfc:14.2] [sgdfc:9.5.0:9.6.0] [db:gtc-saccharomyces cerevisiae] |
| CONTIG4418 | 16412511_f2_6 | 4972 | 19075 | 885 | 295 | YLR098C | 115 | 0.00069 | Saccharomyces cerevisiae | [ui:ylr098c] [pn:transcription factor:cha4 activatory protein] [gn:cha4:l8004] [gtcfc:10.1:10.2] [keggfc:14.2] [sgdfc:1.1.2:4.8.2:9.5.0] [db:gtc-saccharomyces cerevisiae] |
| CONTIG431 | 12696886_c3_3 | 4973 | 19076 | 672 | 224 | YLR105C | 182 | 1.2(10)-13 | Saccharomyces cerevisiae | [ui:ylr105c] [pn:trna splicing endonuclease beta subunit:trna-splicing endonuclease beta-subunit] [gn:sen2:l8004] [gtcfc:10.1:10.2:10.6] [keggfc:14.2] [sgdfc:4.5.0:9.5.0] [db:gtc-saccharomyces cerevisiae] |
| CONTIG1820 | 22850662_c3_3 | 4974 | 19077 | 534 | 178 | YLR131C | 227 | 7.2(10)-18 | Saccharomyces cerevisiae | [ui:ylr131c] [pn:metallothionein expression activator] [gn:ace2:13123:19606] [gtcfc:10.1:10.2:12.13:12.8] [keggfc:14.2] [sgdfc:1.5.2:3.9.0:4.8.2:9.5.0] [db:gtc-saccharomyces cerevisiae] |
| CONTIG4941 | 10979555_c2_6 | 4975 | 19078 | 327 | 109 | YLR147C | 280 | 1.3(10)-24 | Saccharomyces cerevisiae | [ui:ylr147c] [pn:strong similarity to small nuclear ribonucleoprotein d3:small nuclear ribonucleoprotein d3 homolog] [gn:smd3:l9634] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1039 | 6646892_c3_5 | 4976 | 19079 | 576 | 192 | YLR175W | 638 | 1.5(10)-62 | *Saccharomyces cerevisiae* | [gtcfc:10.1:10.2] [keggfc:14.2] [sgdfc:4.9.0:4.12.0:9.5.0] [db:gtc-*saccharomyces cerevisiae*] [ui:ylr175w] [pn:centromere/microtubule binding protein cbf5:p64"] [gn:cbf5:19470] [gtcfc:10.1:10.2:12.16:12.8] [keggfc:14.2] [sgdfc:3.1.0:3.8.0:9.3.0:9.5.0] [db:gtc-*saccharomyces cerevisiae*] |
| CONTIG2834 | 10634652_c3_6 | 4977 | 19080 | 303 | 101 | YLR175W | 398 | 4.0(10)-37 | *Saccharomyces cerevisiae* | [ui:ylr175w] [pn:centromere/microtubule binding protein cbf5:p64"] [gn:cbf5:19470] [gtcfc:10.1:10.2:12.16:12.8] [keggfc:14.2] [sgdfc:3.1.0:3.8.0:9.3.0:9.5.0] [db:gtc-*saccharomyces cerevisiae*] |
| CONTIG1246 | 13791410_f3_1 | 4978 | 19081 | 1074 | 358 | YLR176C | 135 | 7.4(10)-6 | *Saccharomyces cerevisiae* | [ui:ylr176c] [pn:dna binding protein] [gn:rfx1] [gtcfc:10.1:10.2:12.8] [keggfc:13.1] [sgdfc:4.8.2:9.5.0] [db:gtc-*saccharomyces cerevisiae*] |
| CONTIG4976 | 6270908_f2_3 | 4979 | 19082 | 2577 | 859 | YLR176C | 300 | 6.5(10)-37 | *Saccharomyces cerevisiae* | [ui:ylr176c] [pn:dna binding protein] [gn:rfx1] [gtcfc:10.1:10.2:12.8] [keggfc:13.1] [sgdfc:4.8.2:9.5.0] [db:gtc-*saccharomyces cerevisiae*] |
| CONTIG1268 | 15049000_f3_2 | 4980 | 19083 | 993 | 331 | YLR212C | 524 | 2.3(10)-60 | *Saccharomyces cerevisiae* | [ui:ylr212c] [pn:gamma tubulin:tubulin gamma chain] [gn:tub4:18167] [gtcfc:10.1:10.2:12.16:12.8] [keggfc:14.2] [sgdfc:3.8.0:9.3.0:9.5.0] [db:gtc-*saccharomyces cerevisiae*] |
| CONTIG4646 | 25423593_f3_2 | 4981 | 19084 | 408 | 136 | YLR212C | 105 | 4.4(10)-5 | *Saccharomyces cerevisiae* | [ui:ylr212c] [pn:gamma tubulin:tubulin gamma chain] [gn:tub4:18167] [gtcfc:10.1:10.2:12.16:12.8] [keggfc:14.2] [sgdfc:3.8.0:9.3.0:9.5.0] [db:gtc-*saccharomyces cerevisiae*] |
| CONTIG3156 | 33395062_f3_2 | 4982 | 19085 | 1497 | 499 | YLR234W | 819 | 1.5(10)-112 | *Saccharomyces cerevisiae* | [ui:ylr234w] [pn:dna topoisomerase iii] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4303 | 2948838_c2_5 | 4983 | 19086 | 1527 | 509 | YLR256W | 134 | 1.8(10)-5 | Saccharomyces cerevisiae | [gn:top3:edr1:18083] [gtcfc:10.1:10.2:12.8:14.1] [ec:5.99.1.2] [keggfc:14.1] [sgdfc:3.5.0:3.8.0:9.5.0] [db:gtc-saccharomyces cerevisiae] [ui:ylr256w] [pn:transcription factor:cyp1 activatory protein] [gn:cyp1:hap1] [gtcfc:10.1:10.2] [keggfc:14.2] [sgdfc:4.8.2:9.5.0] [db:gtc-saccharomyces cerevisiae] |
| CONTIG4762 | 2757655_f2_6 | 4984 | 19087 | 897 | 299 | YLR256W | 105 | 0.025 | Saccharomyces cerevisiae | [ui:ylr256w] [pn:transcription factor:cyp1 activatory protein] [gn:cyp1:hap1] [gtcfc:10.1:10.2] [keggfc:14.2] [sgdfc:4.8.2:9.5.0] [db:gtc-saccharomyces cerevisiae] |
| CONTIG5745 | 2504676_f2_5 | 4985 | 19088 | 2961 | 987 | YLR256W | 120 | 0.0032 | Saccharomyces cerevisiae | [ui:ylr256w] [pn:transcription factor:cyp1 activatory protein] [gn:cyp1:hap1] [gtcfc:10.1:10.2] [keggfc:14.2] [sgdfc:4.8.2:9.5.0] [db:gtc-saccharomyces cerevisiae] |
| b2x10621.y | 5163942_f3_2 | 4986 | 19089 | 762 | 254 | YLR256W | 165 | 7.5(10)-11 | Saccharomyces cerevisiae | [ui:ylr256w] [pn:transcription factor:cyp1 activatory protein] [gn:cyp1:hap1] [gtcfc:10.1:10.2] [keggfc:14.2] [sgdfc:4.8.2:9.5.0] [db:gtc-saccharomyces cerevisiae] |
| CONTIG2166 | 4948336_f3_4 | 4987 | 19090 | 747 | 249 | YLR274W | 802 | 6.2(10)-80 | Saccharomyces cerevisiae | [ui:ylr274w] [pn:cell division control protein:cell division control protein 46:minichromosome maintenance protein 5] [gn:cdc46:mcm5:19328] [gtcfc:10.1:10.2:10.8:12.8] [keggfc:13.2] [sgdfc:3.6.0:3.8.0:9.5.0] [db:gtc-saccharomyces cere |
| CONTIG3544 | 4351426_f3_5 | 4988 | 19091 | 1290 | 430 | YLR274W | 481 | 1.6(10)-80 | Saccharomyces cerevisiae | [ui:ylr274w] [pn:cell division control protein:cell division control protein 46:minichromosome maintenance protein 5] [gn:cdc46:mcm5:19328] [gtcfc:10.1:10.2:10.8:12.8] [keggfc:13.2] [sgdfc:3.6.0:3.8.0:9.5.0] [db:gtc-saccharomyces cere |
| CONTIG2166 | 22303177_c1_5 | 4989 | 19092 | 444 | 148 | YLR275W | 275 | 4.2(10)-24 | Saccharomyces cerevisiae | [ui:ylr275w] [pn:strong similarity to human snrnp chain d2 involved in systemic lupus erythematosus] [gtcfc:10.1:10.2] [keggfc:14.2] [sgdfc:4.9.0:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1262 | 565757_f2_3 | 4990 | 19093 | 939 | 313 | YLR277C | 711 | 2.7(10)-70 | Saccharomyces cerevisiae | [ui:ylr277c] [pn:component of pre-mrna polyadenylation factor pf i] [gn:brr5] [gtcfc:10.1:10.2:10.9] [kegggfc:14.2] [sgdfc:4.10.0:9.5.0] [db:gtc-saccharomyces cerevisiae] |
| b9x12m23.x | 35328538_f3_1 | 4991 | 19094 | 258 | 86 | YLR277C | 198 | 9.5(10)-15 | Saccharomyces cerevisiae | [ui:ylr277c] [pn:component of pre-mrna polyadenylation factor pf i] [gn:brr5] [gtcfc:10.1:10.2:10.9] [kegggfc:14.2] [sgdfc:4.10.0:9.5.0] [db:gtc-saccharomyces cerevisiae] |
| b9x12m23.x | 17007937_f3_2 | 4992 | 19095 | 297 | 99 | YLR277C | 95 | 0.001 | Saccharomyces cerevisiae | [ui:ylr277c] [pn:component of pre-mrna polyadenylation factor pf i] [gn:brr5] [gtcfc:10.1:10.2:10.9] [kegggfc:14.2] [sgdfc:4.10.0:9.5.0] [db:gtc-saccharomyces cerevisiae] |
| CONTIG731 | 390750_f2_1 | 4993 | 19096 | 708 | 236 | YLR293C | 1052 | 2.0(10)-106 | Saccharomyces cerevisiae | [ui:ylr293c] [pn:gtp-binding protein of the ras superfamily:gtp-binding nuclear protein gsp1/cnr1] [gn:gsp1:cnr1:cst17:l8003] [gtcfc:10.1:10.2:12.3] [kegggfc:14.2] [sgdfc:4.11.0:8.1.0:9.5.0] [db:gtc-saccharomyces cerevisiae] |
| CONTIG3079 | 26189181_f1_1 | 4994 | 19097 | 468 | 156 | YLR298C | 174 | 2.2(10)-13 | Saccharomyces cerevisiae | [ui:ylr298c] [pn:part of the u1 complex] [gtcfc:10.1:10.2] [kegggfc:14.2] [sgdfc:4.9.0:9.5.0] [db:gtc-saccharomyces cerevisiae] |
| CONTIG3116 | 6767786_f2_2 | 4995 | 19098 | 1314 | 438 | YLR335W | 142 | 1.8(10)-16 | Saccharomyces cerevisiae | [ui:ylr335w] [pn:nucleoporin:nuclear pore protein:p95] [gn:nup2] [gtcfc:10.1:10.2] [kegggfc:14.2] [sgdfc:8.1.0:9.5.0] [db:gtc-saccharomyces cerevisiae] |
| CONTIG4375 | 24398461_c3_9 | 4996 | 19099 | 1998 | 666 | YLR335W | 155 | 1.3(10)-7 | Saccharomyces cerevisiae | [ui:ylr335w] [pn:nucleoporin:nuclear pore protein:p95] [gn:nup2] [gtcfc:10.1:10.2] [kegggfc:14.2] [sgdfc:8.1.0:9.5.0] [db:gtc-saccharomyces cerevisiae] |
| CONTIG5399 | 26429087_f2_2 | 4997 | 19100 | 762 | 254 | YLR335W | 221 | 2.8(10)-17 | Saccharomyces cerevisiae | [ui:ylr335w] [pn:nucleoporin:nuclear pore protein:p95] [gn:nup2] [gtcfc:10.1:10.2] [kegggfc:14.2] [sgdfc:8.1.0:9.5.0] [db:gtc-saccharomyces cerevisiae] |
| CONTIG4994 | 471041_f3_5 | 4998 | 19101 | 1044 | 348 | YLR398C | 832 | 1.8(10)-82 | Saccharomyces cerevisiae | [ui:ylr398c] [pn:antiviral protein and putative helicase:antiviral protein] [gn:ski2] [gtcfc:10.1:10.2:12.12] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5760 | 4728438_c1_29 | 4999 | 19102 | 2208 | 736 | YLR398C | 1757 | 8.6(10)-199 | *Saccharomyces cerevisiae* | [keggfc:14.2] [sgdfc:9.5.0:11.3.0] [db:gtc-*saccharomyces cerevisiae*] [ui:ylr398c] [pn:antiviral protein and putative helicase:antiviral protein] [gn:ski2] [gtcfc:10.1:10.2:12.12] [keggfc:14.2] [sgdfc:9.5.0:11.3.0] [db:gtc-*saccharomyces cerevisiae*] |
| CONTIG5733 | 1210287_f1_1 | 5000 | 19103 | 498 | 166 | YLR403W | 128 | 2.5(10)-7 | *Saccharomyces cerevisiae* | [ui:ylr403w] [pn:zinc finger protein:zinc finger protein sfp1] [gn:sfp1:18084] [gtcfc:10.1:10.2:12.8] [keggfc:14.2] [sgdfc:3.1.0:3.8.0:9.5.0] [db:gtc-*saccharomyces cerevisiae*] |
| CONTIG5733 | 19738337_f2_5 | 5001 | 19104 | 864 | 288 | YLR403W | 479 | 1.8(10)-58 | *Saccharomyces cerevisiae* | [ui:ylr403w] [pn:zinc finger protein:zinc finger protein sfp1] [gn:sfp1:18084] [gtcfc:10.1:10.2:12.8] [keggfc:14.2] [sgdfc:3.1.0:3.8.0:9.5.0] [db:gtc-*saccharomyces cerevisiae*] |
| CONTIG3247 | 866708_f3_3 | 5002 | 19105 | 819 | 273 | YLR430W | 193 | 1.3(10)-12 | *Saccharomyces cerevisiae* | [ui:ylr430w] [pn:positive effector of trna-splicing endonuclease:trna-splicing endonuclease positive effector] [gn:sen1] [gtcfc:10.1:10.2:10.6] [keggfc:14.2] [sgdfc:4.5.0:9.5.0] [db:gtc-*saccharomyces cerevisiae*] |
| CONTIG3653 | 12985630_c3_8 | 5003 | 19106 | 2400 | 800 | YLR430W | 493 | 5.0(10)-61 | *Saccharomyces cerevisiae* | [ui:ylr430w] [pn:positive effector of trna-splicing endonuclease:trna-splicing endonuclease positive effector] [gn:sen1] [gtcfc:10.1:10.2:10.6] [keggfc:14.2] [sgdfc:4.5.0:9.5.0] [db:gtc-*saccharomyces cerevisiae*] |
| CONTIG4822 | 975727_f2_6 | 5004 | 19107 | 1218 | 406 | YLR430W | 594 | 2.8(10)-56 | *Saccharomyces cerevisiae* | [ui:ylr430w] [pn:positive effector of trna-splicing endonuclease:trna-splicing endonuclease positive effector] [gn:sen1] [gtcfc:10.1:10.2:10.6] [keggfc:14.2] [sgdfc:4.5.0:9.5.0] [db:gtc-*saccharomyces cerevisiae*] |
| b1x10463.y | 32244792_f2_1 | 5005 | 19108 | 729 | 243 | YLR430W | 392 | 8.8(10)-35 | *Saccharomyces cerevisiae* | [ui:ylr430w] [pn:positive effector of trna-splicing endonuclease:trna-splicing endonuclease positive effector] [gn:sen1] [gtcfc:10.1:10.2:10.6] [keggfc:14.2] [sgdfc:4.5.0:9.5.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5665 | 2915831_f2_3 | 5006 | 19109 | 2970 | 990 | YLR451W | 919 | 4.0(10)-121 | *Saccharomyces cerevisiae* | [db:gtc-saccharomyces cerevisiae] [ui:ylr451w] [pn:transcription factor:regulatory protein leu3] [gn:leu3:19324] [gtcfc:10.1:10.2] [kegfc:14.2] [sgdfc:1.1.2:4.8.2:9.5.0] [db:gtc-saccharomyces cerevisiae] |
| CONTIG5199 | 4475886_c1_9 | 5007 | 19110 | 3396 | 1132 | YML103C | 522 | 1.6(10)-61 | *Saccharomyces cerevisiae* | [ui:yml103c] [pn:nucleoporin:nuclear pore protein] [gn:nup188] [gtcfc:10.1:10.2] [keggfc:14.2] [sgdfc:8.1.0:9.5.0] [db:gtc-saccharomyces cerevisiae] |
| b9x11910.y | 31304582_f3_1 | 5008 | 19111 | 816 | 272 | YML103C | 354 | 6.5(10)-31 | *Saccharomyces cerevisiae* | [ui:yml103c] [pn:nucleoporin:nuclear pore protein] [gn:nup188] [gtcfc:10.1:10.2] [keggfc:14.2] [sgdfc:8.1.0:9.5.0] [db:gtc-saccharomyces cerevisiae] |
| CONTIG3719 | 24804033_f3_4 | 5009 | 19112 | 249 | 83 | YML103C | 93 | 0.0038 | *Saccharomyces cerevisiae* | [ui:yml103c] [pn:nucleoporin:nuclear pore protein] [gn:nup188] [gtcfc:10.1:10.2] [keggfc:14.2] [sgdfc:8.1.0:9.5.0] [db:gtc-saccharomyces cerevisiae] |
| CONTIG5722 | 6287811_f2_6 | 5010 | 19113 | 537 | 179 | YML098W | 166 | 1.5(10)-12 | *Saccharomyces cerevisiae* | [ui:yml098w] [pn:tfiid subunit:tbp-associated factor, 19 kd:protein] [gn:taf19:fun81] [gtcfc:10.1:10.2] [keggfc:14.2] [sgdfc:4.8.1:9.5.0] [db:gtc-saccharomyces cerevisiae] |
| CONTIG4302 | 20422716_c1_4 | 5011 | 19114 | 2253 | 751 | YML076C | 277 | 1.3(10)-40 | *Saccharomyces cerevisiae* | [ui:yml076c] [pn:weak similarity to transcription factor] [gtcfc:10.1:10.2] [keggfc:14.2] [sgdfc:4.8.2:9.5.0] [db:gtc-saccharomyces cerevisiae] |
| CONTIG3857 | 803758_f3_4 | 5012 | 19115 | 315 | 105 | YML074C | 130 | 7.0(10)-8 | *Saccharomyces cerevisiae* | [ui:yml074c] [pn:proline cis-trans isomerase:fk506-binding nuclear protein:peptidyl-prolyl cis-trans isomerase:ppiase:proline rotamase:nucleolar proline isomerase:fkbp-70] [gn:fpr3:npi46] [gtcfc:10.1:10.2:10.5:10.7:12.7:14.1] [ec:5.2] |
| CONTIG4014 | 9776061_f3_5 | 5013 | 19116 | 699 | 233 | YML069W | 591 | 1.3(10)-57 | *Saccharomyces cerevisiae* | [ui:yml069w] [pn:similarity to hmg proteins] [gn:pob3] [gtcfc:10.1:10.2] [keggfc:14.2] [sgdfc:9.5.0:9.6.0] [db:gtc-saccharomyces cerevisiae] |
| CONTIG4014 | 25948302_f3_6 | 5014 | 19117 | 207 | 69 | YML069W | 146 | 2.1(10)-9 | *Saccharomyces cerevisiae* | [ui:yml069w] [pn:similarity to hmg |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | proteins] [gn:pob3] [gtcfc:10.1:10.2] [kegfc:14.2] [sgdfc:9.5.0.9.6.0] [db:gtc-saccharomyces cerevisiae] |
| CONTIG1481 | 23836502_c3_8 | 5015 | 19118 | 753 | 251 | YML065W | 201 | 5.7(10)-15 | Saccharomyces cerevisiae | [ui:yml065w] [pn:origin recognition complex,104 kd subunit:origin recognition complex protein, subunit 1:origin recognition complex protein 120 kd subunit] [gn:orc1] [gtcfc:10.1:10.2:10.8:12.9] [sgdfc:13.2] [sgdfc:3.3.0:3.6.0:4 |
| CONTIG4399 | 14746043_f2_2 | 5016 | 19119 | 990 | 330 | YML065W | 279 | 2.6(10)-23 | Saccharomyces cerevisiae | [ui:yml065w] [pn:origin recognition complex, 104 kd subunit:origin recognition complex protein, subunit 1:origin recognition complex protein 120 kd subunit] [gn:orc1] [gtcfc:10.1:10.2:10.8:12.9] [sgdfc:13.2] [sgdfc:3.3.0:3.6.0:4 |
| CONTIG1465 | 20008541_c3_8 | 5017 | 19120 | 669 | 223 | YML060W | 466 | 2.5(10)-44 | Saccharomyces cerevisiae | [ui:yml060w] [pn:8-oxoguanine dna glycosylase] [gn:ogg1:ym9958] [gtcfc:10.1:10.10:10.2:14.1] [ec:3.2.2.-] [kegfc:14.1] [sgdfc:9.5.0:11.2.1] [db:gtc-saccharomyces cerevisiae] |
| CONTIG275 | 3913128_c1_1 | 5018 | 19121 | 786 | 262 | YML046W | 102 | 0.00869 | Saccharomyces cerevisiae | [ui:yml046w] [pn:pre-mrna splicing factor:pre-mrna processing protein prp39] [gn:prp39:ym9827] [gtcfc:10.1:10.2] [kegfc:14.2] [sgdfc:4.9.0:9.5.0] [db:gtc-saccharomyces cerevisiae] |
| CONTIG5049 | 25601563_f3_5 | 5019 | 19122 | 912 | 304 | YML046W | 105 | 0.0061 | Saccharomyces cerevisiae | [ui:yml046w] [pn:pre-mrna splicing factor:pre-mrna processing protein prp39] [gn:prp39:ym9827] [gtcfc:10.1:10.2] [kegfc:14.2] [sgdfc:4.9.0:9.5.0] [db:gtc-saccharomyces cerevisiae] |
| CONTIG3214 | 1213380_f3_1 | 5020 | 19123 | 1710 | 570 | YML043C | 260 | 8.9(10)-20 | Saccharomyces cerevisiae | [ui:yml043c] [pn:rrna polymerase i specific transcription initiation factor] [gn:rrn11] [kegfc:14.2] [sgdfc:4.1.0.9.5.0] |
| CONTIG5467 | 23844680_f1_4 | 5021 | 19124 | 507 | 169 | YML032C | 164 | 2.1(10)-11 | Saccharomyces cerevisiae | [ui:yml032c] [db:gtc-saccharomyces cerevisiae] [pn:recombination and dna repair protein:dna repair and recombination protein] [gn:rad52] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5726 | 82_c1_17 | 5022 | 19125 | 1839 | 613 | YML032C | 485 | 4.9(10)-54 | Saccharomyces cerevisiae | [gtcfc:10.1:10.10:10.2:10.8:12.9] [keggfc:14.2] [sgdfc:3.3.0:3.7.0:9.5.0:11.2.1] [db:gtc-saccharomyces cerevisiae] [ui:yml032c] [pn:recombination and dna repair protein:dna repair and recombination protein] [gn:rad52] |
| CONTIG5467 | 3384427_c3_19 | 5023 | 19126 | 1029 | 343 | YML031W | 123 | 0.00012 | Saccharomyces cerevisiae | [gtcfc:10.1:10.10:10.2:10.8:12.9] [keggfc:14.2] [sgdfc:3.3.0:3.7.0:9.5.0:11.2.1] [db:gtc-saccharomyces cerevisiae] [ui:yml031w] [pn:nuclear envelope protein] [gn:ndc1] [gtcfc:10.1:10.2:12.8] [keggfc:14.2] [sgdfc:3.8.0:9.5.0] |
| CONTIG3652 | 10243751_c3_3 | 5024 | 19127 | 651 | 217 | YML027W | 142 | 3.1(10)-9 | Saccharomyces cerevisiae | [db:gtc-saccharomyces cerevisiae] [ui:yml027w] [pn:homoeodomain protein:homeobox protein] [gn:yox1] [gtcfc:10.1:10.2] [keggfc:14.2] [sgdfc:4.12.0:9.5.0] [db:gtc-saccharomyces cerevisiae] |
| CONTIG5589 | 33150_f3_12 | 5025 | 19128 | 2799 | 933 | YML010W | 1134 | 4.0(10)-115 | Saccharomyces cerevisiae | [ui:yml010w] [pn:transcription initiation protein:transcription initiation protein spt5] [gn:spt5:ym9571] [gtcfc:10.1:10.2] [keggfc:14.2] [sgdfc:4.8.1:4.8.3:9.5.0] [db:gtc-saccharomyces cerevisiae] |
| CONTIG3572 | 26290937_f3_2 | 5026 | 19129 | 1056 | 352 | YML007W | 139 | 6.7(10)-14 | Saccharomyces cerevisiae | [ui:yml007w] [pn:transcriptional activator involved in oxidative stress response:transcriptional activator pdr4:yap-1 protein] [gn:pdr4:yap1:snq3:par1:ym9571] [gtcfc:10.1:10.2:13.2] [keggfc:14.2] [sgdfc:4.8.2:9.5.0:11.1.0] [db:gtc-sac |
| CONTIG3590 | 21910777_f3_1 | 5027 | 19130 | 258 | 86 | YML007W | 212 | 2.2(10)-16 | Saccharomyces cerevisiae | [ui:yml007w] [pn:transcriptional activator involved in oxidative stress response:transcriptional activator pdr4:yap-1 protein] [gn:pdr4:yap1:snq3:par1:ym9571] [gtcfc:10.1:10.2:13.2] [keggfc:14.2] [sgdfc:4.8.2:9.5.0:11.1.0] [db:gtc-sac |
| CONTIG5215 | 33750027_c3_14 | 5028 | 19131 | 543 | 181 | YML007W | 109 | 0.00083 | Saccharomyces cerevisiae | [ui:yml007w] [pn:transcriptional activator involved in oxidative |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1922 | 33254630_f2_2 | 5029 | 19132 | 1002 | 334 | YMR016C | 516 | 3.2(10)-49 | Saccharomyces cerevisiae | stress response:transcriptional activator pdr4:yap-1 protein] [gn:pdr4:yap1:snq3:par1:ym9571] [gtcfc:10.1:10.2:13.2] [keggfc:14.2] [sgdfc:4.8:2:9.5.0:11.1.0] [db:gtc-sac |
| CONTIG5673 | 6331442_f1_1 | 5030 | 19133 | 480 | 160 | YMR039C | 171 | 8.0(10)-13 | Saccharomyces cerevisiae | [ui:ymr016c] [pn:regulatory protein in the pka signal transduction pathway:sok2 protein] [gn:sok2:ym9711] [gtcfc:12.13] [keggfc:14.2] [sgdfc:3.2:0:4.8:2:9.5.0] [db:gtc-saccharomyces cerevisiae] |
| CONTIG4526 | 23906250_c1_7 | 5031 | 19134 | 1914 | 638 | YMR047C | 299 | 1.3(10)-35 | Saccharomyces cerevisiae | [ui:ymr039c] [pn:transcriptional coactivator:sub1 protein] [gn:sub1:ym9532] [gtcfc:10.1:10.2] [keggfc:14.2] [sgdfc:4.8:2:9.5.0] [db:gtc-saccharomyces cerevisiae] |
| CONTIG5667 | 34410090_f1_3 | 5032 | 19135 | 1344 | 448 | YMR047C | 199 | 2.1(10)-17 | Saccharomyces cerevisiae | [ui:ymr047c] [pn:nuclear pore protein:nucleoporin nup116/nsp116:nuclear pore protein nup116/nsp116] [gn:nup116:nsp116:ym9532] [gtcfc:10.1:10.2:10.6] [keggfc:14.2] [sgdfc:4.5:0:8.1:0:9.5.0] [db:gtc-saccharomyces cerevisiae] |
| CONTIG4321 | 21657628_c2_9 | 5033 | 19136 | 2076 | 692 | YMR061W | 572 | 1.8(10)-70 | Saccharomyces cerevisiae | [ui:ymr047c] [pn:nuclear pore protein:nucleoporin nup116/nsp116:nuclear pore protein nup116/nsp116] [gn:nup116:nsp116:ym9532] [gtcfc:10.1:10.2:10.6] [keggfc:14.2] [sgdfc:4.5:0:8.1:0:9.5.0] [db:gtc-saccharomyces cerevisiae] |
| CONTIG5784 | 26285905_f2_5 | 5034 | 19137 | 2346 | 782 | YMR078C | 258 | 2.2(10)-38 | Saccharomyces cerevisiae | [ui:ymr061w] [pn:component of pre-mrna 3"-end processing factor cfi:mma 3"-end processing protein rna14] [gn:rna14:ym9796] [gtcfc:10.1:10.2:10.9] [keggfc:14.2] [sgdfc:4.10.0:9.5.0] [db:gtc-saccharomyces cerevisiae] |
| | | | | | | | | | | [ui:ymr078c] [pn:required for accurate chromosome transmission in mitosis and maintenance of normal telomere length:chl12 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5784 | 24010800_f3_9 | 5035 | 19138 | 312 | 104 | YMR078C | 165 | 3.0(10)-11 | Saccharomyces cerevisiae | protein] [gn:ch12:ctf18:ym9582] [gtcfc:10.1:10.2:12.8] [keggfc:14.2] [sgdfc:3.8.0:9.5.0] [db:gtc-saccharomyces [ui:ymr078c] [pn:required for accurate chromosome transmission in mitosis and maintenance of normal telomere length:ch112 protein] [gn:ch12:ctf18:ym9582] [gtcfc:10.1:10.2:12.8] [keggfc:14.2] [sgdfc:3.8.0:9.5.0] [db:gtc-saccharomyces |
| CONTIG5813 | 30209777_f3_31 | 5036 | 19139 | 1596 | 532 | YMR106C | 181 | 1.2(10)-10 | Saccharomyces cerevisiae | [ui:ymr106c] [pn:component of dna end-joining repair pathway [gn:hdf2] [gtcfc:10.1:10.2:10.8] [keggfc:14.2] [sgdfc:3.7.0:9.5.0] [db:gtc-saccharomyces cerevisiae] |
| CONTIG1251 | 35589436_f2_1 | 5037 | 19140 | 1236 | 412 | YMR129W | 269 | 7.5(10)-21 | Saccharomyces cerevisiae | [ui:ymr129w] [pn:nuclear pore membrane glycoprotein:nuclear envelope pore membrane protein pom152:p150] [gn:pom152:ym9553] [gtcfc:10.1:10.2] [keggfc:14.2] [sgdfc:8.1.0:9.5.0] [db:gtc-saccharomyces cerevisiae] |
| CONTIG1780 | 10426006_f2_2 | 5038 | 19141 | 792 | 264 | YMR129W | 280 | 3.6(10)-23 | Saccharomyces cerevisiae | [ui:ymr129w] [pn:nuclear pore membrane glycoprotein:nuclear envelope pore membrane protein pom152:p150] [gn:pom152:ym9553] [gtcfc:10.1:10.2] [keggfc:14.2] [sgdfc:8.1.0:9.5.0] [db:gtc-saccharomyces cerevisiae] |
| CONTIG3661 | 161018_c3_5 | 5039 | 19142 | 273 | 91 | YMR129W | 225 | 2.6(10)-17 | Saccharomyces cerevisiae | [ui:ymr129w] [pn:nuclear pore membrane glycoprotein:nuclear envelope pore membrane protein pom152:p150] [gn:pom152:ym9553] [gtcfc:10.1:10.2] [keggfc:14.2] [sgdfc:8.1.0:9.5.0] [db:gtc-saccharomyces cerevisiae] |
| CONTIG2419 | 26455011_f1_2 | 5040 | 19143 | 1257 | 419 | YMR137C | 121 | 9.0(10)-17 | Saccharomyces cerevisiae | [ui:ymr137c] [pn:dna repair protein] [gn:pso2] [gtcfc:10.1:10.10:10.2] [keggfc:14.2] [sgdfc:9.5.0:11.2.1] [db:gtc-saccharomyces cerevisiae] |
| CONTIG5566 | 24414092_f2_11 | 5041 | 19144 | 1677 | 559 | YMR137C | 129 | 6.9(10)-5 | Saccharomyces cerevisiae | [ui:ymr137c] [pn:dna repair protein] [gn:pso2] [gtcfc:10.1:10.10:10.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1457 | 6834800_c3_1 | 5042 | 19145 | 549 | 183 | YMR167W | 340 | 5.0(10)-30 | *Saccharomyces cerevisiae* | [keggfc:14.2] [sgdfc:9.5.0:11.2.1] [db:gtc-*saccharomyces cerevisiae*] [ui:ymr167w] [pn:dna mismatch repair protein:mut1 protein homolog 1:dna mismatch repair protein mlh1] [gn:mlh1:ym8520] [gtcfc:10.1:10.2:10.8] |
| CONTIG2822 | 24428937_c3_1 | 5043 | 19146 | 1221 | 407 | YMR167W | 375 | 6.0(10)-50 | *Saccharomyces cerevisiae* | [keggfc:14.2] [sgdfc:3.7.0:9.5.0] [db:gtc-*saccharomyces cerevisiae*] [ui:ymr167w] [pn:dna mismatch repair protein:mut1 protein homolog 1:dna mismatch repair protein mlh1] [gn:mlh1:ym8520] [gtcfc:10.1:10.2:10.8] |
| CONTIG3961 | 21917137_f2_2 | 5044 | 19147 | 735 | 245 | YMR167W | 670 | 6.0(10)-66 | *Saccharomyces cerevisiae* | [keggfc:14.2] [sgdfc:3.7.0:9.5.0] [db:gtc-*saccharomyces cerevisiae*] [ui:ymr167w] [pn:dna mismatch repair protein:mut1 protein homolog 1:dna mismatch repair protein mlh1] [gn:mlh1:ym8520] [gtcfc:10.1:10.2:10.8] |
| CONTIG4228 | 12540775_c3_11 | 5045 | 19148 | 654 | 218 | YMR167W | 297 | 2.2(10)-25 | *Saccharomyces cerevisiae* | [keggfc:14.2] [sgdfc:3.7.0:9.5.0] [db:gtc-*saccharomyces cerevisiae*] [ui:ymr167w] [pn:dna mismatch repair protein:mut1 protein homolog 1:dna mismatch repair protein mlh1] [gn:mlh1:ym8520] [gtcfc:10.1:10.2:10.8] |
| CONTIG5344 | 6027165_f1_4 | 5046 | 19149 | 684 | 228 | YMR197C | 333 | 3.1(10)-30 | *Saccharomyces cerevisiae* | [ui:ymr197c] [pn:similarity to ntf1p] [gtcfc:10.1:10.2:12.8] [keggfc:14.2] [sgdfc:3.9.0:9.5.0] [db:gtc-*saccharomyces cerevisiae*] |
| CONTIG5111 | 16838411_c1_13 | 5047 | 19150 | 1197 | 399 | YMR201C | 564 | 3.3(10)-59 | *Saccharomyces cerevisiae* | [ui:ymr201c] [pn:nucleotide excision repair protein:dna repair protein rad14] [gn:rad14:ym8325] [gtcfc:10.1:10.10:10.2] [keggfc:14.2] [sgdfc:9.5.0:11.2.1] [db:gtc-*saccharomyces cerevisiae*] |
| CONTIG4328 | 24883563_c1_3 | 5048 | 19151 | 810 | 270 | YMR224C | 782 | 8.0(10)-78 | *Saccharomyces cerevisiae* | [ui:ymr224c] [pn:dna repair and meiotic recombination protein:mre11 protein] [gn:mre11:ym9959] [gtcfc:10.1:10.2:10.8:12.8] [keggfc:14.2] |
| CONTIG648 | 4885950_c2_5 | 5049 | 19152 | 717 | 239 | YMR224C | 108 | 3.5(10)-5 | *Saccharomyces cerevisiae* | [sgdfc:3.5.0:3.7.0:9.5.0] [db:gtc-*saccharomyces cerevisiae*] [ui:ymr224c] [pn:dna repair and |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG648 | 15801542_c1_4 | 5050 | 19153 | 246 | 82 | YMR224C | 156 | 2.5(10)-10 | Saccharomyces cerevisiae | meiotic recombination protein:mre11 protein [gn:mre11:ym9959] [gtcfc:10.1:10.2:10.8:12.8] [keggfc:14.2] [sgdfc:3.5.0:3.7.0:9.5.0] [db:gtc-saccharomyces cerevisiae] [ui:ymr224c] [pn:dna repair and meiotic recombination protein:mre11 protein] [gn:mre11:ym9959] [gtcfc:10.1:10.2:10.8:12.8] [keggfc:14.2] [sgdfc:3.5.0:3.7.0:9.5.0] [db:gtc-saccharomyces cerevisiae] |
| CONTIG5817 | 24807938_c3_63 | 5051 | 19154 | 5262 | 1754 | YMR229C | 2455 | 0 | Saccharomyces cerevisiae | [ui:ymr229c] [pn:processing of pre-ribosomal rna] [gn:rrp5] [gtcfc:10.1:10.2:10.3] [keggfc:14.2] [sgdfc:4.2.0:9.5.0] [db:gtc-saccharomyces cerevisiae] |
| CONTIG5046 | 32087818_f2_2 | 5052 | 19155 | 255 | 85 | YMR240C | 156 | 1.2(10)-10 | Saccharomyces cerevisiae | [ui:ymr240c] [pn:u2 snrnp protein] [gn:cus1] [gtcfc:10.1:10.2] [keggfc:14.2] [sgdfc:4.9.0:9.5.0] [db:gtc-saccharomyces cerevisiae] |
| CONTIG5046 | 26620138_f3_3 | 5053 | 19156 | 804 | 268 | YMR240C | 178 | 4.7(10)-13 | Saccharomyces cerevisiae | [ui:ymr240c] [pn:u2 snrnp protein] [gn:cus1] [gtcfc:10.1:10.2] [keggfc:14.2] [sgdfc:4.9.0:9.5.0] [db:gtc-saccharomyces cerevisiae] |
| CONTIG3657 | 24413880_c1_3 | 5054 | 19157 | 1824 | 608 | YMR239C | 449 | 1.6(10)-42 | Saccharomyces cerevisiae | [ui:ymr239c] [pn:double-stranded ribonuclease] [gn:rnt1] [gtcfc:10.1:10.2:10.3] [keggfc:14.2] [sgdfc:4.2.0:9.5.0] [db:gtc-saccharomyces cerevisiae] |
| CONTIG5748 | 21692010_f3_10 | 5055 | 19158 | 2049 | 683 | YMR239C | 160 | 1.8(10)-8 | Saccharomyces cerevisiae | [ui:ymr239c] [pn:double-stranded ribonuclease] [gn:rnt1] [gtcfc:10.1:10.2:10.3] [keggfc:14.2] [sgdfc:4.2.0:9.5.0] [db:gtc-saccharomyces cerevisiae] |
| CONTIG5739 | 21914553_f1_6 | 5056 | 19159 | 2889 | 963 | YMR268C | 281 | 1.0(10)-21 | Saccharomyces cerevisiae | [ui:ymr268c] [pn:pre-mrna splicing factor:u4/u6 snrna-associated splicing factor prp24:u4/u6snrp protein] [gn:prp24:ym8156] [gtcfc:10.1:10.2] [keggfc:14.2] [sgdfc:4.9.0:9.5.0] [db:gtc-saccharomyces cerevisiae] |
| CONTIG5322 | 10975930_f1_2 | 5057 | 19160 | 1026 | 342 | YMR276W | 570 | 2.3(10)-55 | Saccharomyces cerevisiae | [ui:ymr276w] [pn:ubiquitin-like protein:ubiquitin-like protein dsk2] [gn:dsk2:she4:ym8021] [gtcfc:10.1:10.2:12.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5482 | 1365936_f3_13 | 5058 | 19161 | 2466 | 822 | YMR284W | 144 | 1.2(10)-25 | Saccharomyces cerevisiae | [keggfc:14.2] [sgdfc:3.8.0.9.5.0] [db:gtc-saccharomyces cerevisiae] [ui:ymr284w] [pn:high-affinity dna-binding protein:high affinity dna-binding factor subunit 1:ku70 homolog] [gn:hdf1:nes24:yku70:ym8021] [gtcfc:10.1:10.2:10.8] [keggfc:14.2] [sgdfc:3.6.0:3.7.0.9.5.0] [db:gtc-saccharomyces cerevisiae] |
| CONTIG5428 | 2432827_c1_12 | 5059 | 19162 | 564 | 188 | YNL330C | 117 | 2.0(10)-6 | Saccharomyces cerevisiae | [ui:ynl330c] [pn:transcription modifier protein:histone deacetylase:transcriptional regulatory protein rpd3] [gn:rpd3:sdi2:n0305] [gtcfc:10.1:10.2:12.15:12.9.13.10] [keggfc:14.2] [sgdfc:1.4.1.3.3.0:3.4.0:4.8.2:9.5.0] [db:gtc-saccharom |
| CONTIG5428 | 390932_c3_7 | 5060 | 19163 | 1347 | 449 | YNL330C | 1756 | 5.0(10)-181 | Saccharomyces cerevisiae | [ui:ynl330c] [pn:transcription modifier protein:histone deacetylase:transcriptional regulatory protein rpd3] [gn:rpd3:sdi2:n0305] [gtcfc:10.1:10.2:12.15:12.9.13.10] [keggfc:14.2] [sgdfc:1.4.1.3.3.0:3.4.0:4.8.2:9.5.0] [db:gtc-saccharom |
| CONTIG5485 | 24492127_f3_6 | 5061 | 19164 | 1524 | 508 | YNL330C | 1678 | 9.0(10)-173 | Saccharomyces cerevisiae | [ui:ynl330c] [pn:transcription modifier protein:histone deacetylase:transcriptional regulatory protein rpd3] [gn:rpd3:sdi2:n0305] [gtcfc:10.1:10.2:12.15:12.9.13.10] [keggfc:14.2] [sgdfc:1.4.1.3.3.0:3.4.0:4.8.2:9.5.0] [db:gtc-saccharom |
| CONTIG4245 | 21745192_f2_3 | 5062 | 19165 | 543 | 181 | YNL312W | 254 | 7.2(10)-22 | Saccharomyces cerevisiae | [ui:ynl312w] [pn:dna replication factor a, 36 kda subunit:replication factor-a protein 2:rf-a:dna binding protein buf1] [gn:rfa2:buf1:n0368] [gtcfc:10.1:10.2:10.8] [keggfc:14.2] [sgdfc:3.6.0.9.5.0] [db:gtc-saccharomyces cerevisiae] |
| CONTIG4341 | 9851567_f2_2 | 5063 | 19166 | 1098 | 366 | YNL290W | 1044 | 1.3(10)-105 | Saccharomyces cerevisiae | [ui:ynl290w] [pn:dna replication factor c, 40 kda subunit:activator 1 40 kd subunit:replication factor c 40 kd subunit] [gn:rfc3:n0533] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5417 | 24407812_f1_2 | 5064 | 19167 | 765 | 255 | YNL282W | 159 | 8.4(10)-12 | Saccharomyces cerevisiae | [gtcfc:10.1:10.2:10.8] [keggfc:14.2] [sgdfc:3.6.0.9.5.0] [db:gtc-saccharomyces cerevisiae] [ui:ynl282w] [pn:involved in processsing of trnas and rrnas:hypothetical 22.6 kd protein in mpl10-erg24 intergenic region] [gn:pop3:n0586] [gtcfc:10.1:10.2:10.3:10.6] [keggfc:14.2] [sgdfc:4.2.0:4.5.0:9.5.0] [db:gtc-saccharomyces cere |
| CONTIG2384 | 36117188_f2_2 | 5065 | 19168 | 573 | 191 | YNL261W | 113 | 1.6(10)-9 | Saccharomyces cerevisiae | [ui:ynl261w] [pn:origin recognition complex, 50 kda subunit:origin recognition complex protein, subunit 5:origin recognition complex protein 53 kd subunit] [gn:orc5:n0834] [gtcfc:10.1:10.2:10.8:12.9] [keggfc:13.2] [sgdfc:3.3.0.3. |
| CONTIG5793 | 4898311_c3_24 | 5066 | 19169 | 2073 | 691 | YNL251C | 628 | 3.7(10)-80 | Saccharomyces cerevisiae | [ui:ynl251c] [pn:involved in regulation of nuclear pre-mrna abundance:nrd1 protein] [gn:nrd1:n0868] [gtcfc:10.1:10.2] [keggfc:14.2] [sgdfc:4.8.2:9.5.0] [db:gtc-saccharomyces cerevisiae] |
| CONTIG1211 | 16282280_f3_1 | 5067 | 19170 | 609 | 203 | YNL250W | 159 | 2.7(10)-10 | Saccharomyces cerevisiae | [ui:ynl250w] [pn:dna repair protein:dna repair protein rad50:153 kd protein] [gn:rad50:n0872] [gtcfc:10.1:10.2:10.8:12.8] [keggfc:14.2] [sgdfc:3.5.0:3.7.0:9.5.0] [db:gtc-saccharomyces cerevisiae] |
| CONTIG2192 | 797518_c2_2 | 5068 | 19171 | 723 | 241 | YNL250W | 604 | 8.6(10)-58 | Saccharomyces cerevisiae | [ui:ynl250w] [pn:dna repair protein:dna repair protein rad50:153 kd protein] [gn:rad50:n0872] [gtcfc:10.1:10.2:10.8:12.8] [keggfc:14.2] [sgdfc:3.5.0:3.7.0:9.5.0] [db:gtc-saccharomyces cerevisiae] |
| CONTIG4056 | 9788502_f1_1 | 5069 | 19172 | 1038 | 346 | YNL250W | 103 | 0.03599 | Saccharomyces cerevisiae | [ui:ynl250w] [pn:dna repair protein:dna repair protein rad50:153 kd protein] [gn:rad50:n0872] [gtcfc:10.1:10.2:10.8:12.8] [keggfc:14.2] [sgdfc:3.5.0:3.7.0:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5341 | 24854706_c1_14 | 5070 | 19173 | 1335 | 445 | YNL250W | 891 | 7.0(10)-89 | Saccharomyces cerevisiae | saccharomyces cerevisiae [ui:ynl250w] [pn:dna repair protein:dna repair protein rad50:153 kd protein] [gn:rad50:n0872] [gtcfc:10.1:10.2:10.8:12.8] [keggfc:14.2] [sgdfc:3.5.0:3.7.0:9.5.0] [db:gtc-saccharomyces cerevisiae] |
| b1x11175.y | 11194187_f3_1 | 5071 | 19174 | 279 | 93 | YNL250W | 118 | 6.4(10)-6 | Saccharomyces cerevisiae | saccharomyces cerevisiae [ui:ynl250w] [pn:dna repair protein:dna repair protein rad50:153 kd protein] [gn:rad50:n0872] [gtcfc:10.1:10.2:10.8:12.8] [keggfc:14.2] [sgdfc:3.5.0:3.7.0:9.5.0] [db:gtc-saccharomyces cerevisiae] |
| CONTIG4568 | 24804628_c1_6 | 5072 | 19175 | 1008 | 336 | YNL236W | 119 | 0.00038 | Saccharomyces cerevisiae | saccharomyces cerevisiae [ui:ynl236w] [pn:global-regulator protein:global transcriptional regulator sin4] [gn:sin4:tsf3:bel2:gal22:ssf5:n1135] [gtcfc:10.1:10.2:12.13:12.15:12.9] [keggfc:14.2] [sgdfc:1.1.2:1.5.2:3.3.0:3.4.0:4.8.2:9.5.0] [db:gtc-saccharomyces cerevisiae] |
| CONTIG4979 | 3990636_f2_5 | 5073 | 19176 | 732 | 244 | YNL222W | 544 | 1.5(10)-58 | Saccharomyces cerevisiae | [ui:ynl222w] [pn:suppressor of cs mutant of sua7:ssu72 protein] [gn:ssu72:n1279] [gtcfc:10.1:10.2] [keggfc:14.2] [sgdfc:4.8.2:9.5.0] [db:gtc-saccharomyces cerevisiae] |
| CONTIG4979 | 2922250_f2_6 | 5074 | 19177 | 897 | 299 | YNL221C | 442 | 7.0(10)-41 | Saccharomyces cerevisiae | [ui:ynl221c] [pn:protein component of ribonuclease p and ribonuclease mrp:pop1 protein] [gn:pop1:n1285] [gtcfc:10.1:10.2:10.3:10.6] [keggfc:14.2] [sgdfc:4.2.0:4.5.0:9.5.0] [db:gtc-saccharomyces cerevisiae] |
| CONTIG2176 | 11844207_f1_1 | 5075 | 19178 | 723 | 241 | YNL206C | 220 | 1.3(10)-17 | Saccharomyces cerevisiae | [ui:ynl206c] [pn:similarity to structure-specific recognition proteins:hypothetical 51.6 kd protein in ssb2-spx18 intergenic region] [gn:n1346] [gtcfc:10.1:10.2] [keggfc:14.2] [sgdfc:9.5.0:9.6.0] [db:gtc-saccharomyces cerevisiae] |
| CONTIG4506 | 2007662_c3_16 | 5076 | 19179 | 1671 | 557 | YNL189W | 1978 | 1.5(10)-204 | Saccharomyces cerevisiae | [ui:ynl189w] [pn:karyopherin-alpha or importin:importin alpha subunit:karyopherin alpha |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3708 | 4688950_c2_8 | 5077 | 19180 | 1695 | 565 | YNL172W | 617 | 7.0(10)-79 | Saccharomyces cerevisiae | subunit:serine-rich rna polymerase i suppressor protein] [gn:srp1:kap60:n1606] [gtcfc:10.1:10.2:12.8] [keggfc:14.2] [sgdfc:3.8.0:8.1.0:9.5.0] [db: ui:ynl172w] [pn:subunit of anaphase-promoting complex:cyclosome:hypothetical 196.1 kd protein in rps3-psd1 intergenic region] [gn:apc1:n1677] [gtcfc:10.1:10.2:12.8] [keggfc:14.2] [sgdfc:3.8.0:9.5.0] [db:gtc-saccharomyces cerevisiae] |
| CONTIG3902 | 23914011_f2_2 | 5078 | 19181 | 708 | 236 | YNL167C | 93 | 8.0(10)-5 | Saccharomyces cerevisiae | [ui:ynl167c] [pn:cre-binding bzip protein:cre-binding bzip protein sko1] [gn:sko1:acr1:n1702] [gtcfc:10.1:10.2] [keggfc:14.2] [sgdfc:4.8.2:9.5.0] [db:gtc-saccharomyces cerevisiae] |
| CONTIG4103 | 35303_f2_2 | 5079 | 19182 | 1611 | 537 | YNL126W | 583 | 1.6(10)-56 | Saccharomyces cerevisiae | [ui:ynl126w] [pn:spindle pole body component:spindle pole body component spc98] [gn:spc98:n1222:n1879] [gtcfc:10.1:10.2:11.1:12.16:12.8] [keggfc:14.2] [sgdfc:3.8.0:9.1.0:9.2.0:9.3.0:9.5.0] [db:gtc-saccharomyces cerevisiae] |
| CONTIG3467 | 325_c3_3 | 5080 | 19183 | 396 | 132 | YNL112W | 250 | 1.2(10)-20 | Saccharomyces cerevisiae | [ui:ynl112w] [pn:atp-dependent rna helicase of dead box family:p68-like protein] [gn:dbp2:n1945] [gtcfc:10.1:10.2:10.3] [keggfc:14.2] [sgdfc:4.2.0:9.5.0] [db:gtc-saccharomyces cerevisiae] |
| CONTIG4462 | 860660_c3_4 | 5081 | 19184 | 1377 | 459 | YNL112W | 1556 | 7.7(10)-160 | Saccharomyces cerevisiae | [ui:ynl112w] [pn:atp-dependent rna helicase of dead box family:p68-like protein] [gn:dbp2:n1945] [gtcfc:10.1:10.2:10.3] [keggfc:14.2] [sgdfc:4.2.0:9.5.0] [db:gtc-saccharomyces cerevisiae] |
| CONTIG2968 | 10329700_c2_3 | 5082 | 19185 | 1374 | 458 | YNL088W | 1270 | 1.6(10)-129 | Saccharomyces cerevisiae | [ui:ynl088w] [pn:atp-hydrolysing:dna topoisomerase ii] [gn:top2:tor3:n2244] [gtcfc:10.1:10.2:10.8:14.1] [ec:5.99.1.3] [keggfc:14.1] [sgdfc:3.6.0:3.7.0:9.5.0] [db:gtc-saccharomyces cerevisiae] |
| b3x14031.y | 19962524_c1_2 | 5083 | 19186 | 486 | 162 | YNL088W | 506 | 3.2(10)-47 | Saccharomyces cerevisiae | [ui:ynl088w] [pn:atp-hydrolysing:dna topoisomerase ii] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1244 | 953127_f2_2 | 5084 | 19187 | 999 | 333 | YNL068C | 429 | 3.3(10)-60 | Saccharomyces cerevisiae | [gn:top2:tor3:n2244] [gtcfc:10.1:10.2:10.8:14.1] [ec:5.99.1.3] [keggfc:14.1] [sgdfc:3.6.0:3.7.0:9.5.0] [db:gtc-saccharomyces cerevisiae] [ui:ynl068c] [pn:homology to d.melanogaster forkhead protein:fork head protein homolog 2] [gn:fkh2:n2403:ynl2403c] [gtcfc:10.1:10.2] [keggfc:14.2] [sgdfc:4.12.0:9.5.0] [db:gtc-saccharomyces cerevisiae] |
| CONTIG3621 | 18813_c3_5 | 5085 | 19188 | 1560 | 520 | YNL061W | 1727 | 5.9(10)-178 | Saccharomyces cerevisiae | [ui:ynl061w] [pn:nucleolar protein:nucleolar protein nop2] [gn:nop2:yna1:n2428:ynl2428w] [gtcfc:10.1] [keggfc:14.2] [sgdfc:9.5.0:13.0.0] [db:gtc-saccharomyces cerevisiae] |
| CONTIG5691 | 19723308_f2_11 | 5086 | 19189 | 363 | 121 | YNL059C | 111 | 1.8(10)-5 | Saccharomyces cerevisiae | [ui:ynl059c] [pn:actin-related protein:hypothetical 87.6 kd protein in nop2-omp2 intergenic region] [gn:arp5:n2430:ynl2430c] [gtcfc:10.1:10.2:12.16] [keggfc:14.2] [sgdfc:9.3.0:9.5.0] [db:gtc-saccharomyces cerevisiae] |
| CONTIG5691 | 10335462_f3_18 | 5087 | 19190 | 1797 | 599 | YNL059C | 884 | 1.3(10)-88 | Saccharomyces cerevisiae | [ui:ynl059c] [pn:actin-related protein:hypothetical 87.6 kd protein in nop2-omp2 intergenic region] [gn:arp5:n2430:ynl2430c] [gtcfc:10.1:10.2:12.16] [keggfc:14.2] [sgdfc:9.3.0:9.5.0] [db:gtc-saccharomyces cerevisiae] |
| CONTIG3388 | 13876567_f3_3 | 5088 | 19191 | 1929 | 643 | YNL039W | 507 | 1.1(10)-48 | Saccharomyces cerevisiae | [ui:ynl039w] [pn:tfiiib subunit, 90 kd:transcription factor tfiiib b] [gn:tfc5:tfc7:n2682] [gtcfc:10.1:10.2:10.3] [keggfc:14.2] [sgdfc:4.1.0:4.4.0:9.5.0] [db:gtc-saccharomyces cerevisiae] |
| CONTIG4101 | 22520752_c2_7 | 5089 | 19192 | 1431 | 477 | YNL025C | 593 | 3.6(10)-67 | Saccharomyces cerevisiae | [ui:ynl025c] [pn:dna-directed rna polymerase ii holoenzyme and kornberg"s mediator:srb subcomplex subunit, cyclin c homolog:rna polymerase ii holoenzyme cyclin-like subunit] [gn:ume3:ssn8:srb11:n2805] [gtcfc:10.1:10.2:12.12.13:12.8] [keg |
| CONTIG3012 | 6672175_c3_6 | 5090 | 19193 | 489 | 163 | YNL016W | 145 | 2.0(10)-9 | Saccharomyces cerevisiae | [ui:ynl016w] [pn:major polyadenylated rna-binding protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5129 | 6642127_f3_6 | 5091 | 19194 | 1557 | 519 | YNL016W | 479 | 2.2(10)-76 | Saccharomyces cerevisiae | of nucleus and cytoplasm:nuclear and cytoplasmic polyadenylated rna- binding protein pub1:ars consensus binding protein acbp-60:poly:u-binding protein:poly uridylate-binding pro [ui:ynl016w] [pn:major polyadenylated rna-binding protein of nucleus and cytoplasm:nuclear and cytoplasmic polyadenylated rna- binding protein pub1:ars consensus binding protein acbp-60:poly:u-binding protein:poly uridylate-binding pro |
| CONTIG3755 | 4532762_f2_4 | 5092 | 19195 | 1044 | 348 | YNL007C | 538 | 5.0(10)-87 | Saccharomyces cerevisiae | [ui:ynl007c] [pn:heat shock protein:sis1 protein] [gn:sis1:n2879] [gtcfc:12.7.12.8] [keggfc:14.2] [sgdfc:3.8.0:5.2.0:9.2.0:9.5.0] [db:gtc-saccharomyces cerevisiae] |
| CONTIG2372 | 961003_f3_1 | 5093 | 19196 | 1341 | 447 | YNR011C | 1108 | 2.2(10)-112 | Saccharomyces cerevisiae | [ui:ynr011c] [pn:rna-dependent atpase of deah box family:pre-mrna splicing factor rna helicase prp2] [gn:prp2:rna2:n2048] [gtcfc:10.1:10.2] [keggfc:14.2] [sgdfc:4.9.0:9.5.0] [db:gtc-saccharomyces cerevisiae] |
| CONTIG4666 | 4190937_cl_11 | 5094 | 19197 | 327 | 109 | YNR011C | 96 | 0.00088 | Saccharomyces cerevisiae | [ui:ynr011c] [pn:rna-dependent atpase of deah box family:pre-mrna splicing factor rna helicase prp2] [gn:prp2:rna2:n2048] [gtcfc:10.1:10.2] [keggfc:14.2] [sgdfc:4.9.0:9.5.0] [db:gtc-saccharomyces cerevisiae] |
| CONTIG3881 | 4860936_c3_7 | 5095 | 19198 | 1314 | 438 | YNR023W | 196 | 2.1(10)-23 | Saccharomyces cerevisiae | [ui:ynr023w] [pn:component of swi/snf global transcription activator complex:transcription regulatory protein swp73:swi/snf complex component swp73] [gn:snf12:swp73:n3224] [gtcfc:10.1:10.2] [keggfc:14.2] [sgdfc:10.1:10.2] [db:gtc-sa |
| CONTIG1850 | 35782_c3_10 | 5096 | 19199 | 1281 | 427 | YNR052C | 464 | 4.0(10)-44 | Saccharomyces cerevisiae | [ui:ynr052c] [pn:required for glucose derepression:pop2 protein] [gn:pop2:caf1:n3470] [gtcfc:10.1:10.2:12.13:12.15] [keggfc:14.2] [sgdfc:1.5.2:3.4.0:4.8.2:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5585 | 24647191_f3_14 | 5097 | 19200 | 1485 | 495 | YNR052C | 469 | 1.2(10)-44 | Saccharomyces cerevisiae | [ui:ynr052c] [pn:required for glucose derepression:pop2 protein] [gn:pop2:caf1:n3470] [gtcfc:10.1:10.2:12.13:12.15] [keggfc:14.2] [sgdfc:1.5.2:3.4.0:4.8.2:9.5.0] [db:gtc-saccharomyces cerevisiae] |
| CONTIG3896 | 4020011_f2_3 | 5098 | 19201 | 1599 | 533 | YOL148C | 187 | 9.0(10)-26 | Saccharomyces cerevisiae | [ui:yol148c] [pn:member of the tbp class of spt proteins that alter transcription site selection:transcription factor spt20] [gn:spt20:ada5] [gtcfc:10.1:10.2] [keggfc:14.2] [sgdfc:4.8.2:9.5.0] [db:gtc-saccharomyces cerevisiae] |
| CONTIG5521 | 2822177_f1_3 | 5099 | 19202 | 1461 | 487 | YOL123W | 570 | 2.3(10)-55 | Saccharomyces cerevisiae | [ui:yol123w] [pn:polyadenylated rna-binding protein] [gn:hrp1] [gtcfc:10.1:10.2] [keggfc:14.2] [sgdfc:9.2.0:9.5.0] [db:gtc-saccharomyces cerevisiae] |
| CONTIG4742 | 12676553_f3_6 | 5100 | 19203 | 408 | 136 | YOL116W | 130 | 6.0(10)-8 | Saccharomyces cerevisiae | [ui:yol116w] [pn:transcriptional activator:msn1 protein:multicopy suppressor of snf1 protein 1] [gn:msn1:ftip1:phd2:hrb382] [gtcfc:10.1:10.2:12.13] [keggfc:14.2] [sgdfc:1.5.2:4.8.2:9.5.0] [db:gtc-saccharomyces cerevisiae] |
| CONTIG5328 | 10947055_c3_16 | 5101 | 19204 | 1809 | 603 | YOL116W | 177 | 8.0(10)-11 | Saccharomyces cerevisiae | [ui:yol116w] [pn:transcriptional activator:msn1 protein:multicopy suppressor of snf1 protein 1] [gn:msn1:ftip1:phd2:hrb382] [gtcfc:10.1:10.2:12.13] [keggfc:14.2] [sgdfc:1.5.2:4.8.2:9.5.0] [db:gtc-saccharomyces cerevisiae] |
| CONTIG5732 | 36367807_c2_29 | 5102 | 19205 | 1818 | 606 | YOL115W | 1140 | 9.4(10)-116 | Saccharomyces cerevisiae | [ui:yol115w] [pn:topoisomerase i-related protein:topoisomerase 1-related protein trf4] [gn:trf4:o0716:hrc584] [gtcfc:10.1:10.2:10.8:12.8] [keggfc:14.2] [sgdfc:3.6.0:3.8.0:9.5.0] [db:gtc-saccharomyces cerevisiae] |
| CONTIG5417 | 22064657_f3_7 | 5103 | 19206 | 987 | 329 | YOL094C | 1137 | 1.8(10)-115 | Saccharomyces cerevisiae | [ui:yol094c] [pn:dna replication factor c, 37 kda subunit:activator 1 37 kd subunit:replication factor c 37 kd subunit] [gn:rfc4:o0923] [gtcfc:10.1:10.2:10.8] [keggfc:14.2] [sgdfc:3.6.0:9.5.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5651 | 9960027_f1_1 | 5104 | 19207 | 2604 | 868 | YOL090W | 1279 | 8.1(10)-168 | *Saccharomyces cerevisiae* | [db:gtc-*saccharomyces cerevisiae*] [ui:yol090w] [pn:dna mismatch repair protein:muts protein homolog 2] [gn:msh2:o0935] [gtcfc:10.1:10.2:10.8] [keggfc:14.2] [sgdfc:3.7.0:9.5.0] |
| CONTIG3552 | 3939000_f1_1 | 5105 | 19208 | 1698 | 566 | YOL089C | 129 | 7.4(10)-7 | *Saccharomyces cerevisiae* | [db:gtc-*saccharomyces cerevisiae*] [ui:yol089c] [pn:weak similarity to transcription factors] [gtcfc:10.1:10.2] [keggfc:14.2] [sgdfc:4.8.2:9.5.0] |
| CONTIG5592 | 14275302_c3_8 | 5106 | 19209 | 2271 | 757 | YOL089C | 139 | 3.8(10)-11 | *Saccharomyces cerevisiae* | [ui:yol089c] [pn:weak similarity to transcription factors] [gtcfc:10.1:10.2] [keggfc:14.2] [sgdfc:4.8.2:9.5.0] [db:gtc-*saccharomyces cerevisiae*] |
| b2x16250.x | 4482421B_f1_1 | 5107 | 19210 | 747 | 249 | YOL089C | 91 | 0.34 | *Saccharomyces cerevisiae* | [ui:yol089c] [pn:weak similarity to transcription factors] [gtcfc:10.1:10.2] [keggfc:14.2] [sgdfc:4.8.2:9.5.0] [db:gtc-*saccharomyces cerevisiae*] |
| CONTIG1152 | 565875_f2_3 | 5108 | 19211 | 204 | 68 | YOL069W | 90 | 0.00169 | *Saccharomyces cerevisiae* | [ui:yol069w] [pn:spindle pole body protein:myosin-like protein:nuclear filament-containing protein 2:nuclear divison protein nuf2] [gn:nuf2] [gtcfc:10.1:10.2:12.16:12.8] [keggfc:14.2] [sgdfc:3.8.0:9.3.0:9.5.0] [db:gtc-*saccharomyces c* |
| CONTIG1539 | 5911599_c1_3 | 5109 | 19212 | 954 | 318 | YOL069W | 198 | 1.7(10)-13 | *Saccharomyces cerevisiae* | [ui:yol069w] [pn:spindle pole body protein:myosin-like protein:nuclear filament-containing protein 2:nuclear divison protein nuf2] [gn:nuf2] [gtcfc:10.1:10.2:12.16:12.8] [keggfc:14.2] [sgdfc:3.8.0:9.3.0:9.5.0] [db:gtc-*saccharomyces cerevisiae*] |
| CONTIG4978 | 14242151_f1_2 | 5110 | 19213 | 855 | 285 | YOL067C | 246 | 5.0(10)-21 | *Saccharomyces cerevisiae* | [ui:yol067c] [pn:basic helix-loop-helix transcription factor that regulates cit2 gene expression:retrograde regulation protein 1] [gn:rtg1] [gtcfc:10.1:10.2:12.13] [keggfc:14.2] [sgdfc:1.5.2:4.8.2:9.5.0] [db:gtc-*saccharomyces cerevisi* |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1411 | 9806442_f2_2 | 5111 | 19214 | 816 | 272 | YOL051W | 166 | 3.8(10)-11 | *Saccharomyces cerevisiae* | [ui:yol051w] [pn:dna-directed rna polymerase ii holoenzyme and kornberg"s mediator:srb subcomplex subunit:transcription regulatory protein gal11] [gn:gal11:spt13:rar3] [gtcfc:10.1:10.2:12.13:12.15:15:12.9] [keggfc:14.2] [sgdfc:1.5.2:3.3. |
| CONTIG1537 | 25421931_c3_8 | 5112 | 19215 | 1317 | 439 | YOL051W | 108 | 7.5(10)-6 | *Saccharomyces cerevisiae* | [ui:yol051w] [pn:dna-directed rna polymerase ii holoenzyme and kornberg"s mediator:srb subcomplex subunit:transcription regulatory protein gal11] [gn:gal11:spt13:rar3] [gtcfc:10.1:10.2:12.13:12.15:15:12.9] [keggfc:14.2] [sgdfc:1.5.2:3.3. |
| CONTIG1631 | 24023431_f1_2 | 5113 | 19216 | 1371 | 457 | YOL006C | 798 | 1.6(10)-79 | *Saccharomyces cerevisiae* | [ui:yol006c] [pn:dna topoisomerase i] [gn:top1:mak1] [ec:5.99.1.2] [keggfc:14.1] [sgdfc:3.6.0:3.7.0:4.12.0:9.5.0] [db:gtc-*saccharomyces cerevisiae* |
| CONTIG1633 | 20484390_c3_3 | 5114 | 19217 | 306 | 102 | YOL004W | 336 | 4.7(10)-29 | *Saccharomyces cerevisiae* | [ui:yol004w] [pn:transcription regulatory protein:paired amphipathic helix protein] [gn:sin3:sdi1:ume4:rpd1:gam2] [gtcfc:10.1:10.2:12.15:12.8:12.9] [keggfc:13.1] [sgdfc:1.6.4:3.3.0:3.4.0:4.8.2:9.5.0] [db:gtc-*saccharomyces cerevisiae* |
| CONTIG1633 | 975750_f1_1 | 5115 | 19218 | 564 | 188 | YOL004W | 710 | 5.9(10)-69 | *Saccharomyces cerevisiae* | [ui:yol004w] [pn:transcription regulatory protein:paired amphipathic helix protein] [gn:sin3:sdi1:ume4:rpd1:gam2] [gtcfc:10.1:10.2:12.15:12.8:12.9] [keggfc:13.1] [sgdfc:1.6.4:3.3.0:3.4.0:4.8.2:9.5.0] [db:gtc-*saccharomyces cerevisiae* |
| CONTIG2942 | 14117288_f1_1 | 5116 | 19219 | 1086 | 362 | YOL004W | 581 | 3.6(10)-55 | *Saccharomyces cerevisiae* | [ui:yol004w] [pn:transcription regulatory protein:paired amphipathic helix protein] [gn:sin3:sdi1:ume4:rpd1:gam2] [gtcfc:10.1:10.2:12.5:12.8:12.9] [keggfc:13.1] [sgdfc:1.6.4:3.3.0:3.4.0:4.8.2:9.5.0] [db:gtc-*saccharomyces cerevisiae* |
| CONTIG2942 | 30080143_f2_3 | 5117 | 19220 | 738 | 246 | YOL004W | 225 | 3.2(10)-17 | *Saccharomyces cerevisiae* | [ui:yol004w] [pn:transcription regulatory protein:paired amphipathic helix protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4369 | 13679061_c1_7 | 5118 | 19221 | 945 | 315 | YOL004W | 288 | 3.2(10)-41 | *Saccharomyces cerevisiae* | [ui:yol004w] [pn:transcription regulatory protein:paired amphipathic helix protein] [gn:sin3:sdi1:ume4:rpd1:gam2] [gtcfc:10.1:10.2:12.15:12.8:12.9] [keggfc:13.1] [sgdfc:1.6.4:3.3.0:3.4.0:4.8.2:9.5.0] [db:gtc-*saccharomyces cerevisiae*] |
| CONTIG4369 | 25866430_c2_10 | 5119 | 19222 | 585 | 195 | YOL004W | 173 | 1.1(10)-11 | *Saccharomyces cerevisiae* | [ui:yol004w] [pn:transcription regulatory protein:paired amphipathic helix protein] [gn:sin3:sdi1:ume4:rpd1:gam2] [gtcfc:10.1:10.2:12.15:12.8:12.9] [keggfc:13.1] [sgdfc:1.6.4:3.3.0:3.4.0:4.8.2:9.5.0] [db:gtc-*saccharomyces cerevisiae*] |
| CONTIG2417 | 35188800_f3_2 | 5120 | 19223 | 771 | 257 | YOL001W | 288 | 1.8(10)-25 | *Saccharomyces cerevisiae* | [ui:yol001w] [pn:cyclin:phosphate system cyclin pho80] [gn:pho80:tup7:o2505:unb293] [gtcfc:10.1:10.2:12.8:13.10] [keggfc:13.2] [sgdfc:1.4.2:9.5.0] [db:gtc-*saccharomyces cerevisiae*] |
| CONTIG4252 | 23832562_c1_7 | 5121 | 19224 | 2676 | 892 | YOR038C | 631 | 1.3(10)-80 | *Saccharomyces cerevisiae* | [ui:yor038c] [pn:histone transcription regulator:histone transcription regulator 2] [gn:hir2:or26] [gtcfc:10.1:10.2] [keggfc:14.2] [sgdfc:4.8.2:9.5.0] [db:gtc-*saccharomyces cerevisiae*] |
| CONTIG5125 | 817965_c2_13 | 5122 | 19225 | 321 | 107 | YOR039W | 135 | 6.5(10)-9 | *Saccharomyces cerevisiae* | [ui:yor039w] [pn:casein kinase ii beta" chain:ck ii] [gn:ckb2:or26] [gtcfc:10.1:10.2:12.13] [ec:2.7.1.37] [keggfc:14.1] [sgdfc:4.7.0:9.5.0:15.0.0] [db:gtc-*saccharomyces cerevisiae*] |
| CONTIG5125 | 16839061_c2_12 | 5123 | 19226 | 450 | 150 | YOR039W | 357 | 8.8(10)-33 | *Saccharomyces cerevisiae* | [ui:yor039w] [pn:casein kinase ii beta" chain:ck ii] [gn:ckb2:or26] [gtcfc:10.1:10.2:12.13] [ec:2.7.1.37] [keggfc:14.1] [sgdfc:4.7.0:9.5.0:15.0.0] [db:gtc-*saccharomyces cerevisiae*] |
| CONTIG1954 | 898453_c3_9 | 5124 | 19227 | 762 | 254 | YOR048C | 188 | 1.6(10)-13 | *Saccharomyces cerevisiae* | [ui:yor048c] [pn:5"-3" exoribonuclease:ribonucleic acid trafficking protein 1] [gn:rat1:hke1:tap1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3145 | 17032156_c3_5 | 5125 | 19228 | 549 | 183 | YOR048C | 395 | 1.2(10)-35 | Saccharomyces cerevisiae | [gtcfc:10.1:10.2:10.3:14.1] [ec:3.1.11.-] [keggfc:14.1] [sgdfc:4.2.0:8.1.0:9.5.0] [db:gtc-saccharomyces cerevisiae] [ui:yor048c] [pn:5",3" exoribonuclease:ribonucleic acid trafficking protein 1] [gn:rat1:hke1:tap1] |
| CONTIG3505 | 191557_c1_4 | 5126 | 19229 | 513 | 171 | YOR058C | 130 | 2.1(10)-7 | Saccharomyces cerevisiae | [gtcfc:10.1:10.2:10.3:14.1] [ec:3.1.11.-] [keggfc:14.1] [sgdfc:4.2.0:8.1.0:9.5.0] [db:gtc-saccharomyces cerevisiae] [ui:yor058c] [pn:microtubule-associated protein:nonmotor:anaphase spindle elongation protein] [gn:ase1] [gtcfc:10.1:10.2:12.16:12.8] [keggfc:14.2] [sgdfc:3.8.0:9.3.0:9.5.0] [db:gtc-saccharomyces cerevisiae] |
| CONTIG4199 | 6024011_f3_2 | 5127 | 19230 | 1869 | 623 | YOR058C | 313 | 8.3(10)-25 | Saccharomyces cerevisiae | [ui:yor058c] [pn:microtubule-associated protein:nonmotor:anaphase spindle elongation protein] [gn:ase1] [gtcfc:10.1:10.2:12.16:12.8] [keggfc:14.2] [sgdfc:3.8.0:9.3.0:9.5.0] [db:gtc-saccharomyces cerevisiae] |
| CONTIG5406 | 6646925_c2_11 | 5128 | 19231 | 1002 | 334 | YOR061W | 1148 | 1.3(10)-16 | Saccharomyces cerevisiae | [ui:yor061w] [pn:casein kinase ii alpha" chain:casein ck ii] [gn:cka2] [gtcfc:10.1:10.2:12.13:12.8] [ec:2.7.1.37] [keggfc:14.1] [sgdfc:3.8.0:4.7.0:9.5.0:15.0.0] [db:gtc-saccharomyces cerevisiae] |
| CONTIG4701 | 23925327_c1_5 | 5129 | 19232 | 1974 | 658 | YOR113W | 477 | 1.5(10)-54 | Saccharomyces cerevisiae | [ui:yor113w] [pn:asparagine-rich zinc finger protein:asparagine-rich zinc finger protein azf1] [gn:azf1:o3244:yor3244w] [gtcfc:10.1:10.2] [keggfc:14.2] [sgdfc:4.12.0:9.5.0] [db:gtc-saccharomyces cerevisiae] |
| CONTIG3490 | 4140650_f3_3 | 5130 | 19233 | 2097 | 699 | YOR140W | 239 | 3.0(10)-22 | Saccharomyces cerevisiae | [ui:yor140w] [pn:transcription factor:flocculation suppression protein:sfl1 protein] [gn:sfl1:yor3339w] [gtcfc:10.1:10.2] [keggfc:14.2] [sgdfc:4.8.2:9.5.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4557 | 9925880_c1_5 | 5131 | 19234 | 1086 | 362 | YOR140W | 195 | 1.2(10)-19 | Saccharomyces cerevisiae | [ui:yor140w] [pn:transcription factor:flocculation suppression protein:sfl1 protein] [gn:sfl1:yor339w] [gtcfc:10.1:10.2] [keggfc:14.2] [sgdfc:4.8.2:9.5.0] [db:gtc-saccharomyces cerevisiae] |
| CONTIG1476 | 1067693_f1_1 | 5132 | 19235 | 522 | 174 | YOR194C | 128 | 5.5(10)-8 | Saccharomyces cerevisiae | [ui:yor194c] [pn:tfiia subunit:transcription initiation factor, 32 kd:transcription initiation factor iia large chain:tfiia 32 kd subunit] [gn:toa1] [gtcfc:10.1:10.2] [keggfc:14.2] [sgdfc:4.8.1:9.5.0] [db:gtc-saccharomyces cerevisiae] |
| CONTIG5758 | 14647127_c1_16 | 5133 | 19236 | 894 | 298 | YOR194C | 128 | 2.7(10)-18 | Saccharomyces cerevisiae | [ui:yor194c] [pn:tfiia subunit:transcription initiation factor, 32 kd:transcription initiation factor iia large chain:tfiia 32 kd subunit] [gn:toa1] [gtcfc:10.1:10.2] [keggfc:14.2] [sgdfc:4.8.1:9.5.0] [db:gtc-saccharomyces cerevisiae] |
| CONTIG5473 | 3947177_c1_7 | 5134 | 19237 | 222 | 74 | YOR210W | 313 | 4.0(10)-28 | Saccharomyces cerevisiae | [ui:yor210w] [pn:dna-directed polymerase i, ii, iii 8.3 subunit:dna-directed rna polymerases i, ii, and iii 8.3 kd polypeptide:abc10-beta:abc8] [gn:rpb10] [gtcfc:10.1:10.2:10.3] [keggfc:14.2] [sgdfc:4.1.0:4.4.0:4.8.1:9.5.0] [db:gtc-sa |
| CONTIG4882 | 4867926_c2_9 | 5135 | 19238 | 1956 | 652 | YOR217W | 941 | 2.1(10)-128 | Saccharomyces cerevisiae | [ui:yor217w] [pn:dna replication factor c, 95 kd subunit:activator 1 95 kd subunit:replication factor c 95 kd subunit:cell division control protein 44] [gn:rfc1:cdc44:yor50-7] [gtcfc:10.1:10.2:10.8:12.8] [keggfc:14.2] [sgdfc:3.6.0:3.8 |
| CONTIG2108 | 26441302_f2_2 | 5136 | 19239 | 183 | 61 | YOR257W | 96 | 4.0(10)-5 | Saccharomyces cerevisiae | [ui:yor257w] [pn:spindle pole body component, centrin:cell division control protein 31] [gn:cdc31:dsk1] [gtcfc:10.1:10.2:12.8] [keggfc:14.2] [sgdfc:3.8.0:9.5.0] [db:gtc-saccharomyces cerevisiae] |
| CONTIG1967 | 32440881_c3_2 | 5137 | 19240 | 1044 | 348 | YOR290C | 118 | 0.0011 | Saccharomyces cerevisiae | [ui:yor290c] [pn:component of swi/snf global transcription activator complex:transcription regulatory protein snf2:swi/snf complex component snf2:regulatory protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4757 | 23672202_c3_7 | 5138 | 19241 | 861 | 287 | YOR290C | 313 | 1.6(10)-26 | *Saccharomyces cerevisiae* | swi2:regulatory protein gam1:transcription factor tye3 [gn:snf2:swi2:] [ui:yor290c] [pn:component of swi/snf global transcription activator complex:transcription regulatory protein snf2:swi/snf complex component snf2:regulatory protein swi2:regulatory protein gam1:transcription factor tye3] [gn:snf2:swi2:] |
| CONTIG5776 | 548153_f3_17 | 5139 | 19242 | 2940 | 980 | YOR290C | 1235 | 3.8(10)-129 | *Saccharomyces cerevisiae* | [ui:yor290c] [pn:component of swi/snf global transcription activator complex:transcription regulatory protein snf2:swi/snf complex component snf2:regulatory protein swi2:regulatory protein gam1:transcription factor tye3] [gn:snf2:swi2:] |
| CONTIG151 | 17037564_c1_1 | 5140 | 19243 | 588 | 196 | YOR290C | 745 | 1.3(10)-72 | *Saccharomyces cerevisiae* | [ui:yor290c] [pn:component of swi/snf global transcription activator complex:transcription regulatory protein snf2:swi/snf complex component snf2:regulatory protein swi2:regulatory protein gam1:transcription factor tye3] [gn:snf2:swi2:] |
| CONTIG1781 | 35283264_c1_3 | 5141 | 19244 | 678 | 226 | YOR290C | 659 | 2.1(10)-63 | *Saccharomyces cerevisiae* | [ui:yor290c] [pn:component of swi/snf global transcription activator complex:transcription regulatory protein snf2:swi/snf complex component snf2:regulatory protein swi2:regulatory protein gam1:transcription factor tye3] [gn:snf2:swi2:] |
| CONTIG3991 | 14095056_c2_9 | 5142 | 19245 | 807 | 269 | YOR319W | 393 | 1.3(10)-36 | *Saccharomyces cerevisiae* | [ui:yor319w] [pn:similarity to human sap49 and rna-binding proteins] [gn:hsh49] [gtcfc:10.1:10.2:10.9] [keggfc:14.2] [sgdfc:4.10.0.9.5.0] [db:gtc-*saccharomyces cerevisiae* |
| CONTIG1988 | 5250758_c2_2 | 5143 | 19246 | 1767 | 589 | YOR337W | 187 | 3.2(10)-11 | *Saccharomyces cerevisiae* | [ui:yor337w] [pn:ty1 enhancer activator] [gn:tea1:o6257] [gtcfc:10.1:10.2] [keggfc:14.2] [sgdfc:4.8.2:9.5.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3818 | 23866327_c3_3 | 5144 | 19247 | 1383 | 461 | YOR337W | 460 | 4.9(10)-51 | *Saccharomyces cerevisiae* | *saccharomyces cerevisiae* [ui:yor337w] [pn:ty1 enhancer activator] [gn:teal:o6257] [gtcfc:10.1:10.2] [keggfc:14.2] [sgdfc:4.8.2:9.5.0] [db:gtc-saccharomyces cerevisiae] |
| CONTIG4425 | 4797183_c1_9 | 5145 | 19248 | 822 | 274 | YOR344C | 209 | 4.2(10)-17 | *Saccharomyces cerevisiae* | [ui:yor344c] [pn:basic helix-loop-helix transcription factor:serine-rich protein tye7:basic-helix-loop-helix protein sgc1] [gn:tye7:sgc1:o6233] [gtcfc:10.1:10.2:12.13] [keggfc:14.2] [sgdfc:1.5.2:4.8.2:9.5.0] [db:gtc-saccharomyces cere |
| CONTIG5154 | 33787535_c2_14 | 5146 | 19249 | 1164 | 388 | YOR358W | 403 | 1.2(10)-37 | *Saccharomyces cerevisiae* | [ui:yor358w] [pn:ccaat-binding factor subunit] [gn:hap5] [gtcfc:10.1:10.2] [keggfc:14.2] [sgdfc:4.8.2:9.5.0] [db:gtc-saccharomyces cerevisiae] |
| CONTIG5815 | 12588150_f1_3 | 5147 | 19250 | 633 | 211 | YPL248C | 240 | 3.7(10)-19 | *Saccharomyces cerevisiae* | [ui:ypl248c] [pn:transcription factor:regulatory protein] [gn:gal4] [gtcfc:10.1:10.2:12.13] [keggfc:14.2] [sgdfc:1.5.2:4.8.2:9.5.0] [db:gtc-saccharomyces cerevisiae] |
| CONTIG2382 | 31275181_f1_1 | 5148 | 19251 | 1464 | 488 | YPL190C | 244 | 1.1(10)-17 | *Saccharomyces cerevisiae* | [ui:ypl190c] [pn:polyadenylated rna-binding protein:nuclear polyadenylated rna-binding protein] [gn:nab3] [gtcfc:10.1:10.2:10.9] [keggfc:14.2] [sgdfc:4.10.0:9.5.0] [db:gtc-saccharomyces cerevisiae] |
| CONTIG5737 | 15709528_f3_10 | 5149 | 19252 | 1086 | 362 | YPL177C | 191 | 4.7(10)-15 | *Saccharomyces cerevisiae* | [ui:ypl177c] [pn:copper homeostasis protein:homeobox protein] [gn:cup9] [gtcfc:10.1:10.2:12.6:12.8] [keggfc:13.1] [sgdfc:1.8.1:4.8.2:9.5.0] [db:gtc-saccharomyces cerevisiae] |
| CONTIG1448 | 1432316_f1_1 | 5150 | 19253 | 1518 | 506 | YPL128C | 265 | 8.4(10)-47 | *Saccharomyces cerevisiae* | [ui:ypl128c] [pn:telomere ttagg repeat-binding factor 1:tbf1 protein:ttaggg repeat-binding factor 1:tbf alpha] [gn:tbf1:lpi16c] [gtcfc:10.1:10.2] [keggfc:14.2] [sgdfc:9.5.0:9.6.0] [db:gtc-saccharomyces cerevisiae] |
| bix18204.x | 23484431_c1_3 | 5151 | 19254 | 786 | 262 | YPL089C | 240 | 9.5(10)-23 | *Saccharomyces cerevisiae* | [ui:ypl089c] [pn:transcription factor of the mads box family] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3080 | 34072192_f3_1 | 5152 | 19255 | 693 | 231 | YPL082C | 313 | 1.8(10)-26 | Saccharomyces cerevisiae | [gn:rlm1] [gtcfc:10.1:10.2:12.13:12.8] [keggfc:14.2] [sgdfc:4.8.2:9.5.0:10.2.7] [db-gtc-saccharomyces cerevisiae] [ui:ypl082c] [pn:transcriptional accessory protein:probable helicase mot1] [gn:mot1:lpf4c] [gtcfc:10.1:10.2] [keggfc:14.2] [sgdfc:4.8.2:9.5.0] [db-gtc-saccharomyces cerevisiae] |
| CONTIG3375 | 12689587_c2_5 | 5153 | 19256 | 1887 | 629 | YPL082C | 1301 | 2.5(10)-132 | Saccharomyces cerevisiae | [ui:ypl082c] [pn:transcriptional accessory protein:probable helicase mot1] [gn:mot1:lpf4c] [gtcfc:10.1:10.2] [keggfc:14.2] [sgdfc:4.8.2:9.5.0] [db-gtc-saccharomyces cerevisiae] |
| CONTIG3509 | 31927007_f1_1 | 5154 | 19257 | 1662 | 554 | YPL082C | 1636 | 1.8(10)-179 | Saccharomyces cerevisiae | [ui:ypl082c] [pn:transcriptional accessory protein:probable helicase mot1] [gn:mot1:lpf4c] [gtcfc:10.1:10.2] [keggfc:14.2] [sgdfc:4.8.2:9.5.0] [db-gtc-saccharomyces cerevisiae] |
| CONTIG800 | 19586568_f2_1 | 5155 | 19258 | 813 | 271 | YPL082C | 159 | 5.0(10)-9 | Saccharomyces cerevisiae | [ui:ypl082c] [pn:transcriptional accessory protein:probable helicase mot1] [gn:mot1:lpf4c] [gtcfc:10.1:10.2] [keggfc:14.2] [sgdfc:4.8.2:9.5.0] [db-gtc-saccharomyces cerevisiae] |
| b2x17437.y | 22928188_c2_4 | 5156 | 19259 | 633 | 211 | YPL082C | 570 | 7.7(10)-54 | Saccharomyces cerevisiae | [ui:ypl082c] [pn:transcriptional accessory protein:probable helicase mot1] [gn:mot1:lpf4c] [gtcfc:10.1:10.2] [keggfc:14.2] [sgdfc:4.8.2:9.5.0] [db-gtc-saccharomyces cerevisiae] |
| CONTIG4110 | 4017182_f3_3 | 5157 | 19260 | 2280 | 760 | YPL043W | 1153 | 2.2(10)-150 | Saccharomyces cerevisiae | [ui:ypl043w] [pn:nucleolar protein:nucleolar protein nop4:nucleolar protein nop77] [gn:nop4:nop77] [gtcfc:10.1:10.2:10.3] [keggfc:14.2] [sgdfc:4.2.0:9.5.0] [db-gtc-saccharomyces cerevisiae] |
| CONTIG5317 | 9772711_c2_14 | 5158 | 19261 | 312 | 104 | YPL022W | 143 | 1.1(10)-8 | Saccharomyces cerevisiae | [ui:ypl022w] [pn:component of the nucleotide excision repairosome:dna repair protein] [gn:rad1] [gtcfc:10.1:10.10:10.2] [keggfc:14.2] [sgdfc:9.5.0:11.2.1] [db-gtc-saccharomyces cerevisiae] |
| CONTIG5317 | 33789687_c2_13 | 5159 | 19262 | 2595 | 865 | YPL022W | 1059 | 3.6(10)-107 | Saccharomyces cerevisiae | [ui:ypl022w] [pn:component of the |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3345 | 25478402_c1_7 | 5160 | 19263 | 1557 | 519 | YPL016W | 164 | 4.2(10)-13 | Saccharomyces cerevisiae | nucleotide excision repair:some:dna repair protein] [gn:rad1] [gtcfc:10.1:10.10:10.2] [keggfc:14.2] [sgdfc:9.5.0:11.2.1] [db:gtc-saccharomyces cerevisiae] [ui:ypl016w] [pn:component of swi/snf global transcription activator complex:transcription regulatory protein adr6:swi/snf complex component adr6:regulatory protein swi1:regulatory protein gam3] [gn:adr6:swi1:gam3] [gtcfc:10.1:10.2:12. |
| CONTIG4649 | 4003906_c1_6 | 5161 | 19264 | 1470 | 490 | YPL016W | 186 | 7.0(10)-11 | Saccharomyces cerevisiae | [ui:ypl016w] [pn:component of swi/snf global transcription activator complex:transcription regulatory protein adr6:swi/snf complex component adr6:regulatory protein swi1:regulatory protein gam3] [gn:adr6:swi1:gam3] [gtcfc:10.1:10.2:12. |
| CONTIG4345 | 4710926_c2_9 | 5162 | 19265 | 813 | 271 | YPL008W | 277 | 4.0(10)-41 | Saccharomyces cerevisiae | [ui:ypl008w] [pn:protein of the deah box family:chl1 protein] [gn:chl1:ctf1:yp8132] [gtcfc:10.1:10.2:12.8] [keggfc:14.2] [sgdfc:3.8.0:9.5.0] [db:gtc-saccharomyces cerevisiae] |
| CONTIG4413 | 1054567_f2_1 | 5163 | 19266 | 1227 | 409 | YPL008W | 722 | 1.8(10)-71 | Saccharomyces cerevisiae | [ui:ypl008w] [pn:protein of the deah box family:chl1 protein] [gn:chl1:ctf1:yp8132] [gtcfc:10.1:10.2:12.8] [keggfc:14.2] [sgdfc:3.8.0:9.5.0] [db:gtc-saccharomyces cerevisiae] |
| CONTIG4413 | 26585900_f3_3 | 5164 | 19267 | 231 | 77 | YPL008W | 181 | 7.2(10)-13 | Saccharomyces cerevisiae | [ui:ypl008w] [pn:protein of the deah box family:chl1 protein] [gn:chl1:ctf1:yp8132] [gtcfc:10.1:10.2:12.8] [keggfc:14.2] [sgdfc:3.8.0:9.5.0] [db:gtc-saccharomyces cerevisiae] |
| CONTIG4413 | 23882316_f2_2 | 5165 | 19268 | 216 | 72 | YPL008W | 140 | 1.8(10)-8 | Saccharomyces cerevisiae | [ui:ypl008w] [pn:protein of the deah box family:chl1 protein] [gn:chl1:ctf1:yp8132] [gtcfc:10.1:10.2:12.8] [keggfc:14.2] [sgdfc:3.8.0:9.5.0] [db:gtc-saccharomyces cerevisiae] |
| CONTIG5575 | 2949516_c1_11 | 5166 | 19269 | 1212 | 404 | YPL001W | 634 | 3.8(10)-62 | Saccharomyces cerevisiae | [ui:ypl001w] [pn:histone acetyltransferase subunit] [gn:hat1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4598 | 4726387_f3_4 | 5167 | 19270 | 1125 | 375 | YPR025C | 466 | 2.5(10)-44 | Saccharomyces cerevisiae | [gtcfc:10.1:10.2:10.7] [keggfc:14.2] [sgdfc:6.3.0:9.2.0:9.5.0] [db:gtc-saccharomyces cerevisiae] [ui:ypr025c] [pn:tfiih subunit:transcription initiation factor, cyclin c component:cyclin ee1l] [gn:ee1l:ypr024c:yp9367] [gtcfc:10.1:10.10.2:12.8] [keggfc:14.2] [sgdfc:3.8.0:4.8.1:9.5.0:11.2.1] [db:gtc-saccharomyces cerevisiae] |
| CONTIG1927 | 24406550_c3_8 | 5168 | 19271 | 276 | 92 | YPR052C | 245 | 6.5(10)-21 | Saccharomyces cerevisiae | [ui:ypr052c] [pn:nonhistone chromosomal protein related to mammalian hmg1:nonhistone chromosomal protein 6a] [gn:nhp6a:nhpa:yp9499] [gtcfc:10.1:10.2:12.8] [keggfc:14.2] [sgdfc:3.1.0:3.2.0:9.5.0:9.6.0] [db:gtc-saccharomyces cerevisiae] |
| CONTIG5403 | 31875_c2_7 | 5169 | 19272 | 765 | 255 | YPR057W | 109 | 0.001 | Saccharomyces cerevisiae | [ui:ypr057w] [pn:involved in snmp biogenesis] [gn:br1] [gtcfc:10.1:10.2] [keggfc:14.2] [sgdfc:4.9.0:9.5.0] [db:gtc-saccharomyces cerevisiae] |
| CONTIG5251 | 167182_c3_19 | 5170 | 19273 | 1857 | 619 | YPR065W | 258 | 2.7(10)-22 | Saccharomyces cerevisiae | [ui:ypr065w] [pn:heme-dependent transcriptional repressor of hypoxic genes:rox1 repressor:hypoxic function repressor:heme-dependent repression factor] [gn:rox1:yp9499] [gtcfc:10.1:10.2:12.13:12.8] [keggfc:13.1] [sgdfc:1.7.3:4.8.2:9.5] |
| CONTIG5217 | 9960077_f3_8 | 5171 | 19274 | 426 | 142 | YPR086W | 339 | 7.0(10)-31 | Saccharomyces cerevisiae | [ui:ypr086w] [pn:tfiib subunit:transcription initiation factor, factor e:transcription initiation factor iib:tfiib:transcription factor e] [gn:sua7:p9513] [gtcfc:10.1:10.2] [keggfc:14.2] [fgdfc:4.8.1:9.5.0] [db:gtc-saccharomyces cerevisiae] |
| CONTIG5414 | 34187502_c3_9 | 5172 | 19275 | 564 | 188 | YPR086W | 316 | 1.8(10)-28 | Saccharomyces cerevisiae | [ui:ypr086w] [pn:tfiib subunit:transcription initiation factor, factor e:transcription initiation factor iib:tfiib:transcription factor e] [gn:sua7:p9513] [gtcfc:10.1:10.2] [keggfc:14.2] [sgdfc:4.8.1:9.5.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5728 | 13705008_c2_18 | 5173 | 19276 | 1056 | 352 | YPR086W | 919 | 2.5(10)-92 | Saccharomyces cerevisiae | [db:gfc-saccharomyces cerev][ui:ypt086w][pn:tfiib subunit:transcription initiation factor, factor e:transcription initiation factor iib:tfiib:transcription factor e][gn:sua7:p9513][gtcfc:10.1:10.2][keggfc:14.2][sgdfc:4.8.1:9.5.0][db:gtc-saccharomyces cerev |
| CONTIG4832 | 34410427_f3_3 | 5174 | 19277 | 3018 | 1006 | YPR104C | 363 | 1.2(10)-50 | Saccharomyces cerevisiae | [ui:ypr104c][pn:transcriptional activator of the forkhead/hnf3 family:pre-rrna processing protein fh11][gn:fh11:p8283][gtcfc:10.1:10.2][keggfc:14.2][sgdfc:4.8.2:9.5.0][db:gtc-saccharomyces cerevisiae] |
| CONTIG952 | 11893830_f1_1 | 5175 | 19278 | 825 | 275 | YPR104C | 365 | 1.7(10)-32 | Saccharomyces cerevisiae | [ui:ypr104c][pn:transcriptional activator of the forkhead/hnf3 family:pre-rrna processing protein fh11][gn:fh11:p8283][gtcfc:10.1:10.2][keggfc:14.2][sgdfc:4.8.2:9.5.0][db:gtc-saccharomyces cerevisiae] |
| CONTIG5127 | 4382687_c3_9 | 5176 | 19279 | 2430 | 810 | YPR135W | 499 | 8.3(10)-75 | Saccharomyces cerevisiae | [ui:ypr135w][pn:dna-directed dna polymerase alpha-binding protein:dna polymerase alpha-binding protein:pob1/ctf4 protein:chromosome replication protein chl15][gn:pob1:ctf4:chl15:p9659][gtcfc:10.1:10.2:10.8][keggfc:14.2][sgdfc:3.6 |
| CONTIG5789 | 5917193_f2_7 | 5177 | 19280 | 1002 | 334 | YPR141C | 882 | 2.0(10)-88 | Saccharomyces cerevisiae | [ui:ypr141c][pn:kinesin-related protein:kinesin-like protein:kar3:nuclear fusion protein][gn:kar3:p9659][gtcfc:10.1:10.2:12.16:12.8:12.9][keggfc:14.2][sgdfc:3.3.0:3.8.0:9.3.0:9.5.0][db:gtc-saccharomyces cerevisiae] |
| CONTIG3097 | 36047827_f3_1 | 5178 | 19281 | 513 | 171 | YPR168W | 306 | 2.2(10)-27 | Saccharomyces cerevisiae | [ui:ypr168w][pn:negative regulator of ho endonuclease][gn:nut2][gtcfc:10.1:10.2:12.9][keggfc:14.2][sgdfc:3.3.0:4.8.2:9.5.0][db:gtc-saccharomyces cerevisiae] |
| CONTIG393 | 25425906_c2_4 | 5179 | 19282 | 687 | 229 | YPR162C | 96 | 0.039 | Saccharomyces cerevisiae | [ui:ypr162c][pn:origin recognition complex, 56 kd subunit:origin recognition complex protein, |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3767 | 26353552_c3_4 | 5180 | 19283 | 963 | 321 | YPR178W | 289 | 4.7(10)-45 | Saccharomyces cerevisiae | subunit 3:origin recognition complex protein 56 kd subunit [gn:orc4:p9325] [gtcfc:10.1:10.2:10.8:12.9] [keggfc:13.2] [sgdfc:3.3.0:3.6 [ui:ypr178w] [pn:u4/u6 snmp 52 kd protein:u4/u6 small nuclear ribonucleoprotein prp4] [gn:prp4:rna4:p9705] [gtcfc:10.1:10.2:12.16] [keggfc:14.2] [sgdfc:4.9.0:6.4.0:9.5.0] [db:gtc-saccharomyces cerevisiae] |
| CONTIG3767 | 22054712_c2_3 | 5181 | 19284 | 465 | 155 | YPR178W | 98 | 6.0(10)-8 | Saccharomyces cerevisiae | [ui:ypr178w] [pn:u4/u6 snmp 52 kd protein:u4/u6 small nuclear ribonucleoprotein prp4] [gn:prp4:rna4:p9705] [gtcfc:10.1:10.2:12.16] [keggfc:14.2] [sgdfc:4.9.0:6.4.0:9.5.0] [db:gtc-saccharomyces cerevisiae] |
| CONTIG408 | 12671961_c1_4 | 5182 | 19285 | 378 | 126 | YPR182W | 215 | 9.8(10)-18 | Saccharomyces cerevisiae | [ui:ypr182w] [pn:snrna-associated protein of the sm family:small nuclear ribonucleoprotein like protein smx3] [gn:smx3:p9705] [gtcfc:10.1:10.2] [keggfc:14.2] [sgdfc:4.9.0:9.5.0] [db:gtc-saccharomyces cerevisiae] |
| CONTIG2830 | 6672151_f1_1 | 5183 | 19286 | 396 | 132 | YPR182W | 136 | 2.2(10)-9 | Saccharomyces cerevisiae | [ui:ypr182w] [pn:snrna-associated protein of the sm family:small nuclear ribonucleoprotein like protein smx3] [gn:smx3:p9705] [gtcfc:10.1:10.2] [keggfc:14.2] [sgdfc:4.9.0:9.5.0] [db:gtc-saccharomyces cerevisiae] |
| CONTIG2486 | 289003_c1_7 | 5184 | 19287 | 627 | 209 | YPR186C | 137 | 4.2(10)-14 | Saccharomyces cerevisiae | [ui:ypr186c] [pn:transcription initiation factor:transcription factor iiia:tfiiia] [gn:tfc2:pzf1:tfiiia:p9677] [gtcfc:10.1:10.2:10.3] [keggfc:14.2] [sgdfc:4.1.0:4.4.0:9.5.0] [db:gtc-saccharomyces cerevisiae] |
| CONTIG4935 | 21663962_c2_6 | 5185 | 19288 | 426 | 142 | YPR186C | 96 | 0.0014 | Saccharomyces cerevisiae | [ui:ypr186c] [pn:transcription initiation factor:transcription factor iiia:tfiiia] [gn:tfc2:pzf1:tfiiia:p9677] [gtcfc:10.1:10.2:10.3] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x10d47.x | 2557307_f2_1 | 5186 | 19289 | 462 | 154 | YPR186C | 357 | 8.8(10)-33 | Saccharomyces cerevisiae | [sgdfc:4.1.0:4.4.0:9.5.0] [db:gtc-saccharomyces cerevisiae] [ui:ypr186c] [pn:transcription initiation factor:transcription factor iiia:tfiiia] [gn:tfc2:pzf1:tfiiia:p9677] [gtcfc:10.1:10.2:10.3] [keggfc:14.2] [sgdfc:4.1.0:4.4.0:9.5.0] [db:gtc-saccharomyces cerevisiae] |
| CONTIG2145 | 25395386_f1_1 | 5187 | 19290 | 1092 | 364 | YPR189W | 94 | 0.28 | Saccharomyces cerevisiae | [ui:ypr189w] [pn:antiviral protein:superkiller 3 protein] [gn:ski3] [gtcfc:10.1:10.2:12.14] [keggfc:14.2] [sgdfc:9.5.0:11.7.0] [db:gtc-saccharomyces cerevisiae] |
| CONTIG5354 | 14645010_c2_9 | 5188 | 19291 | 2262 | 754 | YPR189W | 688 | 5.0(10)-101 | Saccharomyces cerevisiae | [ui:ypr189w] [pn:antiviral protein:superkiller 3 protein] [gn:ski3] [gtcfc:10.1:10.2:12.14] [keggfc:14.2] [sgdfc:9.5.0:11.7.0] [db:gtc-saccharomyces cerevisiae] |
| CONTIG4566 | 10642129_c1_3 | 5189 | 19292 | 1830 | 610 | YPR189W | 851 | 3.2(10)-84 | Saccharomyces cerevisiae | [ui:ypr189w] [pn:antiviral protein:superkiller 3 protein] [gn:ski3] [gtcfc:10.1:10.2:12.14] [keggfc:14.2] [sgdfc:9.5.0:11.7.0] [db:gtc-saccharomyces cerevisiae] |
| CONTIG1907 | 4484389_c1_2 | 5190 | 19293 | 1557 | 519 | YPR196W | 152 | 6.5(10)-8 | Saccharomyces cerevisiae | [ui:ypr196w] [pn:strong similarity to regulatory protein mal63p:maltose fermentation regulatory protein mal6r] [gn:mal6r:mal63] [gtcfc:10.1:10.2] [keggfc:14.2] [sgdfc:4.8.2:9.5.0] [db:gtc-saccharomyces cerevisiae] |
| CONTIG4799 | 35183443_c1_6 | 5191 | 19294 | 2370 | 790 | YBL088C | 131 | 2.1(10)-10 | Saccharomyces cerevisiae | [ui:ybl088c] [pn:telomere length control protein:telomer length regulation protein tel1] [gn:tel1:ybl0706] [gtcfc:10.1] [keggfc:14.2] [sgdfc:9.6.0] [db:gtc-saccharomyces cerevisiae] |
| CONTIG4943 | 12594443_f3_1 | 5192 | 19295 | 2400 | 800 | YBL088C | 889 | 18(10)-87 | Saccharomyces cerevisiae | [ui:ybl088c] [pn:telomere length control protein:telomer length regulation protein tel1] [gn:tel1:ybl0706] [gtcfc:10.1] [keggfc:14.2] [sgdfc:9.6.0] [db:gtc-saccharomyces cerevisiae] |
| CONTIG5480 | 19550937_f3_4 | 5193 | 19296 | 555 | 185 | YBL088C | 112 | 0.00209 | Saccharomyces cerevisiae | [ui:ybl088c] [pn:telomere length control protein:telomer length regulation protein tel1] [gn:tel1:ybl0706] [gtcfc:10.1] [keggfc:14.2] [sgdfc:9.6.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5480 | 10160093_f1_2 | 5194 | 19297 | 2844 | 948 | YBL088C | 108 | 0.00077 | Saccharomyces cerevisiae | saccharomyces cerevisiae [ui:ybl088c] [pn:telomere length control protein:telomer length regulation protein tel1 [gn:tel1:ybl0706] [gtcfc:10.1] [keggfc:14.2] [sgdfc:9.6.0] [dbgtc-saccharomyces cerevisiae] |
| CONTIG5236 | 26564680_c1_8 | 5195 | 19298 | 1344 | 448 | YBR195C | 603 | 7.5(10)-59 | Saccharomyces cerevisiae | [ui:ybr195c] [pn:chromatin assembly complex, subunit p50:msi1 protein:ira1 multicopy suppressor] [gn:msi1:ybr1405] [gtcfc:10.1:10.2:10.8:12.13:12.16] [keggfc:14.2] [sgdfc:3.6.0:4.8.3:6.4.0:9.6.0:10.4.5] [db:gtc-saccharomyces cerevisiae] |
| CONTIG5540 | 1368887_f3_11 | 5196 | 19299 | 525 | 175 | YDL208W | 481 | 6.4(10)-46 | Saccharomyces cerevisiae | [ui:ydl208w] [pn:strong similarity to high mobility group:hmg family:high mobility group-like nuclear protein 2] [gn:nhp2:d1045] [gtcfc:10.1:10.4] [keggfc:14.2] [sgdfc:5.1.0:9.6.0] [dbgtc-saccharomyces cerevisiae] |
| CONTIG2920 | 32658177_f1_1 | 5197 | 19300 | 882 | 294 | YDL002C | 263 | 4.2(10)-30 | Saccharomyces cerevisiae | [ui:ydl002c] [pn:non-histone protein] [gn:hmo2] [gtcfc:10.1] [keggfc:14.2] [sgdfc:9.6.0] [dbgtc-saccharomyces cerevisiae] |
| CONTIG4371 | 10285206_c1_6 | 5198 | 19301 | 1203 | 401 | YDR174W | 141 | 8.5(10)-15 | Saccharomyces cerevisiae | [ui:ydr174w] [pn:non-histone protein] [gn:hmo1] [gtcfc:10.1] [keggfc:14.2] [sgdfc:9.6.0] [dbgtc-saccharomyces cerevisiae] |
| CONTIG5258 | 24242255_c3_12 | 5199 | 19302 | 402 | 134 | YEL026W | 505 | 1.8(10)-48 | Saccharomyces cerevisiae | [ui:yel026w] [pn:strong similarity to high mobility group-like protein nhp2:putative 60s ribosomal protein yel026w] [gtcfc:10.1:10.4] [keggfc:14.2] [sgdfc:5.1.0:9.6.0] [db:gtc-saccharomyces cerevisiae] |
| CONTIG1876 | 19531250_c1_3 | 5200 | 19303 | 618 | 206 | YER159C | 249 | 2.3(10)-21 | Saccharomyces cerevisiae | [ui:yer159c] [pn:functional homolog of human nc2alpha:hypothetical 15.5 kd protein in bem2-spt2 intergenic region] [gn:bur6] [gtcfc:10.1:10.2] [keggfc:14.2] [sgdfc:4.8.2:9.6.0] [db:gtc-saccharomyces cerevisiae] |
| CONTIG5754 | 9804627_f3_15 | 5201 | 19304 | 1734 | 578 | YFR037C | 614 | 3.2(10)-75 | Saccharomyces cerevisiae | [ui:yfr037c] [pn:subunit of the rsc complex:hypothetical 63.2 kd protein in cdc26-sap155 intergenic region] [gn:rsc8] [gtcfc:10.1:10.2:12.8] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4529 | 2775952_f1_3 | 5202 | 19305 | 1365 | 455 | YGL194C | 1506 | 1.5(10)-154 | Saccharomyces cerevisiae | [sgdfc:3.8.0:4.8.2:4.8.3:9.6.0] [db:gtc-saccharomyces cerevisiae] [ui:ygl194c] [pn:putative deacetylase:hypothetical 51.5 kd protein in gcn1-spo8 intergenic region] [gn:rtl1:g1330] [gtcfc:10.1:10.2:10.7] [keggfc:14.2] |
| CONTIG5809 | 23834450_c1_16 | 5203 | 19306 | 1164 | 388 | YGL194C | 398 | 4.0(10)-37 | Saccharomyces cerevisiae | [sgdfc:4.8.3:6.3.0:9.6.0] [db:gtc-saccharomyces cerevisiae] [ui:ygl194c] [pn:putative deacetylase:hypothetical 51.5 kd protein in gcn1-spo8 intergenic region] [gn:rtl1:g1330] [gtcfc:10.1:10.2:10.7] [keggfc:14.2] |
| CONTIG4405 | 25657050_c1_4 | 5204 | 19307 | 282 | 94 | YGR187C | 156 | 9.5(10)-11 | Saccharomyces cerevisiae | [sgdfc:4.8.3:6.3.0:9.6.0] [db:gtc-saccharomyces cerevisiae] [ui:ygr187c] [pn:weak similarity to human hmg1p and hmg2p:hgh1 protein] [gn:hgh1:g7538] [gtcfc:10.1] [keggfc:14.2] [sgdfc:9.6.0] [db:gtc-saccharomyces cerevisiae] |
| CONTIG5063 | 11765627_f3_7 | 5205 | 19308 | 540 | 180 | YGR187C | 326 | 1.7(10)-29 | Saccharomyces cerevisiae | [ui:ygr187c] [pn:weak similarity to human hmg1p and hmg2p:hgh1 protein] [gn:hgh1:g7538] [gtcfc:10.1] [keggfc:14.2] [sgdfc:9.6.0] [db:gtc-saccharomyces cerevisiae] |
| CONTIG2392 | 417703_c2_3 | 5206 | 19309 | 291 | 97 | YGR218W | 220 | 6.7(10)-17 | Saccharomyces cerevisiae | [ui:ygr218w] [pn:chromosome region maintenance protein:chromosome region maintenance protein 1] [gn:crm1:g8514] [gtcfc:10.1] [keggfc:14.2] [sgdfc:9.6.0] [db:gtc-saccharomyces cerevisiae] |
| CONTIG2649 | 21535175_c3_7 | 5207 | 19310 | 1716 | 572 | YGR218W | 1870 | 4.0(10)-193 | Saccharomyces cerevisiae | [ui:ygr218w] [pn:chromosome region maintenance protein:chromosome region maintenance protein 1] [gn:crm1:g8514] [gtcfc:10.1] [keggfc:14.2] [sgdfc:9.6.0] [db:gtc-saccharomyces cerevisiae] |
| CONTIG4726 | 26594678_c2_5 | 5208 | 19311 | 378 | 126 | YGR218W | 344 | 3.8(10)-30 | Saccharomyces cerevisiae | [ui:ygr218w] [pn:chromosome region maintenance protein:chromosome region maintenance protein 1] [gn:crm1:g8514] [gtcfc:10.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2558 | 14554537_c3_4 | 5209 | 19312 | 1476 | 492 | YIL074C | 152 | 3.7(10)-7 | Saccharomyces cerevisiae | [keggfc:14.2] [sgdfc:9.6.0] [db:gtc-saccharomyces cerevisiae] [ui:yjl074c] [pn:required for structural maintenance of chromosomes:hypothetical 141.3 kd protein in scp160-mrp18 intergenic region] [gn:smc3;j1049] [gtcfc:10.1:12.8] [keggfc:14.2] [sgdfc:3.8.0:9.6.0] [db:gtc-saccharomyces cerevisiae] |
| CONTIG5286 | 13953792_f1_1 | 5210 | 19313 | 3522 | 1174 | YIL074C | 1049 | 5.5(10)-171 | Saccharomyces cerevisiae | [ui:yjl074c] [pn:required for structural maintenance of chromosomes:hypothetical 141.3 kd protein in scp160-mrp18 intergenic region] [gn:smc3;j1049] [gtcfc:10.1:12.8] [keggfc:14.2] [sgdfc:3.8.0:9.6.0] [db:gtc-saccharomyces cerevisiae] |
| CONTIG5470 | 22383430_c1_8 | 5211 | 19314 | 603 | 201 | YKR048C | 289 | 1.3(10)-25 | Saccharomyces cerevisiae | [ui:ykr048c] [pn:nucleosome assembly protein i:nucleosome assembly protein] [gn:nap1] [gtcfc:10.1:12.16:12.8] [keggfc:14.2] [sgdfc:3.8.0:6.4.0:9.6.0] [db:gtc-saccharomyces cerevisiae] |
| CONTIG5416 | 21502177_c3_15 | 5212 | 19315 | 1080 | 360 | YLR321C | 314 | 3.2(10)-28 | Saccharomyces cerevisiae | [ui:ylr321c] [pn:subunit of the rsc complex] [gn:sfh1] [gtcfc:10.1:10.2:12.8] [keggfc:14.2] [sgdfc:3.8.0:4.8.2:4.8.3:9.6.0] [db:gtc-saccharomyces cerevisiae] |
| CONTIG5399 | 9851537_c1_11 | 5213 | 19316 | 1446 | 482 | YML102W | 578 | 3.3(10)-56 | Saccharomyces cerevisiae | [ui:yml102w] [pn:chromatin assembly complex, subunit p60] [gn:cac2] [gtcfc:10.1:10.8:12.16] [keggfc:14.2] [sgdfc:3.6.0:4.8.3:6.4.0:9.6.0] [db:gtc-saccharomyces cerevisiae] |
| CONTIG5164 | 15117178_c1_6 | 5214 | 19317 | 291 | 97 | YOR213C | 180 | 5.0(10)-14 | Saccharomyces cerevisiae | [ui:yor213c] [pn:subunit of the rsc complex] [gtcfc:10.1:10.2:12.8] [keggfc:14.2] [sgdfc:3.8.0:4.8.2:4.8.3:9.6.0] [db:gtc-saccharomyces cerevisiae] |
| CONTIG5335 | 10553175_c1_7 | 5215 | 19318 | 597 | 199 | YPL254W | 94 | 0.00069 | Saccharomyces cerevisiae | [ui:ypl254w] [pn:interacts functionally with histone h2a] [gn:hfi1] [gtcfc:10.1] |
| CONTIG4964 | 5901151_f1_3 | 5216 | 19319 | 447 | 149 | YPL127C | 144 | 6.0(10)-10 | Saccharomyces cerevisiae | [keggfc:14.2] [sgdfc:9.6.0] [db gtc-saccharomyces cerevisiae] [ui:ypl127c] [pn:histone h1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | protein:histone h1-like protein] [gn:hho1:lpi17c] [gtcfc:10.1:12.8] [keggfc:13.3] [sgdfc:9.6.0] [db:gtc-saccharomyces cerevisiae] |
| CONTIG1370 | 16596905_c3_1 | 5217 | 19320 | 504 | 168 | YPR018W | 101 | 0.0051 | Saccharomyces cerevisiae | [ui:ypr018w] [pn:chromatin assembly complex, subunit p90] [gn:rlf2] [gtcfc:10.1:10.2:10.8:12.16] [keggfc:14.2] [sgdfc:3.6.0:4.8.3:6.4.0:9.6.0] [db:gtc-saccharomyces cerevisiae] |
| CONTIG3073 | 239062_c2_4 | 5218 | 19321 | 1266 | 422 | YPR018W | 188 | 2.8(10)-12 | Saccharomyces cerevisiae | [ui:ypr018w] [pn:chromatin assembly complex, subunit p90] [gn:rlf2] [gtcfc:10.1:10.2:10.8:12.16] [keggfc:14.2] [sgdfc:3.6.0:4.8.3:6.4.0:9.6.0] [db:gtc-saccharomyces cerevisiae] |
| CONTIG2829 | 23601500_c2_5 | 5219 | 19322 | 702 | 234 | YDR002W | 531 | 5.5(10)-61 | Saccharomyces cerevisiae | [ui:ydr002w] [pn:ran-specific gtpase-activating protein:ran binding protein 1 homolog:ranbp1:perinuclear array-localised protein] [gn:htn1:sfo1:yrb1:cst20:yd8119] [gtcfc:10.1:12.3] [keggfc:14.2] [sgdfc:4.11.0:8.1.0:9.2.0] [db:gtc-sacc |
| CONTIG1914 | 23524135_c1_6 | 5220 | 19323 | 258 | 86 | YER110C | 231 | 4.7(10)-18 | Saccharomyces cerevisiae | [ui:yer110c] [pn:ran-binding protein:hypothetical 122.6 kd protein in nup157-swi4 intergenic region] [gn:kap123] [gtcfc:10.1:12.3] [keggfc:14.2] [sgdfc:4.11.0] [db:gtc-saccharomyces cerevisiae] |
| CONTIG5421 | 30081437_c1_8 | 5221 | 19324 | 630 | 210 | YER110C | 268 | 5.2(10)-22 | Saccharomyces cerevisiae | [ui:yer110c] [pn:ran-binding protein:hypothetical 122.6 kd protein in nup157-swi4 intergenic region] [gn:kap123] [gtcfc:10.1:12.3] [keggfc:14.2] [sgdfc:4.11.0] [db:gtc-saccharomyces cerevisiae] |
| CONTIG5421 | 26958180_c2_11 | 5222 | 19325 | 2253 | 751 | YER110C | 1589 | 2.5(10)-163 | Saccharomyces cerevisiae | [ui:yer110c] [pn:ran-binding protein:hypothetical 122.6 kd protein in nup157-swi4 intergenic region] [gn:kap123] [gtcfc:10.1:12.3] [keggfc:14.2] [sgdfc:4.11.0] [db:gtc-saccharomyces cerevisiae] |
| CONTIG3475 | 23438412_c2_6 | 5223 | 19326 | 615 | 205 | YIR011C | 140 | 3.3(10)-9 | Saccharomyces | [ui:yir011c] [pn:required for |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | transport of rna15p from the cytoplasm to the nucleus:dbf8 protein] [gn:dbf8:sts1:yib11c] [gtcfc:12.3:10.1] [keggfc:14.2] [sgdfc:4.11.0:8.1.0] [db:gtc-saccharomyces cerevisiae] |
| CONTIG384 | 4492217_c3_4 | 5224 | 19327 | 1062 | 354 | YMR235C | 603 | 7.5(10)-59 | Saccharomyces cerevisiae | [ui:ymr235c] [pn:gtpase activating protein:ran gtpase activating protein 1:protein involved in rna production/processing] [gn:rna1:ym9959] [gtcfc:10.11:10.3:10.6:12.3] [keggfc:14.2] [sgdfc:4.2.0:4.5.0:4.11.0:9.2.0] [db:gtc-saccharomyce |
| CONTIG3429 | 24317187_c2_4 | 5225 | 19328 | 2217 | 739 | YOR160W | 1317 | 1.6(10)-134 | Saccharomyces cerevisiae | [ui:yor160w] [pn:involved in mrna transport] [gn:mtr10] [gtcfc:12.3:10.1] [keggfc:14.2] [sgdfc:4.11.0:8.1.0] [db:gtc-saccharomyces cerevisiae] |
| CONTIG4250 | 11115780_f2_2 | 5226 | 19329 | 564 | 188 | YAL005C | 329 | 4.7(10)-29 | Saccharomyces cerevisiae | [ui:yal005c] [pn:heat shock protein of hsp70 family, cytosolic:heat shock protein:heat shock protein yg100] [gn:ssa1] [gtcfc:12.7:10.7:13.2] [keggfc:14.2] [sgdfc:6.1.0:6.2.0:8.1.0:9.1.0:9.2.0: 11.1.0] [db:gtc-saccharomyces cerevisiae] |
| CONTIG5363 | 5110625_c2_24 | 5227 | 19330 | 1101 | 367 | YBR017C | 431 | 1.3(10)-39 | Saccharomyces cerevisiae | [ui:ybr017c] [pn:karyopherin:hypothetical 103.7 kd protein in ttp1-gal7 intergenic region] [gn:kap104:ybr017w:ybr0224] [gtcfc:10.1] [keggfc:14.2] [sgdfc:8.1.0:9.2.0] [db:gtc-saccharomyces cerevisiae] |
| CONTIG5363 | 5281253_c1_18 | 5228 | 19331 | 1668 | 556 | YBR017C | 423 | 3.1(10)-66 | Saccharomyces cerevisiae | [ui:ybr017c] [pn:karyopherin:hypothetical 103.7 kd protein in ttp1-gal7 intergenic region] [gn:kap104:ybr017w:ybr0224] [gtcfc:10.1] [keggfc:14.2] [sgdfc:8.1.0:9.2.0] [db:gtc-saccharomyces cerevisiae] |
| CONTIG1592 | 30506930_c1_1 | 5229 | 19332 | 741 | 247 | YBR170C | 786 | 3.1(10)-78 | Saccharomyces cerevisiae | [ui:ybr170c] [pn:nuclear protein localization factor and er translocation component:npl4 protein] [gn:npl4:ybr1231] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x18484.y | 15642686_c2_1 | 5230 | 19333 | 387 | 129 | YER009W | 542 | 2.2(10)-52 | Saccharomyces cerevisiae | [gtcfc:10.1:10.7:11.1:12.16] [keggfc:14.2] [sgdfc:6.2.0:8.1.0:8.8.0] [db:gtc-saccharomyces cerevisiae] [ui:yer009w] [pn:nuclear transport factor 2:nuclear transport factor 2:ntf-2:nuclear transport factor p10] [gn:ntf2] [gtcfc:10.1:12.6] [keggfc:14.2] [sgdfc:8.1.0] [db:gtc-saccharomyces cerevisiae] |
| CONTIG3257 | 3022780_f1_1 | 5231 | 19334 | 1128 | 376 | YIL063C | 190 | 3.5(10)-13 | Saccharomyces cerevisiae | [ui:yil063c] [pn:similarity to s.pombe brefeldin a resistance protein and yrb1p:hypothetical 36.1 kd protein in mr3-snp1 intergenic region] [gn:yrb2] [gtcfc:10.1:11.1] [keggfc:14.2] [sgdfc:8.1.0:9.1.0] [db:gtc-saccharomyces cerevisiae] |
| CONTIG2639 | 25410253_c3_7 | 5232 | 19335 | 243 | 81 | YLR347C | 215 | 1.7(10)-16 | Saccharomyces cerevisiae | [ui:ylr347c] [pn:karyopherin-beta] [gn:kap95] [gtcfc:10.1:10.7:11.1] [keggfc:14.2] [sgdfc:6.2.0:8.1.0] [db:gtc-saccharomyces cerevisiae] |
| CONTIG2639 | 7160212_c3_6 | 5233 | 19336 | 261 | 87 | YLR347C | 202 | 4.0(10)-15 | Saccharomyces cerevisiae | [ui:ylr347c] [pn:karyopherin-beta] [gn:kap95] [gtcfc:10.1:10.7:11.1] [keggfc:14.2] [sgdfc:6.2.0:8.1.0] [db:gtc-saccharomyces cerevisiae] |
| CONTIG5020 | 37500_c2_10 | 5234 | 19337 | 1239 | 413 | YLR347C | 1012 | 3.3(10)-102 | Saccharomyces cerevisiae | [ui:ylr347c] [pn:karyopherin-beta] [gn:kap95] [gtcfc:10.1:10.7:11.1] [keggfc:14.2] [sgdfc:6.2.0:8.1.0] [db:gtc-saccharomyces cerevisiae] |
| CONTIG3033 | 4179755_f1_1 | 5235 | 19338 | 1314 | 438 | YPL174C | 188 | 9.6(10)-16 | Saccharomyces cerevisiae | [ui:ypl174c] [pn:nuclear import protein:protein] [gn:nip80] [gtcfc:10.1] [keggfc:14.2] [sgdfc:8.1.0] [db:gtc-saccharomyces cerevisiae] |
| CONTIG5689 | 23484437_f1_2 | 5236 | 19339 | 2472 | 824 | YBR073W | 1073 | 2.6(10)-121 | Saccharomyces cerevisiae | [ui:ybr073w] [pn:required for meiosis:hypothetical 108.0 kd helicase in hsp26-sec18 intergenic region] [gn:rdh54:ybr0715] [gtcfc:10.0:10.8:12.8] [keggfc:14.2] [sgdfc:3.5.0:3.7.0:11.2.1] [db:gtc-saccharomyces cerevisiae] |
| CONTIG3226 | 13759687_f3_5 | 5237 | 19340 | 1782 | 594 | YDL088C | 184 | 3.2(10)-18 | Saccharomyces cerevisiae | [ui:ydl088c] [pn:suppressor of temperature-sensitive mutations in pol3p] [gn:asm4] [gtcfc:10.10] [keggfc:14.2] [sgdfc:11.2.1] [db:gtc-saccharomyces cerevisiae] |
| CONTIG2898 | 10719562_f2_1 | 5238 | 19341 | 576 | 192 | YDR061W | 285 | 1.7(10)-24 | Saccharomyces cerevisiae | [ui:ydr061w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3624 | 4773567_f3_2 | 5239 | 19342 | 918 | 306 | YDR061W | 309 | 3.8(10)-27 | Saccharomyces cerevisiae | e.coli:modf and photorepair protein phra] [gtcfc:10.0] [keggfc:14.2] [sgdfc:11.2.1] [db:gtc-saccharomyces cerevisiae [ui:ydr061w] [pn:similarity to e.coli:modf and photorepair protein phra] [gtcfc:10.10] [keggfc:14.2] [sgdfc:11.2.1] [db:gtc-saccharomyces cerevisiae |
| CONTIG1861 | 24804700_c2_4 | 5240 | 19343 | 633 | 211 | YDR460W | 123 | 2.5(10)-7 | Saccharomyces cerevisiae | [ui:ydr460w] [pn:tfiih subunit:transcription/repair factor] [gn:tfb3] [gtcfc:10.0:10.2:12.16] [keggfc:14.2] [sgdfc:4.8.1:6.4.0:11.2.1] [db:gtc-saccharomyces cerevisiae |
| CONTIG1861 | 22275312_c1_3 | 5241 | 19344 | 387 | 129 | YDR460W | 391 | 2.2(10)-36 | Saccharomyces cerevisiae | [ui:ydr460w] [pn:tfiih subunit:transcription/repair factor] [gn:tfb3] [gtcfc:10.10:10.2:12.16] [keggfc:14.2] [sgdfc:4.8.1:6.4.0:11.2.1] [db:gtc-saccharomyces cerevisiae |
| CONTIG5225 | 22464786_f2_3 | 5242 | 19345 | 852 | 284 | YEL019C | 169 | 1.6(10)-12 | Saccharomyces cerevisiae | [ui:yel019c] [pn:dna repair protein] [gn:mms21] [gtcfc:10.10.8] [keggfc:14.2] [sgdfc:3.7.0:11.2.1] [db:gtc-saccharomyces cerevisiae |
| CONTIG5580 | 179661_f1_2 | 5243 | 19346 | 618 | 206 | YER176W | 350 | 9.4(10)-31 | Saccharomyces cerevisiae | [ui:yer176w] [pn:dna dependent atpase/dna helicase b:hypothetical 127.0 kd protein in rad24-bmh1 intergenic region] [gn:sygp-orf61] [gtcfc:10.10.8] [keggfc:14.2] [sgdfc:3.6.0:3.7.0:11.2.1] [db:gtc-saccharomyces cerevisiae |
| CONTIG5580 | 34102067_f1_3 | 5244 | 19347 | 2754 | 918 | YER176W | 1340 | 6.0(10)-137 | Saccharomyces cerevisiae | [ui:yer176w] [pn:dna dependent atpase/dna helicase b:hypothetical 127.0 kd protein in rad24-bmh1 intergenic region] [gn:sygp-orf61] [gtcfc:10.10.8] [keggfc:14.2] [sgdfc:3.6.0:3.7.0:11.2.1] [db:gtc-saccharomyces cerevisiae |
| CONTIG55 | 10198760_f3_1 | 5245 | 19348 | 609 | 203 | YFR038W | 589 | 2.2(10)-57 | Saccharomyces cerevisiae | [ui:yfr038w] [pn:strong similarity to mouse lymphocyte specific helicase:hypothetical 88.7 kd helicase in cdc26-sap155 intergenic region] [gtcfc:10.10] [keggfc:14.2] [sgdfc:11.2.1] [db:gtc-saccharomyces cerevisiae |
| CONTIG440 | 22273389_c1_2 | 5246 | 19349 | 1224 | 408 | YFR038W | 465 | 1.3(10)-43 | Saccharomyces cerevisiae | [ui:yfr038w] [pn:strong similarity to mouse lymphocyte specific helicase:hypothetical 88.7 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3831 | 25443877_c3_3 | 5247 | 19350 | 2007 | 669 | YIL128W | 498 | 6.0(10)-53 | Saccharomyces cerevisiae | helicase in cdc26-sap155 intergenic region] [gtcfc:10.10] [keggfc:14.2] [sgdfc:11.2.1] [db:gtc-saccharomyces cerevisiae] [ui:yil128w] [pn:involved in ner repair and rna polymerase ii transcription:hypothetical 117.9 kd protein in fkh1-sth1 intergenic region] [gn:met18] [gtcfc:10.10.10.2] [keggfc:14.2] [sgdfc:4.8.1.11.2.1] [db:gtc-saccharomyces cerevisiae] |
| CONTIG5589 | 26439630_c2_16 | 5248 | 19351 | 1602 | 534 | YLR005W | 651 | 1.1(10)-103 | Saccharomyces cerevisiae | [ui:ylr005w] pn:tfiifb subunit:transcription initiation factor, factor b:supressor of stem-loop protein 1] [gn:ssl1] [gtcfc:10.10.10.2:10.7] [keggfc:14.2] [sgdfc:4.8.1:5.2.0:11.2.1] [db:gtc-saccharomyces cerevisiae] |
| CONTIG1262 | 9848453_c1_6 | 5249 | 19352 | 696 | 232 | YLR288C | 124 | 7.5(10)-9 | Saccharomyces cerevisiae | [ui:ylr288c] [pn:g2-specific checkpoint protein] [gn:mec3] [gtcfc:10.10.8:12.8] [keggfc:14.2] [sgdfc:3.7.0:3.8.0:11.2.1] [db:gtc-saccharomyces cerevisiae] |
| CONTIG1590 | 24409805_f2_3 | 5250 | 19353 | 915 | 305 | YOL043C | 486 | 1.8(10)-46 | Saccharomyces cerevisiae | [ui:yol043c] [pn:endonuclease iii-like glycosylase 2] [gn:ntg2] [gtcfc:10.10] [keggfc:14.2] [sgdfc:11.2.1] [db:gtc-saccharomyces cerevisiae] |
| CONTIG2962 | 14641943_c2_4 | 5251 | 19354 | 852 | 284 | YOR206W | 809 | 1.1(10)-80 | Saccharomyces cerevisiae | [ui:yor206w] [pn:strong similarity to rad4p:hypothetical 84.4 kd protein in rpc2/ret1 3"region] [gn:yox001] [gtcfc:10.10] [keggfc:14.2] [sgdfc:11.2.1] [db:gtc-saccharomyces cerevisiae] |
| CONTIG5003 | 13750026_f2_5 | 5252 | 19355 | 915 | 305 | YOR206W | 368 | 3.7(10)-33 | Saccharomyces cerevisiae | [ui:yor206w] [pn:strong similarity to rad4p:hypothetical 84.4 kd protein in rpc2/ret1 3"region] [gn:yox001] [gtcfc:10.10] [keggfc:14.2] [sgdfc:11.2.1] [db:gtc-saccharomyces cerevisiae] |
| CONTIG5003 | 12140763_f3_6 | 5253 | 19356 | 567 | 189 | YOR206W | 493 | 4.2(10)-47 | Saccharomyces cerevisiae | [ui:yor206w] [pn:strong similarity to rad4p:hypothetical 84.4 kd protein in rpc2/ret1 3"region] [gn:yox001] [gtcfc:10.10] [keggfc:14.2] [sgdfc:11.2.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5606 | 6054715_c3_50 | 5254 | 19357 | 1146 | 382 | YOR368W | 301 | 7.5(10)-27 | *Saccharomyces cerevisiae* | [ui:yor368w][pn:dna damage checkpoint control protein][gn:rad17][gtcfc:10.10:12.8][keggfc:14.2][sgdfc:3.5.0:3.8.0:11.2.1][db:gtc-saccharomyces cerevisiae] |
| CONTIG5807 | 860175_c3_23 | 5255 | 19358 | 1524 | 508 | YPL122C | 683 | 2.7(10)-123 | *Saccharomyces cerevisiae* | [ui:ypl122c][pn:tfiih subunit:transcription/repair factor][gn:tfb2][gtcfc:10.10:10.2][keggfc:14.2][sgdfc:4.8.1:11.2.1][db-gtc-saccharomyces cerevisiae] |
| CONTIG4935 | 24610337_f3_3 | 5256 | 19359 | 1128 | 376 | YPR056W | 453 | 1.8(10)-64 | *Saccharomyces cerevisiae* | [ui:ypr056w][pn:component of rna polymerase transcription initiation tfiih factor][gtcfc:10.10:10.2][keggfc:14.2][sgdfc:4.8.1:11.2.1][db:gtc-saccharomyces cerevisiae] |
| CONTIG5522 | 36360905_f1_3 | 5257 | 19360 | 789 | 263 | YGL213C | 243 | 2.1(10)-20 | *Saccharomyces cerevisiae* | [ui:ygl213c][pn:antiviral protein of the beta-transducin:wd-40 repeat family:antiviral protein][gn:ski8][gtcfc:10.10:12.14][keggfc:14.2][sgdfc:11.6.0][db-gtc-saccharomyces cerevisiae] |
| CONTIG5522 | 4897306_f2_7 | 5258 | 19361 | 495 | 165 | YGL213C | 358 | 6.9(10)-33 | *Saccharomyces cerevisiae* | [ui:ygl213c][pn:antiviral protein of the beta-transducin:wd-40 repeat family:antiviral protein][gn:ski8][gtcfc:10.10:12.14][keggfc:14.2][sgdfc:11.6.0][db-gtc-saccharomyces cerevisiae] |
| CONTIG1373 | 11909444_c2_2 | 5259 | 19362 | 666 | 222 | YBL041W | 916 | 5.0(10)-92 | *Saccharomyces cerevisiae* | [ui:ybl041w][pn:multicatalytic endopeptidase complex subunit:potential proteasome component c5:multicatalytic endopeptidase complex subunit c5][gn:prs3;pre7;pts1;ybl0407][gtcfc:10.11:14.1][ec:3.4.99.46][keggfc:14.1][sgdfc:6.5.1:] |
| CONTIG1643 | 30350813_f2_1 | 5260 | 19363 | 597 | 199 | YBR058C | 382 | 1.7(10)-34 | *Saccharomyces cerevisiae* | [ui:ybr058c][pn:ubiquitin specific protease:ubiquitin carboxyl-terminal hydrolase 14:ubiquitin thiolesterase 14:ubiquitin-specific processing protease 14:deubiquitinating enzyme 14][gn:ubp14;ybr0515][gtcfc:10.11][ec:3.1.2.15][keg |
| CONTIG2277 | 24492311_c2_4 | 5261 | 19364 | 678 | 226 | YBR058C | 271 | 1.5(10)-22 | *Saccharomyces cerevisiae* | [ui:ybr058c][pn:ubiquitin specific protease:ubiquitin carboxyl-terminal hydrolase 14:ubiquitin thiolesterase 14:ubiquitin-specific processing protease |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x12892.y | 13835917_c1_2 | 5262 | 19365 | 438 | 146 | YBR082C | 699 | 5.0(10)-69 | *Saccharomyces cerevisiae* | 14:deubiquitinating enzyme 14 [gn:ubp14:ybr0515] [gtcfc:10.11] [ec:3.1.2.15] [keg [ui:ybr082c] [pn:ubiquitin-conjugating enzyme:ubiquitin-conjugating enzyme e2-16 kd:ubiquitin-protein ligase:ubiquitin carrier protein] [gn:ubc4:ybr0745] [gtcfc:10.11.12.9:13.2:14.1] [ec:6.3.2.19] [keggfc:14.1] [sgdfc:3.3.0:6.5.1:9.2 |
| CONTIG5492 | 24412517_c3_15 | 5263 | 19366 | 3246 | 1082 | YDL190C | 1724 | 1.2(10)-177 | *Saccharomyces cerevisiae* | [ui:ydl190c] [pn:ubiquitin fusion degradation protein:ub fusion degradation protein 2] [gn:ufd2:d1255] [sgdfc:6.5.1] [dbgtc-saccharomyces cerevisiae] |
| CONTIG1035 | 10634680_c3_2 | 5264 | 19367 | 720 | 240 | YDL132W | 612 | 8.4(10)-60 | *Saccharomyces cerevisiae* | [ui:ydl132w] [pn:controls g1/s transition] [gn:cdc53] [gtcfc:10.11.12.8] [keggfc:13.3] [sgdfc:3.8.0:6.5.1] [dbgtc-saccharomyces cerevisiae] |
| CONTIG2950 | 992030_c3_5 | 5265 | 19368 | 1866 | 622 | YDL132W | 140 | 1.0(10)-14 | *Saccharomyces cerevisiae* | [ui:ydl132w] [pn:controls g1/s transition] [gn:cdc53] [gtcfc:10.11.12.8] [keggfc:13.3] [sgdfc:3.8.0:6.5.1] [dbgtc-saccharomyces cerevisiae] |
| b9x12j03.y | 271937_c1_1 | 5266 | 19369 | 630 | 210 | YDL132W | 199 | 8.0(10)-15 | *Saccharomyces cerevisiae* | [ui:ydl132w] [pn:controls g1/s transition] [gn:cdc53] [gtcfc:10.11.12.8] [keggfc:13.3] [sgdfc:3.8.0:6.5.1] [dbgtc-saccharomyces cerevisiae] |
| CONTIG1905 | 12601703_f3_4 | 5267 | 19370 | 342 | 114 | YDL126C | 290 | 1.5(10)-24 | *Saccharomyces cerevisiae* | [ui:ydl126c] [pn:microsomal protein of/pas1/sec18 family of atpases:cell division control protein 48] [gn:cdc48] [gtcfc:10.11:12.8] [keggfc:14.2] [sgdfc:3.8.0:6.5.1] [db:gtc-saccharomyces cerevisiae] |
| CONTIG5516 | 6500_f3_6 | 5268 | 19371 | 2529 | 843 | YDL126C | 3106 | 0 | *Saccharomyces cerevisiae* | [ui:ydl126c] [pn:microsomal protein of/pas1/sec18 family of atpases:cell division control protein 48] [gn:cdc48] [gtcfc:10.11:12.8] [keggfc:14.2] [sgdfc:3.8.0:6.5.1] [db:gtc-saccharomyces cerevisiae] |
| CONTIG5084 | 4095180_c2_11 | 5269 | 19372 | 918 | 306 | YDL122W | 240 | 6.0(10)-22 | *Saccharomyces cerevisiae* | [ui:ydl126w] [pn:ubiquitin carboxyl-terminal hydrolase 1:ubiquitin thiolesterase 1:ubiquitin-specific protease:ubiquitin-specific |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5129 | 5081556_f2_4 | 5270 | 19373 | 696 | 232 | YDL122W | 157 | 2.5(10)-10 | Saccharomyces cerevisiae | processing protease 1:deubiquitinating enzyme 1] [gn:ubp1] [gtcfc:10.11] [ec:3.1.2.15] [keggfc:14.1] [sg ui:ydl122w] [pn:ubiquitin-specific protease:ubiquitin carboxyl-terminal hydrolase 1:ubiquitin thiolesterase 1:ubiquitin-specific processing protease 1:deubiquitinating enzyme 1] [gn:ubp1] [gtcfc:10.11] |
| CONTIG5129 | 13859438_f2_5 | 5271 | 19374 | 588 | 196 | YDL122W | 227 | 7.9(10)-18 | Saccharomyces cerevisiae | [ec:3.1.2.15] [keggfc:14.1] [sg ui:ydl122w] [pn:ubiquitin-specific protease:ubiquitin carboxyl-terminal hydrolase 1:ubiquitin thiolesterase 1:ubiquitin-specific processing protease 1:deubiquitinating enzyme 1] [gn:ubp1] [gtcfc:10.11] [ec:3.1.2.15] [keggfc:14.1] [sg |
| CONTIG5760 | 26602260_f1_3 | 5272 | 19375 | 666 | 222 | YDL064W | 596 | 4.2(10)-58 | Saccharomyces cerevisiae | ui:ydl064w] [pn:ubiquitin-conjugating enzyme:ubiquitin-conjugating enzyme e2-18 kd:ubiquitin-protein ligase:ubiquitin carrier protein] [gn:ubc9] [gtcfc:10.11:10.7:12.8] [ec:6.3.2.19] [keggfc:14.1] |
| CONTIG4273 | 26850002_c2_9 | 5273 | 19376 | 702 | 234 | YDL007W | 849 | 6.4(10)-85 | Saccharomyces cerevisiae | [sgdfc:3.8.0:6.3.0:6.5.1] [db:gtc-sa ui:ydl007w] [pn:probable component of 26s proteasome complex:26s protease regulatory subunit 4 homolog:tat- binding homolog 5] [gn:yta5;yhs4:d2920] [gtcfc:10.11] [keggfc:14.2] [sgdfc:6.5.1] [db:gtc-saccharomyces cerevisiae] |
| CONTIG5610 | 14644806_c2_15 | 5274 | 19377 | 873 | 291 | YDL007W | 681 | 4.0(10)-67 | Saccharomyces cerevisiae | [ui:ydl007w] [pn:probable component of 26s proteasome complex:26s protease regulatory subunit 4 homolog:tat- binding homolog 5] [gn:yta5;yhs4:d2920] [gtcfc:10.11] [keggfc:14.2] [sgdfc:6.5.1] [db:gtc-saccharomyces cerevisiae] |
| CONTIG3149 | 29464092_c3_3 | 5275 | 19378 | 1614 | 538 | YDR069C | 681 | 4.0(10)-67 | Saccharomyces cerevisiae | [ui:ydr069c] [pn:ubiquitin-specific protease:ubiquitin carboxyl-terminal hydrolase 4:ubiquitin thiolesterase 4:ubiquitin-specific processing protease |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5815 | 14552002_f3_21 | 5276 | 19379 | 567 | 189 | YDR092W | 104 | 1.1(10)-12 | *Saccharomyces cerevisiae* | 4:deubiquitinating enzyme 4:vacuole biogenesis protein ssv7 [gn:ubp4:doa4:ssv7:yd960] [ui:ydr092w] [pn:ubiquitin-conjugating enzyme:ubiquitin-conjugating enzyme e2-17.5 kd:ubiquitin-protein ligase:ubiquitin carrier protein] [gn:ubc13:yd6652] [gtcfc:10.11:10.7] [ec:6.3.2.19] [keggfc:14.1] [sgdfc:6.3.0:6.5.1] [db:gtc-sac |
| CONTIG894 | 24414010_c1_2 | 5277 | 19380 | 264 | 88 | YDR177W | 237 | 4.5(10)-20 | *Saccharomyces cerevisiae* | [ui:ydr177w] [pn:ubiquitin conjugating enzyme:ubiquitin conjugating enzyme e2-24 kd:ubiquitin- protein ligase:ubiquitin carrier protein] [gn:ubc1:yd9395] [gtcfc:10.11:10.7:12.15:14.1] [ec:6.3.2.19] [keggfc:14.1] [sgdfc:3.4.0:6.3.0:6.5 |
| CONTIG965 | 22454057_f1_2 | 5278 | 19381 | 207 | 69 | YDR177W | 162 | 4.0(10)-12 | *Saccharomyces cerevisiae* | [ui:ydr177w] [pn:ubiquitin conjugating enzyme:ubiquitin conjugating enzyme e2-24 kd:ubiquitin- protein ligase:ubiquitin carrier protein] [gn:ubc1:yd9395] [gtcfc:10.11:10.7:12.15:14.1] [ec:6.3.2.19] [keggfc:14.1] [sgdfc:3.4.0:6.3.0:6.5 |
| CONTIG2882 | 26384713_c2_4 | 5279 | 19382 | 1119 | 373 | YDR394W | 1368 | 6.5(10)-140 | *Saccharomyces cerevisiae* | [ui:ydr394w] [pn:26s proteasome subunit:26s protease regulatory subunit 6 homolog:ynt1 protein:tat-binding homolog 2] [gn:yta2:ynt1:d9509] [gtcfc:10.11] [keggfc:14.2] [sgdfc:6.5.1] [db-gtc-*saccharomyces cerevisiae* |
| CONTIG5523 | 3922777_c1_17 | 5280 | 19383 | 621 | 207 | YER012W | 738 | 3.7(10)-73 | *Saccharomyces cerevisiae* | [ui:yer012w] [pn:26s proteasome subunit c11: proteasome component c11:macropain subunit c11:proteinase ysce subunit 11:multicatalytic endopeptidase complex subunit c11] [gn:pre1] [gtcfc:10.11] [ec:3.4.99.46] [keggfc:14.1] [sgdfc:6.5.1: |
| CONTIG5728 | 11218942_f2_7 | 5281 | 19384 | 1290 | 430 | YER021W | 779 | 1.7(10)-77 | *Saccharomyces cerevisiae* | [ui:yer021w] [pn:26s proteasome subunit:proteasome component] [gn:sun2] [gtcfc:10.11] [keggfc:14.2] [sgdfc:6.5.1] [db-gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4785 | 10972161_f1_1 | 5282 | 19385 | 627 | 209 | YER094C | 815 | 2.6(10)-81 | *Saccharomyces cerevisiae* | *saccharomyces cerevisiae* [ui:yer094c] [pn:26s proteasome subunit:proteasome component:macropain subunit:multicatalytic endopeptidase complex subunit pup3] [gn:pup3] [gtcfc:10.11] [ec:3.4.99.46] [keggfc:14.1] [sgdfc:6.5.1] [db:gtc- |
| CONTIG2102 | 22457535_c2_5 | 5283 | 19386 | 942 | 314 | YER098W | 165 | 9.8(10)-20 | *Saccharomyces cerevisiae* | *saccharomyces cerevisiae* [ui:yer098w] [pn:ubiquitin carboxyl-terminal hydrolase:ubiquitin carboxyl-terminal hydrolase 9:ubiquitin thiolesterase 9:ubiquitin-specific processing protease 9:deubiquitinating enzyme 9] [gn:ubp9] [gtcfc:10.11] [ec:3.1.2.15] [keggfc |
| b2x17720.x | 22470307_c3_5 | 5284 | 19387 | 735 | 245 | YER098W | 221 | 3.1(10)-17 | *Saccharomyces cerevisiae* | [ui:yer098w] [pn:ubiquitin carboxyl-terminal hydrolase:ubiquitin carboxyl-terminal hydrolase 9:ubiquitin thiolesterase 9:ubiquitin-specific processing protease 9:deubiquitinating enzyme 9] [gn:ubp9] [gtcfc:10.11] [ec:3.1.2.15] [keggfc |
| CONTIG4175 | 10584432_f3_3 | 5285 | 19388 | 777 | 259 | YER100W | 609 | 1.7(10)-59 | *Saccharomyces cerevisiae* | [ui:yer100w] [pn:ubiquitin-conjugating enzyme:ubiquitin-conjugating enzyme e2-28.4 kd:ubiquitin- protein ligase:ubiquitin carrier protein] [gn:ubc6:doa2] [gtcfc:10.11:10.7:12.16:12.9] [ec:6.3.2.19] [keggfc:14.1] [sgdfc:3.3.0:6.3.0:6.5 |
| CONTIG1561 | 12773437_c3_7 | 5286 | 19389 | 1044 | 348 | YER151C | 140 | 2.8(10)-10 | *Saccharomyces cerevisiae* | [ui:yer151c] [pn:ubiquitin-specific proteinase:ubiquitin carboxyl-terminal hydrolase 3:ubiquitin thiolesterase 3:ubiquitin-specific processing protease 3:deubiquitinating enzyme 3] [gn:ubp3] [gtcfc:10.11] [ec:3.1.2.15] [keggfc:14.1] [ |
| b9x11r65.x | 3010967_f2_1 | 5287 | 19390 | 276 | 92 | YER151C | 217 | 1.1(10)-16 | *Saccharomyces cerevisiae* | [ui:yer151c] [pn:ubiquitin-specific proteinase:ubiquitin carboxyl-terminal hydrolase 3:ubiquitin thiolesterase 3:ubiquitin-specific |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2463 | 34272812_f1_1 | 5288 | 19391 | 864 | 288 | YFR050C | 752 | 1.2(10)-74 | Saccharomyces cerevisiae | processing protease 3:deubiquitinating enzyme 3] [gn:ubp3] [gtcfc:10.11] [ec:3.1.2.15] [keggfc:14.1] [ui:yfr050c] [pn:26s proteasome subunit:proteasome component:macropain subunit:proteinase ysce subunit pre4:multicatalytic endopeptidase complex subunit pre4] [gn:pre4] [gtcfc:10.11] [ec:3.4.99.46] [keggfc:14.1] [sgdfc:6.5.1.9.2.0] [d |
| CONTIG4163 | 24398262_f2_2 | 5289 | 19392 | 888 | 296 | YFR052W | 403 | 1.2(10)-37 | Saccharomyces cerevisiae | [ui:yfr052w] [pn:26s proteasome regulatory subunit:nuclear integrity protein 1] [gn:nin1] [gtcfc:10.11.12.8:13.2] [keggfc:14.2] [sgdfc:3.8.0:6.5.1.9.2.0:11.1.0] [db:gtc-saccharomyces cerevisiae] |
| CONTIG2706 | 19532125_c2_4 | 5290 | 19393 | 450 | 150 | YGL087C | 428 | 2.6(10)-40 | Saccharomyces cerevisiae | [ui:ygl087c] [pn:similarity to ubiquitin--protein ligase:hypothetical 15.5 kd protein in mfa12-mad1 intergenic region] [gtcfc:10.11:10.7] [keggfc:14.2] [sgdfc:6.3.0:6.5.1] [dbgtc-saccharomyces cerevisiae] |
| CONTIG1103 | 12282626_f2_3 | 5291 | 19394 | 417 | 139 | YGL048C | 335 | 1.8(10)-30 | Saccharomyces cerevisiae | [ui:ygl048c] [pn:26s proteasome subunit:26s protease regulatory subunit 8 homolog:sug1 protein:cim3 protein:tat-binding protein tby1] [gn:sug1:tby1:tbpy:cim3:crl3] [gtcfc:10.11.12.8] [keggfc:14.2] [sgdfc:3.8.0:6.5.1] [db:gtc-saccharom |
| CONTIG2002 | 12282626_f3_3 | 5292 | 19395 | 957 | 319 | YGL048C | 1184 | 2.0(10)-120 | Saccharomyces cerevisiae | [ui:ygl048c] [pn:26s proteasome subunit:26s protease regulatory subunit 8 homolog:sug1 protein:cim3 protein:tat-binding protein tby1] [gn:sug1:tby1:tbpy:cim3:crl3] [gtcfc:10.11.12.8] [keggfc:14.2] [sgdfc:3.8.0:6.5.1] [dbgtc-saccharom |
| CONTIG783 | 4116567_f2_1 | 5293 | 19396 | 249 | 83 | YGL048C | 355 | 1.3(10)-32 | Saccharomyces cerevisiae | [ui:ygl048c] [pn:26s proteasome subunit:26s protease regulatory subunit 8 homolog:sug1 protein:cim3 protein:tat-binding protein tby1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4529 | 20009682_c2_9 | 5294 | 19397 | 732 | 244 | YGL011C | 784 | 5.0(10)-78 | Saccharomyces cerevisiae | [gn:sug1:tbpy:cim3:crl3] [gtcfc:10.11.12.8] [keggfc:14.2] [sgdfc:3.8.0:6.5.1] [db:gtc-saccharom [ui:ygl011c] [pn:26s proteasome subunit yc7alpha/y8:proteasome component c7-alpha:macropain subunit c7-alpha:proteinase ysce subunit 7:multicatalytic endopeptidase complex c7:component y8:sc11 suppressor protein] [gn:prs2:prc2:sc11] [g |
| CONTIG4962 | 789628_f1_4 | 5295 | 19398 | 1059 | 353 | YGR048W | 771 | 1.2(10)-76 | Saccharomyces cerevisiae | [ui:ygr048w] [pn:ubiquitin fusion degradation protein:rub fusion degradation protein 1] [gn:ufd1] [gtcfc:10.11] [keggfc:14.2] [sgdfc:6.5.1] [db:gtc-saccharomyces cerevisiae] |
| CONTIG5108 | 5960292_f1_1 | 5296 | 19399 | 234 | 78 | YGR048W | 151 | 2.7(10)-10 | Saccharomyces cerevisiae | [ui:ygr048w] [pn:ubiquitin fusion degradation protein:rub fusion degradation protein 1] [gn:ufd1] [gtcfc:10.11] [keggfc:14.2] [sgdfc:6.5.1] [db:gtc-saccharomyces cerevisiae] |
| CONTIG5107 | 20414682_c2_9 | 5297 | 19400 | 771 | 257 | YGR135W | 788 | 1.8(10)-78 | Saccharomyces cerevisiae | [ui:ygr135w] [pn:26s proteasome subunit y13:proteasome component y13:macropain subunit y13:proteinase ysce subunit 13:multicatalytic endopeptidase complex subunit y13] [gn:prs5:pre9] [gtcfc:10.11] [ec:3.4.99.46] [keggfc:14.1] [sgdfc:6 |
| CONTIG1129 | 25572906_c2_2 | 5298 | 19401 | 1305 | 435 | YGR184C | 178 | 6.0(10)-10 | Saccharomyces cerevisiae | [ui:ygr184c] [pn:ubiquitin-protein ligase:n-end-recognizing protein:ubiquitin-protein ligase e3 component:n-recognin] [gn:ubr1:g7168] [gtcfc:10.11] [keggfc:14.2] [sgdfc:6.5.1:9.2.0] [db:gtc-saccharomyces cerevisiae] |
| CONTIG4544 | 32619157_f2_1 | 5299 | 19402 | 2454 | 818 | YGR184C | 165 | 4.7(10)-13 | Saccharomyces cerevisiae | [ui:ygr184c] [pn:ubiquitin-protein ligase:n-end-recognizing protein:ubiquitin-protein ligase e3 component:n-recognin] [gn:ubr1:g7168] [gtcfc:10.11] [keggfc:14.2] [sgdfc:6.5.1:9.2.0] [db:gtc-saccharomyces cerevisiae] |
| CONTIG4837 | 594792_f3_2 | 5300 | 19403 | 1896 | 632 | YGR184C | 728 | 1.2(10)-70 | Saccharomyces cerevisiae | [ui:ygr184c] [pn:ubiquitin-protein ligase:n-end-recognizing |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4837 | 12503175_f1_1 | 5301 | 19404 | 1488 | 496 | YGR184C | 104 | 0.096 | Saccharomyces cerevisiae | protein:ubiquitin-protein ligase e3 component:n-recognin [gn:ubr1:g7168] [gtcfc:10.11] [keggfc:14.2] [sgdfc:6.5.1:9.2.0] [db:gtc-saccharomyces cerevisiae] [ui:ygr184c] [pn:ubiquitin-protein ligase:n-end-recognizing protein:ubiquitin-protein ligase e3 component:n-recognin] [gn:ubr1:g7168] [gtcfc:10.11] [keggfc:14.2] [sgdfc:6.5.1:9.2.0] [db:gtc-saccharomyces cerevisiae] |
| CONTIG3090 | 26298260_c1_2 | 5302 | 19405 | 303 | 101 | YGR253C | 267 | 3.0(10)-23 | Saccharomyces cerevisiae | [ui:ygr253c] [pn:26s proteasome subunit:proteasome component pup2:macropain subunit pup2:proteinase ysce subunit pup2:multicatalytic endopeptidase complex subunit pup2] [gn:pup2:doa5] [gtcfc:10.11:12.8] [ec:3.4.99.46] [keggfc:14.1] [s |
| CONTIG355 | 1204657_c3_5 | 5303 | 19406 | 315 | 105 | YGR253C | 395 | 8.3(10)-37 | Saccharomyces cerevisiae | [ui:ygr253c] [pn:26s proteasome subunit:proteasome component pup2:macropain subunit pup2:proteinase ysce subunit pup2:multicatalytic endopeptidase complex subunit pup2] [gn:pup2:doa5] [gtcfc:10.11:12.8] [ec:3.4.99.46] [keggfc:14.1] [s |
| CONTIG5713 | 4882176_f3_6 | 5304 | 19407 | 1227 | 409 | YGR270W | 200 | 2.0(10)-13 | Saccharomyces cerevisiae | [ui:ygr270w] [pn:26s proteasome subunit:tat-binding homolog 7] [gn:yta7] [gtcfc:10.11] [keggfc:14.2] [sgdfc:6.5.1] [db:gtc-saccharomyces cerevisiae] |
| CONTIG5713 | 40677_f1_3 | 5305 | 19408 | 2760 | 920 | YGR270W | 1743 | 3.2(10)-186 | Saccharomyces cerevisiae | [ui:ygr270w] [pn:26s proteasome subunit:tat-binding homolog 7] [gn:yta7] [gtcfc:10.11] [keggfc:14.2] [sgdfc:6.5.1] [db:gtc-saccharomyces cerevisiae] |
| CONTIG1924 | 11907192_f1_1 | 5306 | 19409 | 660 | 220 | YHR027C | 511 | 3.7(10)-48 | Saccharomyces cerevisiae | [ui:yhr027c] [pn:subunit of the 26s proteasome:hypothetical 109.5 kd protein in ppa1-dap2 intergenic region] [gn:hrd2] [gtcfc:10.11] [keggfc:14.2] [sgdfc:6.5.1] [db:gtc-saccharomyces cerevisiae] |
| CONTIG2755 | 24665942_f1_1 | 5307 | 19410 | 468 | 156 | YHR027C | 479 | 1.1(10)-44 | Saccharomyces cerevisiae | [ui:yhr027c] [pn:subunit of the 26s proteasome:hypothetical 109.5 kd protein in ppa1-dap2 intergenic region] [gn:hrd2] [gtcfc:10.11] [keggfc:14.2] [sgdfc:6.5.1] db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2755 | 6835138_f1_2 | 5308 | 19411 | 249 | 83 | YHR027C | 256 | 8.5(10)-21 | *Saccharomyces cerevisiae* | [ui:yhr027c] [pn:subunit of the 26s proteasome:hypothetical 109.5 kd protein in ppa1-dap2 intergenic region] [gn:hrd2] [gtcfc:10.11] [keggfc:14.2] [sgdfc:6.5.1] db:gtc-*saccharomyces cerevisiae* |
| CONTIG2755 | 25581512_f1_3 | 5309 | 19412 | 978 | 326 | YHR027C | 430 | 2.0(10)-39 | *Saccharomyces cerevisiae* | [ui:yhr027c] [pn:subunit of the 26s proteasome:hypothetical 109.5 kd protein in ppa1-dap2 intergenic region] [gn:hrd2] [gtcfc:10.11] [keggfc:14.2] [sgdfc:6.5.1] db:gtc-*saccharomyces cerevisiae* |
| b3x12710.x | 24414075_f2_2 | 5310 | 19413 | 213 | 71 | YHR027C | 106 | 8.9(10)-5 | *Saccharomyces cerevisiae* | [ui:yhr027c] [pn:subunit of the 26s proteasome:hypothetical 109.5 kd protein in ppa1-dap2 intergenic region] [gn:hrd2] [gtcfc:10.11] [keggfc:14.2] [sgdfc:6.5.1] db:gtc-*saccharomyces cerevisiae* |
| CONTIG2548 | 20881662_f3_2 | 5311 | 19414 | 741 | 247 | YHR200W | 514 | 2.0(10)-49 | *Saccharomyces cerevisiae* | [ui:yhr200w] [pn:26s proteasome subunit:26s proteasome regulatory subunit] [gn:stun1] [gtcfc:10.11] [keggfc:14.2] [sgdfc:6.5.1] [db:gtc-*saccharomyces cerevisiae* |
| CONTIG5430 | 34078136_c3_19 | 5312 | 19415 | 2886 | 962 | YIL156W | 471 | 4.7(10)-63 | *Saccharomyces cerevisiae* | [ui:yil156w] [pn:ubiquitin carboxy terminal hydrolase:ubiquitin carboxyl-terminal hydrolase 7:ubiquitin thiolesterase 7:ubiquitin-specific processing protease 7:deubiquitinating enzyme 7] [gn:ubp7] [gtcfc:10.11] [ec:3.1.2.15] [keggfc: |
| CONTIG2488 | 12925375_c3_8 | 5313 | 19416 | 543 | 181 | YIL075C | 304 | 5.7(10)-26 | *Saccharomyces cerevisiae* | [ui:yil075c] [pn:26s proteasome regulatory subunit:trna-processing protein] [gn:sen3] [gtcfc:10.11:10.6] [keggfc:14.2] [sgdfc:4.5.0:6.5.1:9.2.0] [db:gtc-*saccharomyces cerevisiae* |
| CONTIG4919 | 915882_f3_6 | 5314 | 19417 | 2079 | 693 | YIL075C | 1728 | 4.5(10)-178 | *Saccharomyces cerevisiae* | [ui:yil075c] [pn:26s proteasome regulatory subunit:trna-processing protein] [gn:sen3] [gtcfc:10.11:10.6] [keggfc:14.2] [sgdfc:4.5.0:6.5.1:9.2.0] [db:gtc-*saccharomyces cerevisiae* |
| CONTIG5716 | 10723752_f2_6 | 5315 | 19418 | 963 | 321 | YIL197W | 263 | 2.2(10)-21 | *Saccharomyces cerevisiae* | [ui:yil197w] [pn:ubiquitin c-terminal hydrolase:ubiquitin carboxyl-terminal hydrolase 12:ubiquitin thiolesterase 12:ubiquitin-specific processing |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5716 | 24728462_f1_2 | 5316 | 19419 | 2142 | 714 | YJL197W | 620 | 6.4(10)-98 | *Saccharomyces cerevisiae* | protease 12:deubiquitinating enzyme 12] [gn:ubp12;j0340] [gtcfc:10.11] [ec:3.1.2.15] [ke [ui:yjl197w] [pn:ubiquitin c-terminal hydrolase:ubiquitin carboxyl-terminal hydrolase 12:ubiquitin thiolesterase 12:ubiquitin-specific processing protease 12:deubiquitinating enzyme 12] [gn:ubp12;j0340] [gtcfc:10.11] [ec:3.1.2.15] [ke |
| CONTIG4322 | 24647805_f1_1 | 5317 | 19420 | 345 | 115 | YJL001W | 299 | 1.2(10)-26 | *Saccharomyces cerevisiae* | [ui:yjl001w] [pn:multicatalytic endopeptidase complex subunit:proteasome component pre3 precursor:macropain subunit pre3:proteinase ysce subunit pre3:multicatalytic endopeptidase complex subunit pre3] [gn:pre3;j1407] [gtcfc:10.11:12.8] |
| CONTIG2332 | 959380_f2_1 | 5318 | 19421 | 810 | 270 | YJR099W | 280 | 1.3(10)-24 | *Saccharomyces cerevisiae* | [ui:yjr099w] [pn:ubiquitin-specific protease:ubiquitin carboxyl-terminal hydrolase yuh1:ubiquitin thiolesterase] [gn:yuh1;j1941] [gtcfc:10.11] [ec:3.1.2.15] [keggfc:14.1] [sgdfc:6.3.0:6.5.1:9.2.0] [db:gtc-*saccharomyces cerevisiae*] |
| CONTIG1336 | 3907128_f3_3 | 5319 | 19422 | 867 | 289 | YKL213C | 493 | 4.7(10)-47 | *Saccharomyces cerevisiae* | [ui:ykl213c] [pn:involved in ubiquitin-dependent proteolysis:protein] [gn:doa1] [gtcfc:10.11] [keggfc:14.2] [sgdfc:6.5.1] [db:gtc-*saccharomyces cerevisiae*] |
| CONTIG5139 | 13792203_c2_7 | 5320 | 19423 | 1530 | 510 | YKL213C | 512 | 3.8(10)-58 | *Saccharomyces cerevisiae* | [ui:ykl213c] [pn:involved in ubiquitin-dependent proteolysis:protein] [gn:doa1] [gtcfc:10.11] [keggfc:14.2] [sgdfc:6.5.1] [db:gtc-*saccharomyces cerevisiae*] |
| CONTIG5615 | 3907128_f1_4 | 5321 | 19424 | 357 | 119 | YKL213C | 120 | 1.8(10)-6 | *Saccharomyces cerevisiae* | [ui:ykl213c] [pn:involved in ubiquitin-dependent proteolysis:protein] [gn:doa1] [gtcfc:10.11] [keggfc:14.2] [sgdfc:6.5.1] [db:gtc-*saccharomyces cerevisiae*] |
| CONTIG1706 | 1197311_f3_1 | 5322 | 19425 | 1269 | 423 | YKL145W | 1401 | 3.7(10)-176 | *Saccharomyces cerevisiae* | [ui:ykl145w] [pn:26s proteasome subunit:26s protease regulatory subunit 7 homolog:cim5 protein:tat-binding homolog 3] [gn:cim5;yta3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1540 | 25554760_f2_2 | 5323 | 19426 | 1002 | 334 | YKL010C | 165 | 5.5(10)-9 | Saccharomyces cerevisiae | [gtcfc:10.11.12.8] [keggfc:14.2] [sgdfc:3.8.0:6.5.1] [db:gtc-saccharomyces cerevisiae] [ui:ykl010c] [pn:similarity to rat ubiquitin ligase nedd4:hypothetical 167.8 kd protein cce1-cap1 intergenic region] [gn:ufd4:ykl162] [gtcfc:10.11] [keggfc:14.2] [sgdfc:6.5.1:9.2.0] [db:gtc-saccharomyces cerevisiae] |
| CONTIG3231 | 3651255_f3_3 | 5324 | 19427 | 915 | 305 | YKL010C | 397 | 1.3(10)-35 | Saccharomyces cerevisiae | [ui:ykl010c] [pn:similarity to rat ubiquitin ligase nedd4:hypothetical 167.8 kd protein cce1-cap1 intergenic region] [gn:ufd4:ykl162] [gtcfc:10.11] [keggfc:14.2] [sgdfc:6.5.1:9.2.0] [db:gtc-saccharomyces cerevisiae] |
| CONTIG4051 | 21734385_c1_4 | 5325 | 19428 | 411 | 137 | YKL010C | 449 | 4.0(10)-41 | Saccharomyces cerevisiae | [ui:ykl010c] [pn:similarity to rat ubiquitin ligase nedd4:hypothetical 167.8 kd protein cce1-cap1 intergenic region] [gn:ufd4:ykl162] [gtcfc:10.11] [keggfc:14.2] [sgdfc:6.5.1:9.2.0] [db:gtc-saccharomyces cerevisiae] |
| CONTIG4051 | 19644012_c3_5 | 5326 | 19429 | 1323 | 441 | YKL010C | 528 | 1.5(10)-65 | Saccharomyces cerevisiae | [ui:ykl010c] [pn:similarity to rat ubiquitin ligase nedd4:hypothetical 167.8 kd protein cce1-cap1 intergenic region] [gn:ufd4:ykl162] [gtcfc:10.11] [keggfc:14.2] [sgdfc:6.5.1:9.2.0] [db:gtc-saccharomyces cerevisiae] |
| CONTIG5676 | 24397906_f1_1 | 5327 | 19430 | 621 | 207 | YLR167W | 545 | 1.1(10)-52 | Saccharomyces cerevisiae | [ui:ylr167w] [pn:ubiquitin/ribosomal protein s27a:ubiquitin] [gn:ubi3:19470] [gtcfc:10.11.10.4] [keggfc:14.2] [sgdfc:5.1.0:6.5.1.9.2.0] [db:gtc-saccharomyces cerevisiae] |
| CONTIG5781 | 3990936_c2_24 | 5328 | 19431 | 606 | 202 | YLR306W | 417 | 3.8(10)-39 | Saccharomyces cerevisiae | [ui:ylr306w] [pn:ubiquitin-conjugating enzyme:ubiquitin-conjugating enzyme e2-21.2 kd:ubiquitin-protein ligase:ubiquitin carrier protein] [gn:ubc12:12142] [gtcfc:10.11:10.7] [ec:6.3.2.19] [keggfc:14.1] [sgdfc:6.3.0:6.5.1] [db:gtc-sacc |
| CONTIG1979 | 9953462_f2_1 | 5329 | 19432 | 1368 | 456 | YLR452C | 285 | 4.7(10)-52 | Saccharomyces cerevisiae | [ui:ylr452c] [pn:involved in desensitization to alpha-factor pheromone:protein] [gn:sst2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5416 | 32501382_f1_1 | 5330 | 19433 | 1407 | 469 | YML111W | 95 | 0.34 | Saccharomyces cerevisiae | [gtcfc:10.11.11:12.8:12.9] [keggfc:14.2] [sgdfc:3.3.0:6.5.1:9.1.0:10.1.6] [db:gtc-saccharomyces cerevisiae] [ui:yml111w] [pn:strong similarity to ubiquitination protein bul1p] [gtcfc:10.11:10.7] [keggfc:14.2] [sdgfc:6.3.0:6.5.1] [db-gtc-saccharomyces cerevisiae] |
| CONTIG5738 | 986261_c3_21 | 5331 | 19434 | 1158 | 386 | YML111W | 309 | 1.6(10)-26 | Saccharomyces cerevisiae | [ui:yml111w] [pn:strong similarity to ubiquitination protein bul1p] [gtcfc:10.11:10.7] [keggfc:14.2] [sgdfc:6.3.0:6.5.1] [db-gtc-saccharomyces cerevisiae] |
| CONTIG3334 | 15735437_c1_3 | 5332 | 19435 | 273 | 91 | YML092C | 278 | 2.1(10)-24 | Saccharomyces cerevisiae | [ui:yml092c] [pn:26s proteasome subunit y7:proteasome component y7:proteinase ysce subunit 7:multicatalytic endopeptidase complex subunit y7] [gn:prs4:pre8] [gtcfc:10.11:12.8] [ec:3.4.99.46] [keggfc:14.1] [sgdfc6 |
| CONTIG5642 | 4771952_f2_4 | 5333 | 19436 | 501 | 167 | YML092C | 543 | 1.7(10)-52 | Saccharomyces cerevisiae | [ui:yml092c] [pn:26s proteasome subunit y7:proteasome component y7:proteinase ysce subunit 7:multicatalytic endopeptidase complex subunit y7] [gn:prs4:pre8] [gtcfc:10.11:12.8] [ec:3.4.99.46] [keggfc:14.1] [sgdfc6 |
| CONTIG5642 | 22051285_f3_5 | 5334 | 19437 | 534 | 178 | YMR022W | 637 | 1.8(10)-62 | Saccharomyces cerevisiae | [ui:ymr022w] [pn:ubiquitin conjugation enzyme:ubiquitin-conjugating enzyme e2-18 kd:ubiquitin-protein ligase:ubiquitin carrier protein] [gn:ubc7:qri8:ym9711] [gtcfc:10.11:10.7:12.16:12.9:13.2] [ec:6.3.2.19] [keggfc:14.1] [sgdfc:3.3.0: |
| CONTIG2798 | 35367187_f3_3 | 5335 | 19438 | 1212 | 404 | YMR223W | 236 | 3.2(10)-44 | Saccharomyces cerevisiae | [ui:ymr223w] [pn:similarity to human putative ubiquitin carboxyl-terminal hydrolase:putative ubiquitin carboxyl-terminal hydrolase ymr223w:ubiquitin thiolesterase:ubiquitin-specific processing protease:deubiquitinating enzyme] [gn:ym99 |
| CONTIG2798 | 4882180_f3_4 | 5336 | 19439 | 255 | 85 | YMR223W | 178 | 5.5(10)-13 | Saccharomyces | [ui:ymr223w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | human putative ubiquitin carboxyl-terminal hydrolase;putative ubiquitin carboxyl-terminal hydrolase ymr223w;ubiquitin thiolesterase;ubiquitin-specific processing protease;deubiquitinating enzyme] [gn:ym99 |
| CONTIG916 | 22067010_c1_1 | 5337 | 19440 | 978 | 326 | YMR223W | 236 | 1.0(10)-35 | Saccharomyces cerevisiae | [ui:ymr223w] [pn:similarity to human putative ubiquitin carboxyl-terminal hydrolase;putative ubiquitin carboxyl-terminal hydrolase ymr223w;ubiquitin thiolesterase;ubiquitin-specific processing protease;deubiquitinating enzyme] [gn:ym99 |
| CONTIG18 | 12312660_f3_1 | 5338 | 19441 | 570 | 190 | YMR275C | 95 | 0.04399 | Saccharomyces cerevisiae | [ui:ymr275c] [pn:ubiquitination pathway protein;ubiquitination pathway protein bul1:respiration deficiency suppressor] [gn:bul1:dag1:rds1:ym8021] [gtcfc:10.11:10.7] [keggfc:14.2] [sgdfc:6.3.0:6.5.1] [db:gtc-saccharomyces cerevisiae] |
| CONTIG1692 | 35798416_c2_1 | 5339 | 19442 | 1215 | 405 | YMR275C | 384 | 1.7(10)-34 | Saccharomyces cerevisiae | [ui:ymr275c] [pn:ubiquitination pathway protein;ubiquitination pathway protein bul1:respiration deficiency suppressor] [gn:bul1:dag1:rds1:ym8021] [gtcfc:10.11:10.7] [keggfc:14.2] [sgdfc:6.3.0:6.5.1] [db:gtc-saccharomyces cerevisiae] |
| CONTIG4859 | 2158338_c3_13 | 5340 | 19443 | 1173 | 391 | YMR275C | 289 | 2.5(10)-24 | Saccharomyces cerevisiae | [ui:ymr275c] [pn:ubiquitination pathway protein;ubiquitination pathway protein bul1:respiration deficiency suppressor] [gn:bul1:dag1:rds1:ym8021] [gtcfc:10.11:10.7] [keggfc:14.2] [sgdfc:6.3.0:6.5.1] [db:gtc-saccharomyces cerevisiae] |
| CONTIG5472 | 24641625_f1_1 | 5341 | 19444 | 1008 | 336 | YMR275C | 272 | 1.6(10)-22 | Saccharomyces cerevisiae | [ui:ymr275c] [pn:ubiquitination pathway protein;ubiquitination pathway protein bul1:respiration deficiency suppressor] [gn:bul1:dag1:rds1:ym8021] [gtcfc:10.11:10.7] [keggfc:14.2] [sgdfc:6.3.0:6.5.1] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5200 | 33212758_f3_8 | 5342 | 19445 | 855 | 285 | YMR314W | 733 | 1.3(10)-72 | Saccharomyces cerevisiae | [ui:ymr314w] [pn:26s proteasome subunit, alpha-type:proteasome component pre5:macropain subunit pre5:proteinase ysce subunit pre5:multicatalytic endopeptidase complex subunit pre5] [gn:pre5:ym9924] [gtcfc:10.11:12.8] [ec:3.4.99.46] [k |
| CONTIG5810 | 5083552_f1_5 | 5343 | 19446 | 1614 | 538 | YNL239W | 902 | 1.6(10)-90 | Saccharomyces cerevisiae | [ui:ynl239w] [pn:aminopeptidase of cysteine protease family:cysteine proteinase 1:y3:bleomycin hydrolase:blm hydrolase] [gn:blh1:ycp1:lap3:gal6:n1118] [gtcfc:10.11.5.5] [ec:3.4.22.-] [keggfc:14.1] [sgdfc:6.5.1:9.2.0] [db:gtc-saccharom |
| CONTIG4281 | 20914068_c2_5 | 5344 | 19447 | 735 | 245 | YOL038W | 806 | 2.2(10)-80 | Saccharomyces cerevisiae | [ui:yol038w] [pn:multicatalytic endopeptidase complex chain:proteasome component:macropain subunit:proteinase ysce subunit pre6:multicatalytic endopeptidase complex subunit pre6] [gn:pre6] [gtcfc:10.11:12.8] [ec:3.4.99.46] [keggfc:14. |
| CONTIG1575 | 25807938_f1_1 | 5345 | 19448 | 969 | 323 | YOR117W | 1160 | 7.0(10)-118 | Saccharomyces cerevisiae | [ui:yor117w] [pn:26s proteasome subunit:probable 26s protease subunit tbp-1:tat- binding protein homolog 1] [gn:yta1:o3258:yor3258w] [gtcfc:10.11] [keggfc:14.2] [sgdfc:6.5.1] [db:gtc-saccharomyces cerevisiae] |
| CONTIG3560 | 954776_f1_1 | 5346 | 19449 | 1908 | 636 | YOR124C | 837 | 5.5(10)-120 | Saccharomyces cerevisiae | [ui:yor124c] [pn:ubiquitin-specific proteinase:ubiquitin carboxyl-terminal hydrolase 2:ubiquitin thiolesterase 2:ubiquitin-specific processing protease 2:deubiquinating enzyme 2] [gn:ubp2:o3281:yor3281c] [gtcfc:10.11] [ec:3.1.2.15] |
| CONTIG4291 | 5115900_c3_9 | 5347 | 19450 | 1896 | 632 | YOR124C | 190 | 4.5(10)-19 | Saccharomyces cerevisiae | [ui:yor124c] [pn:ubiquitin-specific proteinase:ubiquitin carboxyl-terminal hydrolase 2:ubiquitin thiolesterase 2:ubiquitin-specific processing protease 2:deubiquinating enzyme 2] [gn:ubp2:o3281:yor3281c] [gtcfc:10.11] [ec:3.1.2.15] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4662 | 34656251_f1_2 | 5348 | 19451 | 465 | 155 | YOR157C | 504 | 2.2(10)-48 | *Saccharomyces cerevisiae* | [gtcfc:10.11] [ec:3.1.2.15] [ui:yor157c] [pn:26s proteasome subunit:proteasome component precursor:macropain subunit:proteinase ysce subunit pup1:multicatalytic endopeptidase complex subunit pup1] [gn:pup1] [gtcfc:10.11.12.8] [ec:3.4.99.46] [keggfc:14.1] [sgdfc: |
| CONTIG4662 | 29410912_f2_3 | 5349 | 19452 | 483 | 161 | YOR157C | 537 | 7.4(10)-52 | *Saccharomyces cerevisiae* | [ui:yor157c] [pn:26s proteasome subunit:proteasome component precursor:macropain subunit:proteinase ysce subunit pup1:multicatalytic endopeptidase complex subunit pup1] [gn:pup1] [gtcfc:10.11.12.8] [ec:3.4.99.46] [keggfc:14.1] [sgdfc: |
| CONTIG3491 | 12540827_c2_7 | 5350 | 19453 | 1197 | 399 | YOR259C | 1574 | 9.5(10)-162 | *Saccharomyces cerevisiae* | [ui:yor259c] [pn:26s proteasome subunit:probable 26s protease subunit sug2] [gn:crl13:sug2:crl13_of_yor259c] [gtcfc:10.11:10.2] [keggfc:14.2] [sgdfc:4.8.2:6.5.1] [db:gtc-*saccharomyces cerevisiae*] |
| CONTIG5559 | 20423437_f1_4 | 5351 | 19454 | 1029 | 343 | YOR261C | 854 | 1.8(10)-85 | *Saccharomyces cerevisiae* | [ui:yor261c] [pn:strong similarity to human 26s proteasome regulatory chain, p40] [gtcfc:10.11] [keggfc:14.2] [sgdfc:6.5.1] [db:gtc-*saccharomyces cerevisiae*] |
| CONTIG5711 | 26204426_f1_4 | 5352 | 19455 | 243 | 81 | YOR362C | 307 | 1.7(10)-27 | *Saccharomyces cerevisiae* | [ui:yor362c] [pn:26s proteasome subunit c1:proteasome component c1:macropain subunit c1:proteinase ysce subunit 1:multicatalytic endopeptidase complex subunit c1] [gn:prs1:pre10] [gtcfc:10.11.12.8] [ec:3.4.99.46] [keggfc:14.1] [s |
| CONTIG5711 | 867015_f1_5 | 5353 | 19456 | 516 | 172 | YOR362C | 448 | 2.0(10)-42 | *Saccharomyces cerevisiae* | [ui:yor362c] [pn:26s proteasome subunit c1:proteasome component c1:macropain subunit c1:proteinase ysce subunit 1:multicatalytic endopeptidase complex subunit c1] [gn:prs1:pre10] [gtcfc:10.11.12.8] [ec:3.4.99.46] [keggfc:14.1] [s |
| CONTIG4364 | 23626263_c3_8 | 5354 | 19457 | 252 | 84 | YPL074W | 244 | 1.1(10)-19 | *Saccharomyces cerevisiae* | [ui:ypl074w] [pn:similarity to vps4p and yta4p:probable 26s protease subunit:tat-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4774 | 40662_f1_2 | 5355 | 19458 | 537 | 179 | YPL074W | 440 | 6.5(10)-41 | Saccharomyces cerevisiae | homolog 6] [gn:yta6] [gtcfc:10.11] [keggfc:14.2] [sgdfc:6.5.1] [db:gtc-saccharomyces cerevisiae] [ui:ypl074w] [pn:similarity to vps4p and yta4p:probable 26s protease subunit:tat-binding homolog 6] [gn:yta6] [gtcfc:10.11] [keggfc:14.2] [sgdfc:6.5.1] [db:gtc-saccharomyces cerevisiae] |
| CONTIG3898 | 37900_c1_3 | 5356 | 19459 | 840 | 280 | YPL003W | 286 | 6.5(10)-25 | Saccharomyces cerevisiae | [ui:ypl003w] [pn:similarity to ubiquitin-activating enzymes] [gtcfc:10.11:10.7] [keggfc:14.2] [sgdfc:6.3.0:6.5.1] [db:gtc-saccharomyces cerevisiae] |
| CONTIG5726 | 20345018_c2_23 | 5357 | 19460 | 1047 | 349 | YPR066W | 564 | 1.0(10)-54 | Saccharomyces cerevisiae | [ui:ypr066w] [pn:strong similarity to ubiquitin-activating enzymes] [gtcfc:10.11:10.7] [keggfc:14.2] [sgdfc:6.3.0:6.5.1] [db:gtc-saccharomyces cerevisiae] |
| CONTIG5036 | 21679002_c3_13 | 5358 | 19461 | 942 | 314 | YPR103W | 1144 | 3.5(10)-116 | Saccharomyces cerevisiae | [ui:ypr103w] [pn:26s proteasome subunit:proteasome component pre2 precursor:macropain subunit pre2:proteinase ysec subunit pre2:multicatalytic endopeptidase complex subunit pre2] [gn:pre2:prg1:doa3:ps283] [gtcfc:10.11:12.8] [ec:3.4.99 |
| CONTIG2014 | 23631875_f1_1 | 5359 | 19462 | 912 | 304 | YPR180W | 236 | 5.7(10)-20 | Saccharomyces cerevisiae | [ui:ypr180w] [pn:similarity to ubiquitin-activating enzymes] [gtcfc:10.11:10.7] [keggfc:14.2] [sgdfc:6.3.0:6.5.1] [db:gtc-saccharomyces cerevisiae] |
| CONTIG5485 | 31672080_f3_5 | 5360 | 19463 | 315 | 105 | YPR180W | 181 | 1.2(10)-13 | Saccharomyces cerevisiae | [ui:ypr180w] [pn:similarity to ubiquitin-activating enzymes] [gtcfc:10.11:10.7] [keggfc:14.2] [sgdfc:6.3.0:6.5.1] [db:gtc-saccharomyces cerevisiae] |
| CONTIG4098 | 32609638_c2_4 | 5361 | 19464 | 2112 | 704 | YDL077C | 283 | 3.2(10)-21 | Saccharomyces cerevisiae | [ui:ydl077c] [pn:vacuolar carboxypeptidase y] [gn:vam6] [gtcfc:10.11:12.16] [keggfc:14.2] [sgdfc:6.5.2:9.10.0] [db:gtc-saccharomyces cerevisiae] |
| CONTIG2363 | 23627260_c3_5 | 5362 | 19465 | 183 | 61 | YEL060C | 144 | 4.2(10)-9 | Saccharomyces cerevisiae | [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4372 | 24429712_f1_3 | 5363 | 19466 | 1068 | 356 | YEL060C | 818 | 1.2(10)-81 | *Saccharomyces cerevisiae* | *saccharomyces cerevisiae* [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc-saccharomyces cerevisiae] |
| CONTIG5557 | 4105375_c1_15 | 5364 | 19467 | 1041 | 347 | YEL060C | 482 | 5.0(10)-46 | *Saccharomyces cerevisiae* | *saccharomyces cerevisiae* [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc-saccharomyces cerevisiae] |
| CONTIG5557 | 5256575_c3_19 | 5365 | 19468 | 1209 | 403 | YEL060C | 479 | 1.0(10)-45 | *Saccharomyces cerevisiae* | *saccharomyces cerevisiae* [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc-saccharomyces cerevisiae] |
| CONTIG809 | 36047562_f3_2 | 5366 | 19469 | 519 | 173 | YEL060C | 501 | 4.7(10)-48 | *Saccharomyces cerevisiae* | *saccharomyces cerevisiae* [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc-saccharomyces cerevisiae] |
| CONTIG934 | 9877305_c2_4 | 5367 | 19470 | 243 | 81 | YEL060C | 284 | 3.6(10)-24 | *Saccharomyces cerevisiae* | *saccharomyces cerevisiae* [ui:yel060c] [pn:protease b, vacuolar:cerevisin precursor:vacuolar protease b:proteinase yscb] [gn:prb1] [gtcfc:10.11:12.16] [ec:3.4.21.48] [keggfc:14.1] [sgdfc:6.3.0:6.5.2:9.10.0] [db:gtc-saccharomyces cerevisiae] |
| CONTIG3501 | 14878552_f1_1 | 5368 | 19471 | 837 | 279 | YHR028C | 336 | 1.6(10)-29 | *Saccharomyces cerevisiae* | *saccharomyces cerevisiae* [ui:yhr028c] [pn:dipeptidyl aminopeptidase b:dpap b:ysev] [gn:dap2] [gtcfc:10.11:12.16] [ec:3.4.14.-] [keggfc:14.1] [sgdfc:6.5.2:9.10.0] [db:gtc-saccharomyces cerevisiae] |
| CONTIG4805 | 26692808_c2_4 | 5369 | 19472 | 1485 | 495 | YHR028C | 1154 | 3.1(10)-117 | *Saccharomyces cerevisiae* | *saccharomyces cerevisiae* [ui:yhr028c] [pn:dipeptidyl aminopeptidase b:ysev |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3410 | 9844200_c1_9 | 5370 | 19473 | 876 | 292 | YKL103C | 964 | 4.2(10)-97 | *Saccharomyces cerevisiae* | [ui:ykl103c] [pn:aminopeptidase ysci precursor, vacuolar:vacuolar aminopeptidase i precursor:polypeptidase:leucine aminopeptidase:aminopeptidase iii:aminopeptidase ysci:lapiv] [gn:ape1:lap4:ykl455] [gtcfc:10.11:12.16] [ec:3.4.11.1]k |
| CONTIG3410 | 36523442_c2_10 | 5371 | 19474 | 876 | 292 | YKL103C | 549 | 4.0(10)-53 | *Saccharomyces cerevisiae* | [ui:ykl103c] [pn:aminopeptidase ysci precursor, vacuolar:vacuolar aminopeptidase i precursor:polypeptidase:leucine aminopeptidase:aminopeptidase iii:aminopeptidase ysci:lapiv] [gn:ape1:lap4:ykl455] [gtcfc:10.11:12.16] [ec:3.4.11.1]k |
| CONTIG4002 | 36353158_c1_6 | 5372 | 19475 | 954 | 318 | YKL103C | 459 | 1.3(10)-43 | *Saccharomyces cerevisiae* | [ui:ykl103c] [pn:aminopeptidase ysci precursor, vacuolar:vacuolar aminopeptidase i precursor:polypeptidase:leucine aminopeptidase:aminopeptidase iii:aminopeptidase ysci:lapiv] [gn:ape1:lap4:ykl455] [gtcfc:10.11:12.16] [ec:3.4.11.1]k |
| CONTIG4002 | 11141300_c3_8 | 5373 | 19476 | 852 | 284 | YKL103C | 277 | 1.1(10)-23 | *Saccharomyces cerevisiae* | [ui:ykl103c] [pn:aminopeptidase ysci precursor, vacuolar:vacuolar aminopeptidase i precursor:polypeptidase:leucine aminopeptidase:aminopeptidase iii:aminopeptidase ysci:lapiv] [gn:ape1:lap4:ykl455] [gtcfc:10.11:12.16] [ec:3.4.11.1]k |
| CONTIG5022 | 24491408_c2_7 | 5374 | 19477 | 1737 | 579 | YMR297W | 1588 | 3.1(10)-163 | *Saccharomyces cerevisiae* | [ui:ymr297w] [pn:carboxypeptidase y, serine-type protease:carboxypeptidase yscy precursor:carboxypeptidase yscy] [gn:prc1] [gtcfc:10.11:12.16] [keggfc:14.1] [sgdfc:6.5.2:9.10.0] [db:gtc-*saccharomyces cerevisiae*] |
| CONTIG5684 | 4878376_f3_11 | 5375 | 19478 | 1599 | 535 | YMR297W | 989 | 9.4(10)-100 | *Saccharomyces cerevisiae* | [ui:ymr297w] [pn:carboxypeptidase y, serine-type |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5790 | 22695252_f1_5 | 5376 | 19479 | 1659 | 533 | YMR297W | 1348 | 8.5(10)-138 | Saccharomyces cerevisiae | protease:carboxypeptidase y precursor:carboxypeptidase yscy [gn:prc1] [gtcfc:10.11:12.16] [keggfc:14.1] [sgdfc:6.5.2:9.10.0] [db:gtc-saccharomyces cerevisiae] [ui:ymr297w] [pn:carboxypeptidase y, serine-type protease:carboxypeptidase y precursor:carboxypeptidase yscy [gn:prc1] [gtcfc:10.11:12.16] [keggfc:14.1] [sgdfc:6.5.2:9.10.0] [db:gtc-saccharomyces cerevisiae] |
| CONTIG4471 | 10970285_c3_11 | 5377 | 19480 | 1008 | 336 | YNR007C | 293 | 5.5(10)-61 | Saccharomyces cerevisiae | [ui:ynr007c] [pn:essential for autophagocytosis:hypothetical 35.9 kd protein in vps27-cse2 intergenic region] [gn:aut1:n2040] [gtcfc:10.11:12.13] [keggfc:14.2] [sgdfc:6.5.2:8.5.0] [db:gtc-saccharomyces cerevisiae] |
| CONTIG2749 | 16075_c3_7 | 5378 | 19481 | 1146 | 382 | YPL154C | 146 | 2.2(10)-7 | Saccharomyces cerevisiae | [ui:ypl154c] [pn:aspartyl protease:saccharopepsin precursor:aspartate protease:proteinase a:proteinase ysca] [gn:pep4:pho9:pra1:p2585] [gtcfc:10.11.5.2:7.2] [ec:3.4.23.25] [keggfc:14.1] [sgdfc:6.3.0:6.5.2:9.10.0] [db:gtc-saccharomyces |
| CONTIG5808 | 24003930_f2_13 | 5379 | 19482 | 1011 | 337 | YPL154C | 1342 | 3.7(10)-137 | Saccharomyces cerevisiae | [ui:ypl154c] [pn:aspartyl protease:saccharopepsin precursor:aspartate protease:proteinase a:proteinase ysca] [gn:pep4:pho9:pra1:p2585] [gtcfc:10.11.5.2:7.2] [ec:3.4.23.25] [keggfc:14.1] [sgdfc:6.3.0:6.5.2:9.10.0] [db:gtc-saccharomyces |
| CONTIG1436 | 14941251_f1_1 | 5380 | 19483 | 726 | 242 | YCL057W | 592 | 1.1(10)-57 | Saccharomyces cerevisiae | [ui:ycl057w] [pn:saccharolysin protease d:proteinase yscd:oligopeptidase yscd] [gn:prd1:ycl57w] [gtcfc:10.11:7.2] [ec:3.4.24.37] [keggfc:14.1] [sgdfc:6.5.3] [db:gtc-saccharomyces cerevisiae] |
| CONTIG1436 | 3015887_f2_2 | 5381 | 19484 | 204 | 68 | YCL057W | 152 | 7.0(10)-10 | Saccharomyces cerevisiae | [ui:ycl057w] [pn:saccharolysin protease d:proteinase yscd:oligopeptidase yscd] [gn:prd1:ycl57w] [gtcfc:10.11:7.2] [ec:3.4.24.37] [keggfc:14.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2081 | 10631932_c2_8 | 5382 | 19485 | 1455 | 485 | YDR144C | 192 | 4.7(10)-12 | Saccharomyces cerevisiae | [sgdfc:6.5.3] [db:gtc-saccharomyces cerevisiae] [ui:ydr144c] [pn:aspartyl protease of the periplasmic space:aspartic proteinase mkc7 precursor] [gn:mkc7:yd8358] [gtcfc:10.11.11.15.2] [ec:3.4.23.-] [keggfc:14.1] [sgdfc:6.5.3:9.1.0] [db:gtc-saccharomyces cerevisiae] |
| CONTIG3875 | 23943801_c3_4 | 5383 | 19486 | 675 | 225 | YHR113W | 508 | 8.8(10)-49 | Saccharomyces cerevisiae | [ui:yhr113w] [pn:similarity to vacuolar aminopeptidase ape1:hypothetical 54.2 kd protein in cdc12-orc6 intergenic region] [gtcfc:10.11] [keggfc:14.2] [sgdfc:6.5.3] [db:gtc-saccharomyces cerevisiae] |
| CONTIG651 | 25429661_c2_3 | 5384 | 19487 | 750 | 250 | YHR113W | 796 | 2.7(10)-79 | Saccharomyces cerevisiae | [ui:yhr113w] [pn:similarity to vacuolar aminopeptidase ape1:hypothetical 54.2 kd protein in cdc12-orc6 intergenic region] [gtcfc:10.11] [keggfc:14.2] [sgdfc:6.5.3] [db:gtc-saccharomyces cerevisiae] |
| CONTIG3699 | 26594376_c3_8 | 5385 | 19488 | 870 | 290 | YIL015W | 265 | 3.3(10)-22 | Saccharomyces cerevisiae | [ui:yil015w] [pn:barriepepsin precursor:extracellular] [gn:bar1:sst1] [gtcfc:10.11:12.9] [ec:3.4.23.35] [keggfc:14.1] [sgdfc:3.3.0:6.5.3] [db:gtc-saccharomyces cerevisiae] |
| CONTIG5353 | 5111011_f3_8 | 5386 | 19489 | 564 | 188 | YDL104C | 302 | 5.9(10)-27 | Saccharomyces cerevisiae | [ui:ydl104c] [pn:similarity to h. influenzae sialoglycoprotease:gcp:putative protease qri7] [gn:qri7:d2366] [gtcfc:10.11] [ec:3.4.24.-] [keggfc:14.1] [sgdfc:6.6.0] [db:gtc-saccharomyces cerevisiae] |
| b1x10133.x | 24658450_c3_2 | 5387 | 19490 | 546 | 182 | YDL104C | 155 | 1.3(10)-10 | Saccharomyces cerevisiae | [ui:ydl104c] [pn:similarity to h. influenzae sialoglycoprotease:gcp:putative protease qri7] [gn:qri7:d2366] [gtcfc:10.11] [ec:3.4.24.-] [keggfc:14.1] [sgdfc:6.6.0] [db:gtc-saccharomyces cerevisiae] |
| CONTIG5255 | 15897912_c3_8 | 5388 | 19491 | 513 | 171 | YDR415C | 478 | 1.3(10)-45 | Saccharomyces cerevisiae | [ui:ydr415c] [pn:strong similarity to bacterial leucyl aminopeptidase] [gtcfc:10.11] [keggfc:14.2] [sgdfc:6.6.0] [db:gtc-saccharomyces cerevisiae] |
| CONTIG5738 | 21595160_f2_4 | 5389 | 19492 | 1293 | 431 | YLR299W | 575 | 7.0(10)-56 | Saccharomyces cerevisiae | [ui:ylr299w] [pn:gamma- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5738 | 24417207_f3_6 | 5390 | 19493 | 672 | 224 | YLR299W | 469 | 1.2(10)-44 | Saccharomyces cerevisiae | glutamyltransferase, involved in glutathione synthesis] [gn:cis2] [gtcfc:10.2:12.8] [keggfc:14.2] [sgdfc:1.1.2:3.8.0] [db:gtc-saccharomyces cerevisiae] [ui:ylr299w] [pn:gamma-glutamyltransferase, involved in glutathione synthesis] [gn:cis2] [gtcfc:10.2:12.8] [keggfc:14.2] [sgdfc:1.1.2:3.8.0] [db:gtc-saccharomyces cerevisiae] |
| CONTIG3001 | 24022812_f3_4 | 5391 | 19494 | 660 | 220 | YMR116C | 647 | 1.6(10)-63 | Saccharomyces cerevisiae | [ui:ymr116c] [pn:strong similarity to n.crassa cpe2 protein:guanine nucleotide-binding protein beta subunit-like protein] [gn:ym9718] [gtcfc:10.2] [keggfc:14.2] [sgdfc:1.1.2] [db:gtc-saccharomyces cerevisiae] |
| CONTIG3001 | 605055_f1_2 | 5392 | 19495 | 426 | 142 | YMR116C | 472 | 5.7(10)-45 | Saccharomyces cerevisiae | [ui:ymr116c] [pn:strong similarity to n.crassa cpe2 protein:guanine nucleotide-binding protein beta subunit-like protein] [gn:ym9718] [gtcfc:10.2] [keggfc:14.2] [sgdfc:1.1.2] [db:gtc-saccharomyces cerevisiae] |
| CONTIG1120 | 30484717_c3_3 | 5393 | 19496 | 843 | 281 | YBR142W | 288 | 2.1(10)-24 | Saccharomyces cerevisiae | [ui:ybr142w] [pn:atp-dependent rna helicase:atp-dependent rna helicase mak5] [gn:mak5:ybr1119] [gtcfc:10.2:10.3] [keggfc:14.2] [sgdfc:4.2.0:4.9.0] [db:gtc-saccharomyces cerevisiae] |
| CONTIG5583 | 24353432_f1_1 | 5394 | 19497 | 1098 | 366 | YBR142W | 627 | 2.2(10)-61 | Saccharomyces cerevisiae | [ui:ybr142w] [pn:atp-dependent rna helicase:atp-dependent rna helicase mak5] [gn:mak5:ybr1119] [gtcfc:10.2:10.3] [keggfc:14.2] [sgdfc:4.2.0:4.9.0] [db:gtc-saccharomyces cerevisiae] |
| CONTIG5583 | 990677_f1_2 | 5395 | 19498 | 1209 | 403 | YBR142W | 629 | 1.3(10)-61 | Saccharomyces cerevisiae | [ui:ybr142w] [pn:atp-dependent rna helicase:atp-dependent rna helicase mak5] [gn:mak5:ybr1119] [gtcfc:10.2:10.3] [keggfc:14.2] [sgdfc:4.2.0:4.9.0] [db:gtc-saccharomyces cerevisiae] |
| CONTIG2054 | 24250007_c1_1 | 5396 | 19499 | 336 | 112 | YGL120C | 262 | 1.3(10)-21 | Saccharomyces cerevisiae | [ui:ygl120c] [pn:strong similarity to prp22:putative atp-dependent rna helicase ygl120c] [gtcfc:10.2] [keggfc:14.2] [sgdfc:4.9.0] [db:gtc-saccharomyces cerevisiae] |
| CONTIG902 | 35792152_f1_1 | 5397 | 19500 | 765 | 255 | YGL120C | 1057 | 5.7(10)-107 | Saccharomyces cerevisiae | [ui:gyl120c] [pn:strong similarity |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x13229.y | 6134452_c1_1 | 5398 | 19501 | 513 | 171 | YGL120C | 537 | 8.6(10)-52 | Saccharomyces cerevisiae | [ui:ygl120c] [pn:strong similarity to prp22p;putative atp-dependent rna helicase ygl120c] [gtcfc:10.2] [keggfc:14.2] [sgdfc:4.9.0] [db:gtc-saccharomyces cerevisiae] |
| CONTIG5788 | 23538311_c3_27 | 5399 | 19502 | 1407 | 469 | YHR086W | 285 | 1.0(10)-43 | Saccharomyces cerevisiae | [ui:yhr086w] [pn:meiotic recombination protein;nam8 protein] [gn:nam8:mre2] [gtcfc:10.2:10.8:12.8] [keggfc:14.2] [sgdfc:3.5.0:3.7.0:4.9.0] [db:gtc-saccharomyces cerevisiae] |
| CONTIG5094 | 19728952_c2_12 | 5400 | 19503 | 1488 | 496 | YKL078W | 1172 | 3.7(10)-119 | Saccharomyces cerevisiae | [ui:ykl078w] [pn:strong similarity to atp-dependent rna helicases;putative atp-dependent rna helicase ykl078w] [gn:ykl408] [gtcfc:10.2] [keggfc:14.2] [sgdfc:4.9.0] [db:gtc-saccharomyces cerevisiae] |
| CONTIG5094 | 16598182_c1_10 | 5401 | 19504 | 1128 | 376 | YKL078W | 560 | 2.7(10)-54 | Saccharomyces cerevisiae | [ui:ykl078w] [pn:strong similarity to atp-dependent rna helicases;putative atp-dependent rna helicase ykl078w] [gn:ykl408] [gtcfc:10.2] [keggfc:14.2] [sgdfc:4.9.0] [db:gtc-saccharomyces cerevisiae] |
| CONTIG1718 | 5116262_f1_1 | 5402 | 19505 | 936 | 312 | YKL012W | 239 | 2.2(10)-19 | Saccharomyces cerevisiae | [ui:ykl012w] [pn:splicing factor;hypothetical 69.1 kd protein in put3-cce1 intergenic region] [gn:prp40:ykl165] [gtcfc:10.2] [keggfc:14.2] [sgdfc:4.9.0] [db:gtc-saccharomyces cerevisiae] |
| CONTIG3526 | 23634591_f2_2 | 5403 | 19506 | 594 | 198 | YKL012W | 132 | 1.3(10)-16 | Saccharomyces cerevisiae | [ui:ykl012w] [pn:splicing factor;hypothetical 69.1 kd protein in put3-cce1 intergenic region] [gn:prp40:ykl165] [gtcfc:10.2] [keggfc:14.2] [sgdfc:4.9.0] [db:gtc-saccharomyces cerevisiae] |
| CONTIG4950 | 10351387_f3_5 | 5404 | 19507 | 864 | 288 | YKR024C | 509 | 1.1(10)-48 | Saccharomyces cerevisiae | [ui:ykr024c] [pn:similarity to pre-mrna processing protein prp5p;hypothetical 83.3 kd protein in ypt52-gcn3 intergenic region] [gtcfc:10.2] [keggfc:14.2] [sgdfc:4.9.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4950 | 31818950_f1_3 | 5405 | 19508 | 240 | 80 | YKR024C | 142 | 8.8(10)-9 | *Saccharomyces cerevisiae* | [ui:ykr024c] [pn:similarity to pre-mrna processing protein prp5p:hypothetical 83.3 kd protein in ypt52-gcn3 intergenic region] [gtcfc:10.2] [keggfc:14.2] [sgdfc:4.9.0] [db:gtc-*saccharomyces cerevisiae*] |
| CONTIG4950 | 11757627_f2_4 | 5406 | 19509 | 681 | 227 | YKR024C | 275 | 4.7(10)-23 | *Saccharomyces cerevisiae* | [ui:ykr024c] [pn:similarity to pre-mrna processing protein prp5p:hypothetical 83.3 kd protein in ypt52-gcn3 intergenic region] [gtcfc:10.2] [keggfc:14.2] [sgdfc:4.9.0] [db:gtc-*saccharomyces cerevisiae*] |
| CONTIG5796 | 33992218_c3_20 | 5407 | 19510 | 462 | 154 | YKR024C | 355 | 1.1(10)-31 | *Saccharomyces cerevisiae* | [ui:ykr024c] [pn:similarity to pre-mrna processing protein prp5p:hypothetical 83.3 kd protein in ypt52-gcn3 intergenic region] [gtcfc:10.2] [keggfc:14.2] [sgdfc:4.9.0] [db:gtc-*saccharomyces cerevisiae*] |
| CONTIG421 | 2844376_f1_1 | 5408 | 19511 | 819 | 273 | YNL286W | 203 | 1.8(10)-16 | *Saccharomyces cerevisiae* | [ui:ynl286w] [pn:cold sensitive u2 snrna suppressor:hypothetical 32.3 kd protein in sec21-mrp110 intergenic region] [gn:cus2:n0549] [gtcfc:10.2] [keggfc:14.2] [sgdfc:4.9.0] [db:gtc-*saccharomyces cerevisiae*] |
| CONTIG5467 | 94017_f1_3 | 5409 | 19512 | 276 | 92 | YOR159C | 204 | 1.3(10)-16 | *Saccharomyces cerevisiae* | [ui:yor159c] [pn:strong similarity to human small nuclear ribonucleoprotein e] [gn:sme1] [gtcfc:10.2:10.9] [keggfc:14.2] [sgdfc:4.9.0:4.10.0] [db:gtc-*saccharomyces cerevisiae*] |
| CONTIG5618 | 24038438_c1_18 | 5410 | 19513 | 1905 | 635 | YOR204W | 1703 | 2.1(10)-175 | *Saccharomyces cerevisiae* | [ui:yor204w] [pn:atp-dependent rna helicase:putative atp-dependent rna helicase ded1] [gn:ded1:spp81] [gtcfc:10.2:10.7] [keggfc:14.2] [sgdfc:4.9.0:5.2.0:9.2.0] [db:gtc-*saccharomyces cerevisiae*] |
| CONTIG1254 | 13085062_c2_2 | 5411 | 19514 | 1206 | 402 | YPL060W | 517 | 1.5(10)-54 | *Saccharomyces cerevisiae* | [ui:ypl060w] [pn:strong similarity to mrs2p] [gtcfc:10.2] [keggfc:14.2] [sgdfc:4.9.0] [db:gtc-*saccharomyces cerevisiae*] |
| CONTIG5566 | 34258256_c1_19 | 5412 | 19515 | 393 | 131 | YDR045C | 464 | 4.0(10)-44 | *Saccharomyces cerevisiae* | [ui:ydr045c] [pn:strong similarity to s. *acidocaldarius* transcription elongation factor tfs] [gtcfc:14.2] [keggfc:14.2] [sgdfc:4.8.1] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4966 | 22070192_c1_7 | 5413 | 19516 | 1185 | 395 | YDR145W | 494 | 2.7(10)-47 | Saccharomyces cerevisiae | [ui:ydr145w] [pn:tfiid subunit-tbp-associated factor] [gn:taf61] [gtcfc:10.2] [keggfc:14.2] [sgdfc:4.8.1] [dbgtc-saccharomyces cerevisiae] |
| CONTIG5705 | 9978402_c1_14 | 5414 | 19517 | 1551 | 517 | YDR145W | 338 | 2.2(10)-30 | Saccharomyces cerevisiae | [ui:ydr145w] [pn:tfiid subunit-tbp-associated factor] [gn:taf61] [gtcfc:10.2] [keggfc:14.2] [sgdfc:4.8.1] [dbgtc-saccharomyces cerevisiae] |
| CONTIG2805 | 23631531_c2_6 | 5415 | 19518 | 726 | 242 | YDR167W | 419 | 2.3(10)-39 | Saccharomyces cerevisiae | [ui:ydr167w] [pn:tfiid subunit-tbp-associated factor, 23 kd] [gn:taf23] [gtcfc:10.2] [keggfc:14.2] [sgdfc:4.8.1] [dbgtc-saccharomyces cerevisiae] |
| CONTIG1627 | 4096062_c3_4 | 5416 | 19519 | 501 | 167 | YGL244W | 197 | 4.5(10)-15 | Saccharomyces cerevisiae | [ui:ygl244w] [pn:involved in tata site selection by tbp:hypothetical 54.6 kd protein in pde1-cse1 intergenic region] [gn:rtf1:hra458] [gtcfc:10.2] [keggfc:14.2] [sgdfc:4.8.1] [dbgtc-saccharomyces cerevisiae] |
| CONTIG3430 | 25478412_c2_4 | 5417 | 19520 | 1281 | 427 | YGL244W | 250 | 4.5(10)-26 | Saccharomyces cerevisiae | [ui:ygl244w] [pn:involved in tata site selection by tbp:hypothetical 54.6 kd protein in pde1-cse1 intergenic region] [gn:rtf1:hra458] [gtcfc:10.2] [keggfc:14.2] [sgdfc:4.8.1] [dbgtc-saccharomyces cerevisiae] |
| CONTIG4359 | 29428312_f2_4 | 5418 | 19521 | 1005 | 335 | YML015C | 128 | 4.2(10)-11 | Saccharomyces cerevisiae | [ui:yml015c] [pn:tfiid subunit-tbp-associated factor, 40 kd] [gn:taf40] [gtcfc:10.2] [keggfc:14.2] [sgdfc:4.8.1] [dbgtc-saccharomyces cerevisiae] |
| CONTIG3736 | 4062655_f2_3 | 5419 | 19522 | 1320 | 440 | YMR227C | 99 | 0.07199 | Saccharomyces cerevisiae | [ui:ymr227c] [pn:tfiid subunit-tbp-associated factor, 67 kd] [gn:taf67] [gtcfc:10.2] [keggfc:14.2] [sgdfc:4.8.1] [dbgtc-saccharomyces cerevisiae] |
| CONTIG5817 | 9929701_c2_50 | 5420 | 19523 | 1248 | 416 | YMR227C | 91 | 0.00018 | Saccharomyces cerevisiae | [ui:ymr227c] [pn:tfiid subunit-tbp-associated factor, 67 kd] [gn:taf67] [gtcfc:10.2] [keggfc:14.2] [sgdfc:4.8.1] [dbgtc-saccharomyces cerevisiae] |
| CONTIG5817 | 24314753_c3_58 | 5421 | 19524 | 201 | 67 | YMR227C | 106 | 4.7(10)-5 | Saccharomyces cerevisiae | [ui:ymr227c] [pn:tfiid subunit-tbp-associated factor, 67 kd] [gn:taf67] [gtcfc:10.2] [keggfc:14.2] [sgdfc:4.8.1] [dbgtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3717 | 1257677_f1_2 | 5422 | 19525 | 339 | 113 | YPL046C | 159 | 8.4(10)-12 | Saccharomyces cerevisiae | [ui:ypl046c] [pn:strong similarity to human dna-directed rna polymerase ii elongation factor siii p15 subunit] [gtcfc:10.2] [keggfc:14.2] [sgdfc:4.8.1] [db:gtc-saccharomyces cerevisiae] |
| CONTIG4645 | 5079530_c3_8 | 5423 | 19526 | 1356 | 452 | YAR003W | 522 | 6.0(10)-80 | Saccharomyces cerevisiae | [ui:yar003w] [pn:similarity to human rb protein binding protein:hypothetical trp-asp repeats containing protein in tfc3-rfa1 intergenic region] [gn:fun16] [gtcfc:10.2:12.8] [keggfc:14.2] [sgdfc:3.8.0:4.8.2] [db:gtc-saccharomyces cerev |
| CONTIG3762 | 241637_f3_3 | 5424 | 19527 | 1026 | 342 | YBL066C | 141 | 1.3(10)-9 | Saccharomyces cerevisiae | [ui:ybl066c] [pn:putative transcription factor;putative 118.2 kd transcriptional regulatory protein in ubp13-kip1 intergenic region] [gn:sef1:ybl0501:ybl0526] [gtcfc:10.2:12.15] [keggfc:14.2] [sgdfc:3.4.0:4.8.2] [db:gtc-saccharomyces |
| CONTIG4782 | 35392050_c3_12 | 5425 | 19528 | 1626 | 542 | YBL066C | 652 | 5.2(10)-90 | Saccharomyces cerevisiae | [ui:ybl066c] [pn:putative transcription factor;putative 118.2 kd transcriptional regulatory protein in ubp13-kip1 intergenic region] [gn:sef1:ybl0501:ybl0526] [gtcfc:10.2:12.15] [keggfc:14.2] [sgdfc:3.4.0:4.8.2] [db:gtc-saccharomyces |
| b9x11s19.x | 21517807_c2_2 | 5426 | 19529 | 531 | 177 | YBL066C | 481 | 7.7(10)-45 | Saccharomyces cerevisiae | [ui:ybl066c] [pn:putative transcription factor;putative 118.2 kd transcriptional regulatory protein in ubp13-kip1 intergenic region] [gn:sef1:ybl0501:ybl0526] [gtcfc:10.2:12.15] [keggfc:14.2] [sgdfc:3.4.0:4.8.2] [db:gtc-saccharomyces |
| CONTIG5117 | 24015900_c1_7 | 5427 | 19530 | 2202 | 734 | YBL052C | 877 | 6.9(10)-88 | Saccharomyces cerevisiae | [ui:ybl052c] [pn:silencing protein;hypothetical 97.6 kd protein in ptc3-sec17 intergenic region] [gn:sas3:ybl0515:ybl0507] [gtcfc:10.2:12.9] [keggfc:14.2] [sgdfc:3.3.0:4.8.2] [db:gtc-saccharomyces cerevisiae] |
| CONTIG5690 | 5313390_c2_22 | 5428 | 19531 | 2916 | 972 | YBR033W | 99 | 0.25 | Saccharomyces cerevisiae | [ui:ybr033w] [pn:weak similarity to transcription factors;putative 103.4 kd transcriptional regulatory protein in rpl2-odp1 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5253 | 23645200_f1_1 | 5429 | 19532 | 948 | 316 | YBR061C | 929 | 2.1(10)-93 | Saccharomyces cerevisiae | region] [gn:ybr0318] [gtcfc:10.2] [keggfc:14.2] [sgdfc:4.8.2] [db:gtc-saccharomyces cerevisiae] [ui:ybr061c] [pn:similarity to e. coli ftsj protein:hypothetical 34.7 kd protein in ore2-tip1 intergenic region] [gn:ybr0527] [gtcfc:10.2] [keggfc:14.2] [sgdfc:4.8.2] [db:gtc-saccharomyces cerevisiae] |
| CONTIG4558 | 34239382_f3_7 | 5430 | 19533 | 447 | 149 | YBR215W | 154 | 3.5(10)-10 | Saccharomyces cerevisiae | [ui:ybr215w] [pn:cell cycle regulatory protein:histone promoter control 2 protein] [gn:hpe2:ybr1503] [gtcfc:10.2:12.8] [keggfc:14.2] [sgdfc:3.8.0:4.8.2] [db:gtc-saccharomyces cerevisiae] |
| CONTIG4332 | 30251343_c1_8 | 5431 | 19534 | 1452 | 484 | YBR245C | 1761 | 1.5(10)-181 | Saccharomyces cerevisiae | [ui:ybr245c] [pn:strong similarity to snf2/swi2 dna binding regulatory protein:hypothetical 132.7 kd helicase in alg7-enp1 intergenic region] [gn:ybr1633] [gtcfc:10.2] [keggfc:14.2] [sgdfc:4.8.2] [db:gtc-saccharomyces cerevisiae] |
| CONTIG4332 | 21642001_c1_7 | 5432 | 19535 | 330 | 110 | YBR245C | 146 | 5.7(10)-9 | Saccharomyces cerevisiae | [ui:ybr245c] [pn:strong similarity to snf2/swi2 dna binding regulatory protein:hypothetical 132.7 kd helicase in alg7-enp1 intergenic region] [gn:ybr1633] [gtcfc:10.2] [keggfc:14.2] [sgdfc:4.8.2] [db:gtc-saccharomyces cerevisiae] |
| CONTIG4551 | 26384826_f2_2 | 5433 | 19536 | 858 | 286 | YBR245C | 490 | 1.0(10)-45 | Saccharomyces cerevisiae | [ui:ybr245c] [pn:strong similarity to snf2/swi2 dna binding regulatory protein:hypothetical 132.7 kd helicase in alg7-enp1 intergenic region] [gn:ybr1633] [gtcfc:10.2] [keggfc:14.2] [sgdfc:4.8.2] [db:gtc-saccharomyces cerevisiae] |
| CONTIG5642 | 10188800_c2_19 | 5434 | 19537 | 669 | 223 | YCR020C | 185 | 2.1(10)-21 | Saccharomyces cerevisiae | [ui:ycr020c] [pn:similarity to regulatory protein:pet18 protein] [gn:pet18:hii2:ycr20c] [gtcfc:10.2] [keggfc:14.2] [sgdfc:4.8.2] [db:gtc-saccharomyces cerevisiae] |
| CONTIG2578 | 10657875_c2_5 | 5435 | 19538 | 1395 | 465 | YDL153C | 381 | 5.7(10)-64 | Saccharomyces cerevisiae | [ui:ydl153c] [pn:involved in silencing] [gn:sas10] [gtcfc:10.2] [keggfc:14.2] [sgdfc:4.8.2] [db:gtc-saccharomyces cerevisiae] |
| CONTIG4067 | 26210886_f3_4 | 5436 | 19539 | 963 | 321 | YDR017C | 430 | 6.4(10)-51 | Saccharomyces cerevisiae | [ui:ydr017c] [pn:potential transcription factor of the bzip type] [gn:kcs1] [gtcfc:10.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5453 | 4329067_c2_23 | 5437 | 19540 | 1476 | 492 | YDR026C | 273 | 1.0(10)-25 | Saccharomyces cerevisiae | [keggfc:14.2] [sgdfc:4.8.2] [db:gtc-saccharomyces cerevisiae] [ui:ydr026c] [pn:strong similarity to dna-binding protein reb1p] [gtcfc:10.2] [keggfc:14.2] [sgdfc:4.8.2] [db:gtc-saccharomyces cerevisiae] |
| CONTIG2433 | 21972625_c3_4 | 5438 | 19541 | 705 | 235 | YDR334W | 627 | 4.2(10)-60 | Saccharomyces cerevisiae | [ui:ydr334w] [pn:similarity to nuclear sth1p, snf2p and related proteins] [gtcfc:10.2] [keggfc:14.2] [sgdfc:4.8.2] [db:gtc-saccharomyces cerevisiae] |
| CONTIG4520 | 1458582_c3_7 | 5439 | 19542 | 2697 | 899 | YDR334W | 1462 | 1.3(10)-178 | Saccharomyces cerevisiae | [ui:ydr334w] [pn:similarity to nuclear sth1p, snf2p and related proteins] [gtcfc:10.2] [keggfc:14.2] [sgdfc:4.8.2] [db:gtc-saccharomyces cerevisiae] |
| CONTIG5708 | 4787512_c2_24 | 5440 | 19543 | 3969 | 1323 | YDR464W | 122 | 0.0023 | Saccharomyces cerevisiae | [ui:ydr464w] [pn:negative regulator of prp3 and prp4 gene expression:protein] [gn:spp41] [gtcfc:10.2] [keggfc:14.2] [sgdfc:4.8.2] [db:gtc-saccharomyces cerevisiae] |
| CONTIG3037 | 547083_f2_2 | 5441 | 19544 | 1215 | 405 | YEL056W | 473 | 2.7(10)-65 | Saccharomyces cerevisiae | [ui:yel056w] [pn:subunit of the major yeast histone acetyltransferase:hypothetical trp-asp repeats containing protein in pcm1-rpl15b intergenic region] [gn:hat2] [gtcfc:10.2:10.7] [keggfc:14.2] [sgdfc:4.8.2:6.3.0:9.2.0] [db:gtc-saccha |
| CONTIG5752 | 13751312_f2_9 | 5442 | 19545 | 1497 | 499 | YEL056W | 494 | 2.7(10)-47 | Saccharomyces cerevisiae | [ui:yel056w] [pn:subunit of the major yeast histone acetyltransferase:hypothetical trp-asp repeats containing protein in pcm1-rpl15b intergenic region] [gn:hat2] [gtcfc:10.2:10.7] [keggfc:14.2] [sgdfc:4.8.2:6.3.0:9.2.0] [db:gtc-saccha |
| CONTIG5770 | 14459375_f3_15 | 5443 | 19546 | 1278 | 426 | YER027C | 472 | 7.7(10)-78 | Saccharomyces cerevisiae | [ui:yer027c] [pn:glucose repression protein:glucose repression protein gal83spm1 protein] [gn:gal83spm1] [gtcfc:10.2:12.13] [keggfc:14.2] [sgdfc:15.2:4.8.2] [db:gtc-saccharomyces cerevisiae] |
| CONTIG1916 | 24006261_f1_1 | 5444 | 19547 | 1332 | 444 | YER164W | 1651 | 6.5(10)-170 | Saccharomyces cerevisiae | [ui:yer164w] [pn:transcriptional regulator:hypothetical 168.2 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG241 | 1204413_c3_2 | 5445 | 19548 | 642 | 214 | YER164W | 803 | 5.5(10)-79 | Saccharomyces cerevisiae | protein in rad4-pab1 intergenic region] [gn:chd1:sygp-orf4] [gtcfc:10.2] [keggfc:14.2] [sgdfc:4.8.2] [dbgtc-saccharomyces cerevisiae] [ui:yer164w] [pn:transcriptional regulator:hypothetical 168.2 kd protein in rad4-pab1 intergenic region] [gn:chd1:sygp-orf4] [gtcfc:10.2] [keggfc:14.2] [sgdfc:4.8.2] [dbgtc-saccharomyces cerevisiae] |
| CONTIG3287 | 31942_c3_7 | 5446 | 19549 | 1254 | 418 | YER164W | 365 | 3.6(10)-56 | Saccharomyces cerevisiae | [ui:yer164w] [pn:transcriptional regulator:hypothetical 168.2 kd protein in rad4-pab1 intergenic region] [gn:chd1:sygp-orf4] [gtcfc:10.2] [keggfc:14.2] [sgdfc:4.8.2] [dbgtc-saccharomyces cerevisiae] |
| CONTIG3940 | 19571965_c3_15 | 5447 | 19550 | 1053 | 351 | YER169W | 336 | 1.5(10)-29 | Saccharomyces cerevisiae | [ui:yer169w] [pn:similarity to human retinoblastoma binding protein 2:putative 90.2 kd zinc finger protein in cca1-adk2 intergenic region] [gtcfc:10.2] [keggfc:14.2] [sgdfc:4.8.2] [dbgtc-saccharomyces cerevisiae] |
| CONTIG2457 | 24016507_f3_3 | 5448 | 19551 | 243 | 81 | YGL221C | 142 | 1.5(10)-9 | Saccharomyces cerevisiae | [ui:ygl221c] [pn:ngg1p-interacting factor 3:hypothetical 31.9 kd protein in gog5-clg1 intergenic region] [gn:nif3] [gtcfc:10.2] [keggfc:14.2] [sgdfc:4.8.2] [dbgtc-saccharomyces cerevisiae] |
| CONTIG3428 | 24016507_c1_3 | 5449 | 19552 | 222 | 74 | YGL221C | 139 | 3.2(10)-9 | Saccharomyces cerevisiae | [ui:ygl221c] [pn:ngg1p-interacting factor 3:hypothetical 31.9 kd protein in gog5-clg1 intergenic region] [gn:nif3] [gtcfc:10.2] [keggfc:14.2] [sgdfc:4.8.2] [dbgtc-saccharomyces cerevisiae] |
| b1x12535.y | 658431_c3_5 | 5450 | 19553 | 306 | 102 | YGL221C | 178 | 1.1(10)-13 | Saccharomyces cerevisiae | [ui:ygl221c] [pn:ngg1p-interacting factor 3:hypothetical 31.9 kd protein in gog5-clg1 intergenic region] [gn:nif3] [gtcfc:10.2] [keggfc:14.2] [sgdfc:4.8.2] [dbgtc-saccharomyces cerevisiae] |
| b3x19292.x | 19625262_c1_3 | 5451 | 19554 | 699 | 233 | YGL181W | 404 | 9.1(10)-38 | Saccharomyces cerevisiae | [ui:ygl181w] [pn:transcription factor of the gcs1p/glo3p/sps18p family:gts1 protein:lsr1 protein] [gn:gts1:lsr1] [gtcfc:10.2:12.8.13.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5777 | 4694055_c3_26 | 5452 | 19555 | 4185 | 1395 | YGL150C | 1758 | 1.3(10)-261 | *Saccharomyces cerevisiae* | [keggfc:14.2] [sgdfc:3.2.0:3.8.0:4.8.2:11.1.0] [db:gtc-*saccharomyces cerevisiae*] [ui:ygl150c] [pn:similarity to snf2p and human snf2alpha:hypothetical 171.5 kd helicase in lys5-aro2 intergenic region] [gn:g1880] [gtcfc:10.2] [keggfc:14.2] [sgdfc:4.8.2] [db:gtc-*saccharomyces cerevisiae*] |
| CONTIG3283 | 1954656_c3_3 | 5453 | 19556 | 1707 | 569 | YGL073W | 415 | 2.5(10)-52 | *Saccharomyces cerevisiae* | [ui:ygl073w] [pn:heat shock factor protein:hsf:heat shock transcription factor:hsf1] [gn:hsf1] [keggfc:12.7:10.2:13.2] [gtcfc:14.2] [sgdfc:4.8.2:11.1.0] [db:gtc-*saccharomyces cerevisiae*] |
| CONTIG4623 | 24350010_c2_9 | 5454 | 19557 | 1491 | 497 | YGL073W | 93 | 0.46 | *Saccharomyces cerevisiae* | [ui:ygl073w] [pn:heat shock factor protein:hsf:heat shock transcription factor:hsf1] [gn:hsf1] [keggfc:12.7:10.2:13.2] [gtcfc:14.2] [sgdfc:4.8.2:11.1.0] [db:gtc-*saccharomyces cerevisiae*] |
| CONTIG489 | 787510_c3_3 | 5455 | 19558 | 624 | 208 | YGR097W | 90 | 0.37 | *Saccharomyces cerevisiae* | [ui:ygr097w] [pn:involved in skn7p-dependent transcription:protein] [gn:ask10] [gtcfc:10.2] [keggfc:14.2] [sgdfc:4.8.2] [db:gtc-*saccharomyces cerevisiae*] |
| CONTIG4474 | 21698426_c3_8 | 5456 | 19559 | 1149 | 383 | YGR100W | 586 | 2.2(10)-56 | *Saccharomyces cerevisiae* | [ui:ygr100w] [pn:mac1p interacting protein:mic1 protein] [gn:mic1:g5717] [gtcfc:10.2:13.2] [keggfc:14.2] [sgdfc:4.8.2:11.1.0] [db:gtc-*saccharomyces cerevisiae*] |
| CONTIG4474 | 11223943_c2_6 | 5457 | 19560 | 1083 | 361 | YGR100W | 1222 | 1.8(10)-124 | *Saccharomyces cerevisiae* | [ui:ygr100w] [pn:mac1p interacting protein:mic1 protein] [gn:mic1:g5717] [gtcfc:10.2:13.2] [keggfc:14.2] [sgdfc:4.8.2:11.1.0] [db:gtc-*saccharomyces cerevisiae*] |
| b9x13m30.y | 4407157_f2_1 | 5458 | 19561 | 297 | 99 | YGR100W | 110 | 3.2(10)-5 | *Saccharomyces cerevisiae* | [ui:ygr100w] [pn:mac1p interacting protein:mic1 protein] [gn:mic1:g5717] [gtcfc:10.2:13.2] [keggfc:14.2] [sgdfc:4.8.2:11.1.0] [db:gtc-*saccharomyces cerevisiae*] |
| CONTIG4300 | 6145055_c3_12 | 5459 | 19562 | 1908 | 636 | YHR178W | 836 | 3.6(10)-88 | *Saccharomyces cerevisiae* | [ui:yhr178w] [pn:sin3 binding protein:putative 83.5 kd transcriptional regulatory protein in eno2-oye2 intergenic region] [gn:stb5] [gtcfc:10.2] [keggfc:14.2] [sgdfc:4.8.2] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4379 | 9845317_f1_1 | 5460 | 19563 | 2016 | 672 | YHR178W | 91 | 0.65 | Saccharomyces cerevisiae | saccharomyces cerevisiae] [ui:yhr178w] [pn:sin3 binding protein:putative 83.5 kd transcriptional regulatory protein in eno2-oye2 intergenic region] [gn:stb5] [gtcfc:10.2] [keggfc:14.2] [sgdfc:4.8.2] [db:gtc-saccharomyces cerevisiae] |
| CONTIG5812 | 13759657_f3_18 | 5461 | 19564 | 711 | 237 | YHR178W | 103 | 0.0071 | Saccharomyces cerevisiae | [ui:yhr178w] [sin3 binding protein:putative 83.5 kd transcriptional regulatory protein in eno2-oye2 intergenic region] [gn:stb5] [gtcfc:10.2] [keggfc:14.2] [sgdfc:4.8.2] [db:gtc-saccharomyces cerevisiae] |
| CONTIG1667 | 34385005_f2_1 | 5462 | 19565 | 1227 | 409 | YIL130W | 99 | 0.063 | Saccharomyces cerevisiae | [ui:yil130w] [pn:similarity to put3p and to hypothetical protein yjl206c:putative 108.8 kd transcriptional regulatory protein in fkh1-sth1 intergenic region] [gtcfc:10.2] [keggfc:14.2] [sgdfc:4.8.2] [db:gtc-saccharomyces cerevisiae] |
| CONTIG2486 | 190937_f1_1 | 5463 | 19566 | 588 | 196 | YIL130W | 99 | 0.016 | Saccharomyces cerevisiae | [ui:yil130w] [pn:similarity to put3p and to hypothetical protein yjl206c:putative 108.8 kd transcriptional regulatory protein in fkh1-sth1 intergenic region] [gtcfc:10.2] [keggfc:14.2] [sgdfc:4.8.2] [db:gtc-saccharomyces cerevisiae] |
| CONTIG3929 | 26615877_c1_1 | 5464 | 19567 | 2190 | 730 | YIL130W | 171 | 3.7(10)-9 | Saccharomyces cerevisiae | [ui:yil130w] [pn:similarity to put3p and to hypothetical protein yjl206c:putative 108.8 kd transcriptional regulatory protein in fkh1-sth1 intergenic region] [gtcfc:10.2] [keggfc:14.2] [sgdfc:4.8.2] [db:gtc-saccharomyces cerevisiae] |
| CONTIG4508 | 11718875_c2_3 | 5465 | 19568 | 1605 | 535 | YIL130W | 130 | 6.0(10)-5 | Saccharomyces cerevisiae | [ui:yil130w] [pn:similarity to put3p and to hypothetical protein yjl206c:putative 108.8 kd transcriptional regulatory protein in fkh1-sth1 intergenic region] [gtcfc:10.2] [keggfc:14.2] [sgdfc:4.8.2] [db:gtc-saccharomyces cerevisiae] |
| CONTIG4575 | 10172526_c1_7 | 5466 | 19569 | 792 | 264 | YIL130W | 205 | 2.2(10)-15 | Saccharomyces cerevisiae | [ui:yil130w] [pn:similarity to put3p and to hypothetical protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x17449.y | 244112675_c3_4 | 5467 | 19570 | 327 | 109 | YIL130W | 132 | 1.3(10)-7 | Saccharomyces cerevisiae | [ui:yil130w] [pn:similarity to put3p and to hypothetical protein yjl206c:putative 108.8 kd transcriptional regulatory protein in fkh1-sth1 intergenic region] [gtcfc:10.2] [keggfc:14.2] [sgdfc:4.8.2] [db:gtc-saccharomyces cerevisiae] |
| CONTIG4784 | 32229813_f2_6 | 5468 | 19571 | 792 | 264 | YIL050W | 223 | 9.3(10)-34 | Saccharomyces cerevisiae | [ui:yil050w] [pn:similarity to n. crassa regulatory protein preg:+hypothetical 32.0 kd protein in gpp1-syg1 intergenic region] [gtcfc:10.2] [keggfc:14.2] [sgdfc:4.8.2] [db:gtc-saccharomyces cerevisiae] |
| CONTIG2883 | 10579552_f3_4 | 5469 | 19572 | 321 | 107 | YJL115W | 277 | 2.6(10)-24 | Saccharomyces cerevisiae | [ui:yjl115w] [pn:anti-silencing protein:anti-silencing protein 1] [gn:asf1:j0755] [gtcfc:10.2] [keggfc:14.2] [sgdfc:4.8.2] [db:gtc-saccharomyces cerevisiae] |
| CONTIG4945 | 25665938_f2_1 | 5470 | 19573 | 1578 | 526 | YIL115W | 113 | 0.00059 | Saccharomyces cerevisiae | [ui:yjl115w] [pn:anti-silencing protein:anti-silencing protein 1] [gn:asf1:j0755] [gtcfc:10.2] [keggfc:14.2] [sgdfc:4.8.2] [db:gtc-saccharomyces cerevisiae] |
| CONTIG1122 | 7320285_c2_2 | 5471 | 19574 | 723 | 241 | YJR032W | 547 | 6.5(10)-53 | Saccharomyces cerevisiae | [ui:yjr032w] [pn:member of the cyclophilin family:peptidyl-prolyl cis-trans isomerase cyp7:ppiase:rotamase] [gn:cpr7:j1585] [gtcfc:10.2:10.5:10.7:12.7:12.8] [ec:5.2.1.8] [keggfc:14.1] [sgdfc:3.1.0:4.8.2:6.1.0] [db:gtc-saccharomyces ce] |
| CONTIG5620 | 7893_f1_2 | 5472 | 19575 | 1221 | 407 | YJR032W | 599 | 2.2(10)-72 | Saccharomyces cerevisiae | [ui:yjr032w] [pn:member of the cyclophilin family:peptidyl-prolyl cis-trans isomerase cyp7:ppiase:rotamase] [gn:cpr7:j1585] [gtcfc:10.2:10.5:10.7:12.7:12.8] [ec:5.2.1.8] [keggfc:14.1] [sgdfc:3.1.0:4.8.2:6.1.0] [db:gtc-saccharomyces ce] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3852 | 36382953_f3_1 | 5473 | 19576 | 1524 | 508 | YJR119C | 132 | 2.7(10)-12 | Saccharomyces cerevisiae | [ui:yjr119c] [pn:similarity to human retinoblastoma binding protein 2:hypothetical 85.0 kd protein in nnf1-atp2 intergenic region] [gn:j2035] [sgdfc:4.8.2] [db:gtc-saccharomyces cerevisiae] |
| CONTIG5804 | 20343762_f2_19 | 5474 | 19577 | 393 | 131 | YJR119C | 172 | 5.2(10)-12 | Saccharomyces cerevisiae | [ui:yjr119c] [pn:similarity to human retinoblastoma binding protein 2:hypothetical 85.0 kd protein in nnf1-atp2 intergenic region] [gn:j2035] [sgdfc:4.8.2] [db:gtc-saccharomyces cerevisiae] |
| CONTIG5804 | 20704760_f2_20 | 5475 | 19578 | 1800 | 600 | YJR119C | 806 | 2.2(10)-80 | Saccharomyces cerevisiae | [ui:yjr119c] [pn:similarity to human retinoblastoma binding protein 2:hypothetical 85.0 kd protein in nnf1-atp2 intergenic region] [gn:j2035] [sgdfc:4.8.2] [db:gtc-saccharomyces cerevisiae] |
| CONTIG5322 | 24228466_f2_4 | 5476 | 19579 | 660 | 220 | YKL185W | 295 | 1.8(10)-25 | Saccharomyces cerevisiae | [ui:ykl185w] [pn:negative regulator of ho expression:hypothetical 65.7 kd protein in mtr2-ord1 intergenic region] [gn:ash1] [gtcfc:10.2:12.9] [keggfc:14.2] [gtcfc:3.3.0:4.8.2] [db:gtc-saccharomyces cerevisiae] |
| CONTIG1694 | 33484567_c1_4 | 5477 | 19580 | 984 | 328 | YKL072W | 90 | 0.5 | Saccharomyces cerevisiae | [ui:ykl072w] [pn:sin3 binding protein:hypothetical 88.8 kd protein in lhs1-nup100 intergenic region] [gn:stb6:ykl352] [gtcfc:10.2] [keggfc:14.2] [sgdfc:4.8.2] [db:gtc-saccharomyces cerevisiae] |
| b3x13540.y | 116379_c1_2 | 5478 | 19581 | 444 | 148 | YKL070W | 213 | 1.6(10)-17 | Saccharomyces cerevisiae | [ui:ykl070w] [pn:similarity to b. subtilis transcriptional regulatory protein:hypothetical 19.8 kd protein in lhs1-nup100 intergenic region] [gn:ykl343] [gtcfc:10.2] [keggfc:14.2] [sgdfc:4.8.2] [db:gtc-saccharomyces cerevisiae] |
| CONTIG1623 | 4490650_f2_2 | 5479 | 19582 | 798 | 266 | YKR036C | 129 | 1.5(10)-5 | Saccharomyces cerevisiae | [ui:ykr036c] [pn:ccr4 associated factor:hypothetical trp-asp repeats containing protein in dal80-gap1 intergenic region] [gn:caf4] [gtcfc:10.2] [keggfc:14.2] [sgdfc:4.8.2] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2785 | 1203385_f2_3 | 5480 | 19583 | 648 | 216 | YKR036C | 129 | 6.0(10)-6 | Saccharomyces cerevisiae | [ui:ykr036c][pn:ccr4 associated factor:hypothetical trp-asp repeats containing protein in dal80-gap1 intergenic region] [gn:caf4] [gtcfc:10.2][keggfc:14.2] [sgdfc:4.8.2] [db:gtc-saccharomyces cerevisiae] |
| CONTIG3407 | 35580275_f2_2 | 5481 | 19584 | 312 | 104 | YKR064W | 104 | 0.00012 | Saccharomyces cerevisiae | [ui:ykr064w][pn:weak similarity to transcription factors:putative 101.8 kd transcriptional regulatory protein in las1-ccp1 intergenic region] [gtcfc:10.2] [keggfc:14.2] [sgdfc:4.8.2] [db:gtc-saccharomyces cerevisiae] |
| CONTIG4938 | 25596942_f3_4 | 5482 | 19585 | 528 | 176 | YLR136C | 239 | 2.7(10)-20 | Saccharomyces cerevisiae | [ui:ylr136c][pn:member of the inducible ccch zinc-finger family:zinc finger protein cth2:ytis11 protein] [gn:cth2:tis11:19606] [gtcfc:10.2] [keggfc:14.2] [sgdfc:4.8.2] [db:gtc-saccharomyces cerevisiae] |
| CONTIG4311 | 23681561_f3_5 | 5483 | 19586 | 1224 | 408 | YLR216C | 943 | 7.0(10)-95 | Saccharomyces cerevisiae | [ui:ylr216c][pn:member of the cyclophilin family:peptidyl-prolyl cis-trans isomerase cyp6:ppiase:rotamase] [gn:cpr6:18167] [gtcfc:10.2:10.5:10.7:12.7:14.1] [ec:5.2.1.8] [keggfc:14.1] [sgdfc:4.8.2:6.1.0.9.2.0] [db:gtc-saccharomyces cerevisiae] |
| CONTIG3802 | 266942_c1_8 | 5484 | 19587 | 759 | 253 | YLR228C | 204 | 2.2(10)-15 | Saccharomyces cerevisiae | [ui:ylr228c][pn:strong similarity to ydr213w, weak similarity to lys14p] [gtcfc:10.2] [keggfc:14.2] [sgdfc:4.8.2] [db:gtc-saccharomyces ce |
| CONTIG4763 | 6370753_f2_3 | 5485 | 19588 | 1212 | 404 | YLR228C | 917 | 4.0(10)-92 | Saccharomyces cerevisiae | [ui:ylr228c][pn:strong similarity to ydr213w, weak similarity to lys14p] [gtcfc:10.2] [keggfc:14.2] [sgdfc:4.8.2] [db:gtc-saccharomyces cerevisiae] |
| CONTIG4218 | 21517037_f3_2 | 5486 | 19589 | 1152 | 384 | YML081W | 280 | 3.2(10)-23 | Saccharomyces cerevisiae | [ui:yml081w][pn:strong similarity to zms1 protein] [gtcfc:10.2] [keggfc:14.2] [sgdfc:4.8.2] [db:gtc-saccharomyces cerevisiae] |
| CONTIG4755 | 25978317_f3_2 | 5487 | 19590 | 2022 | 674 | YML081W | 373 | 4.9(10)-31 | Saccharomyces cerevisiae | [ui:yml081w][pn:strong similarity to zms1 protein] [gtcfc:10.2] [keggfc:14.2] [sgdfc:4.8.2] [db:gtc-saccharomyces cerevisiae] |
| CONTIG2923 | 34406717_f3_4 | 5488 | 19591 | 1263 | 421 | YMR019W | 183 | 1.5(10)-19 | Saccharomyces cerevisiae | [ui:ymr019w][pn:sin3 binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4039 | 3164050_c2_7 | 5489 | 19592 | 1110 | 370 | YMR019W | 111 | 0.00359 | Saccharomyces cerevisiae | protein:putative 109.8 kd transcriptional regulatory protein in sok2-fms1 intergenic region] [gn:stb4;ym9711] [gtcfc:10.2] [keggfc:14.2] [sgdfc:4.8.2] [db:gtc-saccharomyces cerevisiae |
| CONTIG4390 | 26378336_c3_10 | 5490 | 19593 | 939 | 313 | YMR019W | 126 | 3.0(10)-5 | Saccharomyces cerevisiae | [ui:ymr019w] [pn:sin3 binding protein:putative 109.8 kd transcriptional regulatory protein in sok2-fms1 intergenic region] [gn:stb4;ym9711] [gtcfc:10.2] [keggfc:14.2] [sgdfc:4.8.2] [db:gtc-saccharomyces cerevisiae |
| CONTIG4765 | 4163211_c3_8 | 5491 | 19594 | 789 | 263 | YMR019W | 194 | 3.3(10)-14 | Saccharomyces cerevisiae | [ui:ymr019w] [pn:sin3 binding protein:putative 109.8 kd transcriptional regulatory protein in sok2-fms1 intergenic region] [gn:stb4;ym9711] [gtcfc:10.2] [keggfc:14.2] [sgdfc:4.8.2] [db:gtc-saccharomyces cerevisiae |
| b9x13233.x | 20806887_c3_1 | 5492 | 19595 | 621 | 207 | YMR053C | 165 | 3.7(10)-11 | Saccharomyces cerevisiae | [ui:ymr053c] [pn:sin3p binding protein:stb2 protein] [gn:stb2;ym9796] [gtcfc:10.2] [keggfc:14.2] [sgdfc:4.8.2] [db:gtc-saccharomyces cerevisiae |
| CONTIG5814 | 34173260_c1_36 | 5493 | 19596 | 1077 | 359 | YMR127C | 524 | 2.3(10)-58 | Saccharomyces cerevisiae | [ui:ymr127c] [pn:involved in silencing at hmr:sas2 protein] [gn:sas2;ym9553] [gtcfc:10.2;12.8;12.9] [keggfc:14.2] [sgdfc:3.3.0;3.8.0;4.8.2] [db:gtc-saccharomyces cerevisiae |
| CONTIG5741 | 10634655_f3_8 | 5494 | 19597 | 768 | 256 | YNL107W | 282 | 7.5(10)-38 | Saccharomyces cerevisiae | [ui:ynl107w] [pn:similarity to human af-9 protein:hypothetical 26.0 kd protein in cyb5-leu4 intergenic region] [gn:n1966] [gtcfc:10.2] [keggfc:14.2] [sgdfc:4.8.2] [db:gtc-saccharomyces cerevisiae |
| CONTIG5142 | 956251_c2_6 | 5495 | 19598 | 357 | 119 | YOL133W | 388 | 4.5(10)-36 | Saccharomyces cerevisiae | [ui:yol133w] [pn:similarity to lotus ring-finger protein] [gtcfc:10.2] [keggfc:14.2] [sgdfc:4.8.2] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3634 | 21678177_c1_7 | 5496 | 19599 | 1020 | 340 | YOL068C | 631 | 5.5(10)-94 | *Saccharomyces cerevisiae* | *saccharomyces cerevisiae* [ui:yol068c] [pn:silencing protein:protein] [gn:hst1] [gtcfc:10.2:12.9] [keggfc:14.2] [sgdfc:3.3:0:4.8.2] [db:gtc-sgdfc:4.8.2] [db:gtc-saccharomyces cerevisiae] |
| CONTIG5551 | 962637_f1_3 | 5497 | 19600 | 1644 | 548 | YOL055C | 462 | 9.0(10)-55 | *Saccharomyces cerevisiae* | *saccharomyces cerevisiae* [ui:yol055c] [pn:weak similarity to bacterial transcription factors] [gtcfc:10.2] [keggfc:14.2] [sgdfc:4.8.2] [db:gtc-saccharomyces cerevisiae] |
| CONTIG4179 | 2775332_f2_1 | 5498 | 19601 | 1467 | 489 | YOR025W | 838 | 9.4(10)-84 | *Saccharomyces cerevisiae* | *saccharomyces cerevisiae* [ui:yor025w] [pn:silencing protein:hst3 protein] [gn:hst3:or26] [gtcfc:10.2] [keggfc:14.2] [sgdfc:4.8.2] [db:gtc-saccharomyces cerevisiae] |
| CONTIG3722 | 14642938_f3_2 | 5499 | 19602 | 1827 | 609 | YOR304W | 1781 | 1.1(10)-183 | *Saccharomyces cerevisiae* | *saccharomyces cerevisiae* [ui:yor304w] [pn:strong similarity to human snf2p homolog] [gtcfc:10.2] [keggfc:14.2] [sgdfc:4.8.2] [db:gtc-saccharomyces cerevisiae] |
| CONTIG4332 | 22285135_c2_10 | 5500 | 19603 | 237 | 79 | YOR304W | 155 | 6.0(10)-10 | *Saccharomyces cerevisiae* | *saccharomyces cerevisiae* [ui:yor304w] [pn:strong similarity to human snf2p homolog] [gtcfc:10.2] [keggfc:14.2] [sgdfc:4.8.2] [db:gtc-saccharomyces cerevisiae] |
| CONTIG5389 | 9960258_c2_17 | 5501 | 19604 | 276 | 92 | YOR304W | 225 | 2.1(10)-17 | *Saccharomyces cerevisiae* | *saccharomyces cerevisiae* [ui:yor304w] [pn:strong similarity to human snf2p homolog] [gtcfc:10.2] [keggfc:14.2] [sgdfc:4.8.2] [db:gtc-saccharomyces cerevisiae] |
| CONTIG5389 | 1302_c2_16 | 5502 | 19605 | 273 | 91 | YOR304W | 142 | 1.5(10)-8 | *Saccharomyces cerevisiae* | *saccharomyces cerevisiae* [ui:yor304w] [pn:strong similarity to human snf2p homolog] [gtcfc:10.2] [keggfc:14.2] [sgdfc:4.8.2] [db:gtc-saccharomyces cerevisiae] |
| CONTIG3787 | 34087807_c2_8 | 5503 | 19606 | 852 | 284 | YPL015C | 663 | 3.2(10)-65 | *Saccharomyces cerevisiae* | *saccharomyces cerevisiae* [ui:ypl015c] [pn:similarity to hst1p and sir2p:hst2 protein] [gn:hst2:lpa2c] [gtcfc:10.2] [keggfc:14.2] [sgdfc:4.8.2] [db:gtc-saccharomyces cerevisiae] |
| CONTIG5531 | 34462782_f3_20 | 5504 | 19607 | 795 | 265 | YPR115W | 118 | 4.2(10)-9 | *Saccharomyces cerevisiae* | *saccharomyces cerevisiae* [ui:ypr115w] [pn:similarity to probable transcription factor ask 10p, and to hypothetical proteins ynl047c and yil105c] [gtcfc:10.2] [keggfc:14.2] [sgdfc:4.8.2] [db:gtc-saccharomyces cerevisiae] |
| CONTIG5531 | 24844186_f2_14 | 5505 | 19608 | 1182 | 394 | YPR115W | 136 | 9.0(10)-6 | *Saccharomyces* | *saccharomyces cerevisiae* [ui:ypr115w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5468 | 3943927_c1_15 | 5506 | 19609 | 1476 | 492 | YAL013W | 159 | 4.2(10)-9 | *Saccharomyces cerevisiae* | probable transcription factor ask 10p, and to hypothetical proteins ynl047c and yil105c [gtcfc:10.2] [keggfc:14.2] [sgdfc:4.8.2] [db:gtc-*saccharomyces cerevisiae*] [ui:yal013w] [pn:regulator of phospholipid metabolism:dep1 protein] [gn:dep1:fun54] [gtcfc:10.2] [keggfc:14.2] [sgdfc:1.6.4:9.2.0] [db:gtc-*saccharomyces cerevisiae*] |
| CONTIG2498 | 3937516_c2_4 | 5507 | 19610 | 852 | 284 | YGL162W | 108 | 0.00046 | *Saccharomyces cerevisiae* | [ui:ygl162w] [pn:hypoxic protein involved in sterol uptake:probable sterol carrier] [gn:sut1:g1828] [gtcfc:10.2] [keggfc:14.2] [sgdfc:1.6.4] [db:gtc-*saccharomyces cerevisiae*] |
| CONTIG5619 | 875463_f2_5 | 5508 | 19611 | 513 | 171 | YIL096W | 220 | 2.8(10)-18 | *Saccharomyces cerevisiae* | [ui:yil096w] [pn:putative regulator of purine and/or pyrimidine biosynthesis:hypothetical 25.4 kd protein in sap185-bck1 intergenic region] [gn:j0904] [gtcfc:10.2] [keggfc:14.2] [sgdfc:1.3.5] [db:gtc-*saccharomyces cerevisiae*] |
| CONTIG5357 | 20895052_c1_14 | 5509 | 19612 | 702 | 234 | YOL110W | 152 | 2.5(10)-10 | *Saccharomyces cerevisiae* | [ui:yol110w] [pn:ras suppressor:ras modification protein sh5] [gn:shr5:hrc237] [gtcfc:10.2:12.13:12.8:13.2] [keggfc:14.2] [sgdfc:1.3.5:1.5.2:3.10.0:10.4.8] [db:gtc-*saccharomyces cerevisiae*] |
| CONTIG1003 | 24251676_c2_1 | 5510 | 19613 | 798 | 266 | YOR101W | 550 | 3.1(10)-53 | *Saccharomyces cerevisiae* | [ui:yor101w] [pn:gtp-binding protein:ras-like protein 1] [gn:ras1:yor3205w] [gtcfc:10.2:11.1:12.13:12.8] [keggfc:13.1] [sgdfc:1.3.5:1.5.2:3.10.0:9.1.0:10.4.4:11.5.0] [db:gtc-*saccharomyces cerevisiae*] |
| CONTIG3766 | 3908311_f1_1 | 5511 | 19614 | 996 | 332 | YOR101W | 221 | 1.1(10)-17 | *Saccharomyces cerevisiae* | [ui:yor101w] [pn:gtp-binding protein:ras-like protein 1] [gn:ras1:yor3205w] [gtcfc:10.2:11.1:12.13:12.8] [keggfc:13.1] [sgdfc:1.3.5:1.5.2:3.10.0:9.1.0:10.4.4:11.5.0] [db:gtc-*saccharomyces cerevisiae*] |
| CONTIG5802 | 4803441_f2_17 | 5512 | 19615 | 567 | 189 | YOR101W | 352 | 3.0(10)-32 | *Saccharomyces* | [ui:yor101w] [pn:gtp-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11m02.x | 14068917_c2_5 | 5513 | | 711 | 237 | YOR101W | 437 | 2.8(10)-41 | Saccharomyces cerevisiae | protein:ras-like protein 1] [gn:ras1;yor3205w] [gtcfc:10.2:11.1:12.13:12.8] [keggfc:13.1] [sgdfc:1.3.5:1.5.2:3.10.0:9.1.0:10.4.4:11.5.0] [db:gtc-saccharomyces cerevisiae] [ui:yor101w] [pn:gtp-binding protein:ras-like protein 1] [gn:ras1;yor3205w] [gtcfc:10.2:11.1:12.13:12.8] [keggfc:13.1] [sgdfc:1.3.5:1.5.2:3.10.0:9.1.0:10.4.4:11.5.0] [db:gtc-saccharomyces cerevisiae] |
| CONTIG1745 | 24001542_c3_6 | 5514 | 19616 | 648 | 216 | YFR004W | 220 | 2.8(10)-18 | Saccharomyces cerevisiae | [ui:yff004w] [pn:strong similarity to s.pombe pad1 protein:protein] [gn:mpr1] [gtcfc:10.2:10.6] [keggfc:14.2] [sgdfc:4.4.0:4.5.0] [db:gtc-saccharomyces cerevisiae] |
| b2x19164.x | 33385_c1_6 | 5515 | 19617 | 783 | 261 | YFR004W | 894 | 1.1(10)-89 | Saccharomyces cerevisiae | [ui:yff004w] [pn:strong similarity to s.pombe pad1 protein:protein] [gn:mpr1] [gtcfc:10.2:10.6] [keggfc:14.2] [sgdfc:4.4.0:4.5.0] [db:gtc-saccharomyces cerevisiae] |
| CONTIG5668 | 163188_f1_1 | 5516 | 19618 | 1893 | 631 | YBR238C | 438 | 2.0(10)-39 | Saccharomyces cerevisiae | [ui:ybr238c] [pn:strong similarity to general chromatin factor spt16p:hypothetical 83.7 kd protein in prp5-alg7 intergenic region] [gn:ybr1608] [gtcfc:10.2:12.8] [keggfc:14.2] [sgdfc:3.8.0:4.8.3] [db:gtc-saccharomyces cerevisiae] |
| CONTIG4750 | 15134650_c2_7 | 5517 | 19619 | 2280 | 760 | YBR212W | 470 | 4.2(10)-79 | Saccharomyces cerevisiae | [ui:ybr212w] [pn:glucose-repressible rna-binding protein:negative growth regulatory protein ngr1:rna-binding protein rbp1] [gn:ngr1;rbp1;ybr1459] [gtcfc:10.2:12.8] [keggfc:14.2] [sgdfc:3.1.0:4.12.0] [db:gtc-saccharomyces cerevisiae] |
| CONTIG2397 | 9939050_c2_3 | 5518 | 19620 | 894 | 298 | YBR233W | 195 | 5.7(10)-15 | Saccharomyces cerevisiae | [ui:ybr233w] [pn:similarity to human hnrnp-e1 protein:hypothetical 45.8 kd protein in pes60-abd1 intergenic region] [gn:ybr1531] [gtcfc:10.2] [keggfc:14.2] [sgdfc:4.12.0] [db:gtc-saccharomyces cerevisiae] |
| CONTIG5481 | 22479187_c1_12 | 5519 | 19621 | 966 | 322 | YBR233W | 347 | 1.0(10)-31 | Saccharomyces cerevisiae | [ui:ybr233w] [pn:similarity to human hnrnp-e1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4607 | 10737577_f3_6 | 5520 | 19623 | 435 | 145 | YCL033C | 310 | 8.4(10)-28 | Saccharomyces cerevisiae | protein:hypothetical 45.8 kd protein in pes60-abd1 intergenic region [gn:ybr1531] [gtcfc:10.2] [keggfc:14.2] [sgdfc:4.12.0] [db:gtc-saccharomyces cerevisiae] [ui:ycl033c] [pn:similarity to m.capricolum transcription repressor:hypothetical 19.3 kd protein in ste50 5"region [gn:ycl33c] [gtcfc:10.2] [keggfc:14.2] [sgdfc:4.12.0] [db:gtc-saccharomyces cerevisiae] |
| CONTIG2363 | 13710252_c3_7 | 5521 | 19624 | 477 | 159 | YCR004C | 504 | 2.2(10)-48 | Saccharomyces cerevisiae | [ui:ycr004c] [pn:strong similarity to s. pombe protein obr1·hypothetical 26.4 kd protein in cdc10-cit2 intergenic region] [gn:ycp4:ycr4:cycr042] [gtcfc:10.2] [keggfc:14.2] [sgdfc:4.12.0] [db:gtc-saccharomyces cerevisiae] |
| CONTIG434 | 22712776_c2_2 | 5522 | 19625 | 813 | 271 | YCR004C | 598 | 2.5(10)-58 | Saccharomyces cerevisiae | [ui:ycr004c] [pn:strong similarity to s. pombe protein obr1·hypothetical 26.4 kd protein in cdc10-cit2 intergenic region] [gn:ycp4:ycr4:cycr042] [gtcfc:10.2] [keggfc:14.2] [sgdfc:4.12.0] [db:gtc-saccharomyces cerevisiae] |
| CONTIG5438 | 21956281_c2_18 | 5523 | 19626 | 681 | 227 | YCR004C | 610 | 1.3(10)-59 | Saccharomyces cerevisiae | [ui:ycr004c] [pn:strong similarity to s. pombe protein obr1·hypothetical 26.4 kd protein in cdc10-cit2 intergenic region] [gn:ycp4:ycr4:cycr042] [gtcfc:10.2] [keggfc:14.2] [sgdfc:4.12.0] [db:gtc-saccharomyces cerevisiae] |
| CONTIG5438 | 20509375_f3_10 | 5524 | 19627 | 768 | 256 | YCR004C | 566 | 6.2(10)-55 | Saccharomyces cerevisiae | [ui:ycr004c] [pn:strong similarity to s. pombe protein obr1·hypothetical 26.4 kd protein in cdc10-cit2 intergenic region] [gn:ycp4:ycr4:cycr042] [gtcfc:10.2] [keggfc:14.2] [sgdfc:4.12.0] [db:gtc-saccharomyces cerevisiae] |
| CONTIG5343 | 6735005_c2_16 | 5525 | 19628 | 420 | 140 | YCR087C-A | 243 | 1.1(10)-20 | Saccharomyces cerevisiae | [ui:ycr087c-a] [pn:nucleic acid-binding protein:hypothetical 17.7 kd protein in abp1 5"region [gn:ycrx16c] [gtcfc:10.2] [keggfc:14.2] [sgdfc:4.12.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4385 | 24617258_f1_1 | 5526 | 19629 | 843 | 281 | YDL051W | 167 | 1.7(10)-12 | Saccharomyces cerevisiae | [db:gtc-saccharomyces cerevisiae] [ui:ydl051w] [pn:rna binding protein:1a protein homolog] [gn:lah1:lhp1:yla1] [keggfc:14.2] [sgdfc:4.12.0] |
| CONTIG3713 | 22307888_c3_10 | 5527 | 19630 | 1146 | 382 | YDL031W | 923 | 9.3(10)-93 | Saccharomyces cerevisiae | [db:gtc-saccharomyces cerevisiae] [ui:ydl031w] [pn:similarity to rna helicases] [keggfc:10.2] [keggfc:14.2] [sgdfc:4.12.0] |
| CONTIG405 | 25430337_f3_2 | 5528 | 19631 | 810 | 270 | YDL031W | 776 | 3.5(10)-77 | Saccharomyces cerevisiae | [db:gtc-saccharomyces cerevisiae] [ui:ydl031w] [pn:similarity to rna helicases] [keggfc:10.2] [keggfc:14.2] [sgdfc:4.12.0] |
| b2x12979.x | 5331552_f1_1 | 5529 | 19632 | 561 | 187 | YDL031W | 400 | 3.2(10)-36 | Saccharomyces cerevisiae | [db:gtc-saccharomyces cerevisiae] [ui:ydl031w] [pn:similarity to rna helicases] [keggfc:10.2] [keggfc:14.2] [sgdfc:4.12.0] |
| CONTIG571 | 3947692_f1_1 | 5530 | 19633 | 411 | 137 | YDR043C | 233 | 1.2(10)-19 | Saccharomyces cerevisiae | [db:gtc-saccharomyces cerevisiae] [ui:ydr043c] [pn:weak similarity to k.marxianus mig1 and other regulatory proteins] [gtcfc:10.2] [keggfc:14.2] [sgdfc:4.12.0] |
| CONTIG5754 | 23550337_c1_24 | 5531 | 19634 | 900 | 300 | YDR429C | 479 | 1.0(10)-45 | Saccharomyces cerevisiae | [db:gtc-saccharomyces cerevisiae] [ui:ydr429c] [pn:similarity to nuclear rna binding proteins] [gtcfc:10.2] [keggfc:14.2] [sgdfc:4.12.0] |
| CONTIG4050 | 1204390_c3_6 | 5532 | 19635 | 1002 | 334 | YGL171W | 453 | 5.9(10)-43 | Saccharomyces cerevisiae | [db:gtc-saccharomyces cerevisiae] [ui:ygl171w] [pn:atp-dependent rna helicase:atp-dependent rna helicase rok1] [gn:rok1:g1651] [gtcfc:10.2] [keggfc:14.2] [sgdfc:4.12.0] |
| b1x13309.x | 3020816_f1_1 | 5533 | 19636 | 609 | 203 | YGL171W | 706 | 9.1(10)-70 | Saccharomyces cerevisiae | [db:gtc-saccharomyces cerevisiae] [ui:ygl171w] [pn:atp-dependent rna helicase:atp-dependent rna helicase rok1] [gn:rok1:g1651] [gtcfc:10.2] [keggfc:14.2] [sgdfc:4.12.0] |
| CONTIG2561 | 34179687_c3_3 | 5534 | 19637 | 510 | 170 | YGL127C | 185 | 1.5(10)-14 | Saccharomyces cerevisiae | [db:gtc-saccharomyces cerevisiae] [ui:ygl127c] [pn:allows hpr1 null mutant to grow at 37 degsoh1 protein] [gn:soh1:g2864] [gtcfc:10.2:10.8] [keggfc:14.2] [sgdfc:3.7.0:4.12.0] |
| CONTIG2747 | 2151131_c2_3 | 5535 | 19638 | 1170 | 390 | YGL014W | 356 | 6.2(10)-49 | Saccharomyces cerevisiae | [db:gtc-saccharomyces cerevisiae] [ui:ygl014w] [pn:similarity to drosophila pumilio protein and mpt5p protein:hypothetical regulatory protein in pdr6-pdr1 intergenic region] [gn:ygl023] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5525 | 4329575_f1_3 | 5536 | 19639 | 1749 | 583 | YGL014W | 476 | 1.6(10)-44 | Saccharomyces cerevisiae | [ui:ygl014w] [pn:similarity to drosophila pumilio protein and mpt5p protein:hypothetical regulatory protein in pdr6-pdr1 intergenic region] [gn:ygl023] [gtcfc:10.2] [keggfc:14.2] [sgdfc:4.12.0] [db:gtc-saccharomyces cerevisiae] |
| CONTIG3729 | 16829030_c1_4 | 5537 | 19640 | 1311 | 437 | YGR067C | 231 | 4.5(10)-17 | Saccharomyces cerevisiae | [ui:ygr067c] [pn:weak similarity to transcription factors:putative 91.0 kd zinc finger protein in spt4-rom1 intergenic region] [gtcfc:10.2] [keggfc:14.2] [sgdfc:4.12.0] [db:gtc-saccharomyces cerevisiae] |
| CONTIG2764 | 22055252_c2_11 | 5538 | 19641 | 1104 | 368 | YHR169W | 1072 | 1.5(10)-108 | Saccharomyces cerevisiae | [ui:yhr169w] [pn:strong similarity to dead box rna helicases:putative atp-dependent rna helicase yhr169w] [gtcfc:10.2] [keggfc:14.2] [sgdfc:4.12.0] [db:gtc-saccharomyces cerevisiae] |
| CONTIG5584 | 15017211_c3_13 | 5539 | 19642 | 228 | 76 | YHR169W | 181 | 2.2(10)-13 | Saccharomyces cerevisiae | [ui:yhr169w] [pn:strong similarity to dead box rna helicases:putative atp-dependent rna helicase yhr169w] [gtcfc:10.2] [keggfc:14.2] [sgdfc:4.12.0] [db:gtc-saccharomyces cerevisiae] |
| CONTIG3603 | 34179556_c2_6 | 5540 | 19643 | 1665 | 555 | YHR170W | 1516 | 1.3(10)-155 | Saccharomyces cerevisiae | [ui:yhr170w] [pn:nonsense-mediated mrna decay protein:nonsense-mediated mrna decay protein 3] [gn:nmd3] [gtcfc:10.2] [keggfc:14.2] [sgdfc:4.12.0] [db:gtc-saccharomyces cerevisiae] |
| CONTIG5333 | 30719437_f2_2 | 5541 | 19644 | 480 | 160 | YHR170W | 141 | 6.7(10)-9 | Saccharomyces cerevisiae | [ui:yhr170w] [pn:nonsense-mediated mrna decay protein:nonsense-mediated mrna decay protein 3] [gn:nmd3] [gtcfc:10.2] [keggfc:14.2] [sgdfc:4.12.0] [db:gtc-saccharomyces cerevisiae] |
| CONTIG5757 | 21509380_f2_3 | 5542 | 19645 | 2139 | 713 | YIL105C | 507 | 1.1(10)-48 | Saccharomyces cerevisiae | [ui:yil105c] [pn:weak similarity to probable transcription factor ask10p:hypothetical 78.0 kd protein in pfk26-sga1 intergenic region] [gtcfc:10.2] [keggfc:14.2] [sgdfc:4.12.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5722 | 1375400_f2_7 | 5543 | 19646 | 3651 | 1217 | YIL030C | 577 | 1.1(10)-86 | Saccharomyces cerevisiae | saccharomyces cerevisiae] [ui:yil030c] [pn:involved in mrna turnover:ssm4 protein] [gn:ssm4:yi3299] [gtcfc:10.2] [keggfc:14.2] [sgdfc:4.12.0] [db:gtc-saccharomyces cerevisiae] |
| CONTIG3532 | 26369157_c2_10 | 5544 | 19647 | 771 | 257 | YIR001C | 216 | 7.7(10)-18 | Saccharomyces cerevisiae | [ui:yir001c] [pn:similarity to d.melanogaster rna binding protein:hypothetical 29.0 kd protein in bet1-pan1 intergenic region] [gn:yib1c] [gtcfc:10.2] [keggfc:14.2] [sgdfc:4.12.0] [db:gtc-saccharomyces cerevisiae] |
| CONTIG3773 | 26370316_f2_3 | 5545 | 19648 | 513 | 171 | YIR001C | 238 | 3.6(10)-20 | Saccharomyces cerevisiae | [ui:yir001c] [pn:similarity to d.melanogaster rna binding protein:hypothetical 29.0 kd protein in bet1-pan1 intergenic region] [gn:yib1c] [gtcfc:10.2] [keggfc:14.2] [sgdfc:4.12.0] [db:gtc-saccharomyces cerevisiae] |
| CONTIG5223 | 3917563_c3_14 | 5546 | 19649 | 1071 | 357 | YIR005W | 255 | 5.7(10)-22 | Saccharomyces cerevisiae | [ui:yir005w] [pn:similarity to rna-binding proteins:hypothetical 17.1 kd protein in bet1-pan1 intergenic region] [gn:yib5w] [gtcfc:10.2] [keggfc:14.2] [sgdfc:4.12.0] [db:gtc-saccharomyces cerevisiae] |
| CONTIG5594 | 31298426_c1_12 | 5547 | 19650 | 297 | 99 | YIL124C | 134 | 3.7(10)-9 | Saccharomyces cerevisiae | [ui:yil124c] [pn:weak similarity to human sm protein g:hypothetical 20.3 kd protein in gcd14-pos18 intergenic region] [gn:j0714] [gtcfc:4.12.0] [keggfc:14.2] [sgdfc:4.12.0] [db:gtc-saccharomyces cerevisiae] |
| CONTIG4617 | 15626338_f2_2 | 5548 | 19651 | 2289 | 763 | YML017W | 156 | 3.0(10)-11 | Saccharomyces cerevisiae | [ui:yml017w] [pn:suppressor of dna polymerase alpha mutation:psp2 protein] [gn:psp2:ym9571] [gtcfc:10.2] [keggfc:14.2] [sgdfc:4.12.0] |
| CONTIG5315 | 24300255_f2_4 | 5549 | 19652 | 873 | 291 | YMR213W | 359 | 1.7(10)-32 | Saccharomyces cerevisiae | [ui:ymr213w] [pn:similarity to s.pombe putative transcription factor cdc5:hypothetical 67.7 kd protein in rar1-sej1 intergenic region] [gn:ym9646] [gtcfc:10.2] [keggfc:14.2] [sgdfc:4.12.0] |
| CONTIG1236 | 15761316_c2_5 | 5550 | 19653 | 531 | 177 | YNL255C | 398 | 4.0(10)-37 | Saccharomyces cerevisiae | [ui:ynl255c] [pn:strong similarity to nucleic acid-binding proteins:hypothetical 17.1 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5079 | 6054138_c2_8 | 5551 | 19654 | 1233 | 411 | YNL175C | 583 | 9.9(10)-57 | Saccharomyces cerevisiae | protein in sip3-mrp130 intergenic region] [gn:n0852] [gtcfc:10.2] [keggfc:14.2] [sgdfc:4.12.0] [db:gtc-saccharomyces cerevisiae] [ui:ynl175c] [pn:similarity to s.pombe mp24p:hypothetical 45.7 kd protein in rps3-psd1 intergenic region] [gn:n1665] [gtcfc:10.2] [keggfc:14.2] [sgdfc:4.12.0] |
| CONTIG4233 | 23489151_c3_4 | 5552 | 19655 | 330 | 110 | YNL027W | 259 | 2.1(10)-21 | Saccharomyces cerevisiae | [db:gtc-saccharomyces cerevisiae] [ui:ynl027w] [pn:similarity to zinc-finger proteins:hypothetical 76.3 kd zinc finger protein in hhf2-ume3 intergenic region] [gn:n2760] [gtcfc:10.2] [keggfc:14.2] [sgdfc:4.12.0] |
| CONTIG4828 | 2150313_c1_7 | 5553 | 19656 | 1245 | 415 | YNL027W | 188 | 8.0(10)-12 | Saccharomyces cerevisiae | [db:gtc-saccharomyces cerevisiae] [ui:ynl027w] [pn:similarity to zinc-finger proteins:hypothetical 76.3 kd zinc finger protein in hhf2-ume3 intergenic region] [gn:n2760] [gtcfc:10.2] [keggfc:14.2] [sgdfc:4.12.0] |
| CONTIG5723 | 4119002_c3_35 | 5554 | 19657 | 288 | 96 | YNR063W | 135 | 3.7(10)-8 | Saccharomyces cerevisiae | [db:gtc-saccharomyces cerevisiae] [ui:ynr063w] [pn:weak similarity to cyc1/cyp3 transcription activator:putative transcriptional regulatory protein in bio3-hxt17 intergenic region] [gn:n3531] [gtcfc:10.2] [keggfc:14.2] [sgdfc:4.12.0] |
| CONTIG5781 | 16831535_c3_32 | 5555 | 19658 | 1632 | 544 | YOR244W | 1180 | 7.0(10)-132 | Saccharomyces cerevisiae | [db:gtc-saccharomyces cerevisiae] [ui:yor244w] [pn:similarity to sas2p and sas3p] [gtcfc:10.2] [keggfc:14.2] [sgdfc:4.12.0] |
| CONTIG3139 | 9773376_c3_12 | 5556 | 19659 | 795 | 265 | YPL230W | 271 | 1.1(10)-23 | Saccharomyces cerevisiae | [db:gtc-saccharomyces cerevisiae] [ui:ypl230w] [pn:similarity to transcription factors] [gtcfc:10.2] [keggfc:14.2] [sgdfc:4.12.0] |
| CONTIG2137 | 13759635_f2_1 | 5557 | 19660 | 402 | 134 | YPL133C | 138 | 1.1(10)-8 | Saccharomyces cerevisiae | [db:gtc-saccharomyces cerevisiae] [ui:ypl133c] [pn:weak similarity to transcription factors:putative transcriptional regulatory protein in mkk2-cox11 intergenic region] [gn:lpl12c] [gtcfc:10.2] [keggfc:14.2] [sgdfc:4.12.0] |
| CONTIG2962 | 9852266_f3_3 | 5558 | 19661 | 1185 | 395 | YPL133C | 873 | 6.2(10)-97 | Saccharomyces cerevisiae | [db:gtc-saccharomyces cerevisiae] [ui:ypl133c] [pn:weak similarity to transcription factors:putative |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3967 | 47885_f2_2 | 5559 | 19662 | 1143 | 381 | YPR013C | 187 | 2.2(10)-13 | Saccharomyces cerevisiae | transcriptional regulatory protein in mkt2-cox11 intergenic region] [gn:lpi12c] [gtcfc:10.2] [keggfc:14.2] [sgdfc:4.12.0] [db:gtc-saccharomyces cerevisiae] [ui:ypr013c] [pn:similarity to transcription factors] [gtcfc:10.2] [keggfc:14.2] [sgdfc:4.12.0] [db:gtc-saccharomyces cerevisiae] |
| CONTIG2677 | 34663912_c2_8 | 5560 | 19663 | 2001 | 667 | YPR031W | 833 | 2.7(10)-92 | Saccharomyces cerevisiae | [ui:ypr031w] [pn:similarity to human zinc-finger protein br140] [gtcfc:10.2] [keggfc:14.2] [sgdfc:4.12.0] [db:gtc-saccharomyces cerevisiae] |
| CONTIG2941 | 4569427_f1_1 | 5561 | 19664 | 774 | 258 | YPR031W | 117 | 0.00038 | Saccharomyces cerevisiae | [ui:ypr031w] [pn:similarity to human zinc-finger protein br140] [gtcfc:10.2] [keggfc:14.2] [sgdfc:4.12.0] [db:gtc-saccharomyces cerevisiae] |
| CONTIG5797 | 4476387_c3_36 | 5562 | 19665 | 657 | 219 | YPR107C | 655 | 2.2(10)-64 | Saccharomyces cerevisiae | [ui:ypr107c] [pn:strong similarity to d.melanogaster zinc finger protein] [gtcfc:10.2] [keggfc:14.2] [sgdfc:4.12.0] [db:gtc-saccharomyces cerevisiae] |
| CONTIG4909 | 7827_f1_1 | 5563 | 19666 | 1620 | 540 | YHR065C | 1309 | 1.2(10)-133 | Saccharomyces cerevisiae | [ui:yhr065c] [pn:required for maturation of the 35s primary transcript:atp-dependent rna helicase] [gn:rrp3] [gtcfc:10.3] [keggfc:14.2] [sgdfc:4.2.0] [db:gtc-saccharomyces cerevisiae] |
| CONTIG3377 | 2737785_c2_7 | 5564 | 19667 | 648 | 216 | YJL033W | 214 | 1.8(10)-16 | Saccharomyces cerevisiae | [ui:yjl033w] [pn:can suppress the u14 snoma rma processing function:probable atp-dependent rna helicase ca4] [gn:hca4;j1250] [gtcfc:10.3] [keggfc:14.2] [sgdfc:4.2.0] [db:gtc-saccharomyces cerevisiae] |
| CONTIG5717 | 1253_f2_1 | 5565 | 19668 | 2430 | 810 | YJL033W | 1949 | 1.8(10)-201 | Saccharomyces cerevisiae | [ui:yjl033w] [pn:can suppress the u14 snoma rma processing function:probable atp-dependent rna helicase ca4] [gn:hca4;j1250] [gtcfc:10.3] [keggfc:14.2] [sgdfc:4.2.0] [db:gtc-saccharomyces cerevisiae] |
| CONTIG5118 | 1213187_f1_2 | 5566 | 19669 | 564 | 188 | YLR059C | 353 | 2.2(10)-32 | Saccharomyces cerevisiae | [ui:ylr059c] [pn:suppressor of rna12/yme2/ynt20 protein] [gn:ynt20;112159] [gtcfc:10.3] [keggfc:14.2] [sgdfc:4.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x13585.y | 6561_c3_2 | 5567 | 19670 | 297 | 99 | YBL092W | 377 | 6.7(10)-35 | Saccharomyces cerevisiae | [ui:ybl092w] [pn:ribosomal protein 132.e:60s ribosomal protein 132e] [gn:ybl0838] [gtcfc:10.4] [keggfc:14.2] [sgdfc:5.1.0:9.2.0] [db:gtc-saccharomyces cerevisiae] |
| CONTIG5763 | 12501050_c2_21 | 5568 | 19671 | 372 | 124 | YBL087C | 583 | 9.9(10)-57 | Saccharomyces cerevisiae | [ui:ybl087c] [pn:ribosomal protein 123.e:60s ribosomal protein 117] [gn:rp117b:rp117a:ybl0713] [gtcfc:10.4] [keggfc:14.2] [sgdfc:5.1.0:9.2.0] [db:gtc-saccharomyces cerevisiae] |
| CONTIG5062 | 36367178_f3_4 | 5569 | 19672 | 627 | 209 | YBL072C | 697 | 8.1(10)-69 | Saccharomyces cerevisiae | [ui:ybl072c] [pn:ribosomal protein s8.e:40s ribosomal protein s8.s14:ys9:rp19] [gn:rps8b:rps8a:ybl0613:ybl06] [gtcfc:10.4] [keggfc:14.2] [sgdfc:5.1.0:9.2.0] [db:gtc-saccharomyces cerevisiae] |
| CONTIG44 | 24492149_c1_2 | 5570 | 19673 | 336 | 112 | YBL027W | 237 | 4.5(10)-20 | Saccharomyces cerevisiae | [ui:ybl027w] [pn:ribosomal protein 119.e:60s ribosomal protein 119:123:yl14:rp33:rp151] [gn:rp119a:ybr084bc:rp119b:ybr084c-a:ybl0424] [gtcfc:10.4] [keggfc:14.2] [sgdfc:5.1.0:9.2.0] [db:gtc-saccharomyces cerevisiae] |
| CONTIG5370 | 9773444_c1_8 | 5571 | 19674 | 414 | 138 | YBL027W | 206 | 8.8(10)-17 | Saccharomyces cerevisiae | [ui:ybl027w] [pn:ribosomal protein 119.e:60s ribosomal protein 119:123:yl14:rp33:rp151] [gn:rp119a:ybr084bc:rp119b:ybr084c-a:ybl0424] [gtcfc:10.4] [keggfc:14.2] [sgdfc:5.1.0:9.2.0] [db:gtc-saccharomyces cerevisiae] |
| CONTIG4531 | 22542162_c2_12 | 5572 | 19675 | 207 | 69 | YBR031W | 297 | 2.0(10)-26 | Saccharomyces cerevisiae | [ui:ybr031w] [pn:ribosomal protein 12a:60s ribosomal protein 12a:rp2] [gn:rp12a:rp12:ybr0315] [gtcfc:10.4] [keggfc:14.2] [sgdfc:5.1.0:9.2.0] [db:gtc-saccharomyces cerevisiae] |
| CONTIG4531 | 10984406_c2_11 | 5573 | 19676 | 252 | 84 | YBR031W | 143 | 2.1(10)-9 | Saccharomyces cerevisiae | [ui:ybr031w] [pn:ribosomal protein 12a:60s ribosomal protein 12a:rp2] [gn:rp12a:rp12:ybr0315] [gtcfc:10.4] [keggfc:14.2] [sgdfc:5.1.0:9.2.0] [db:gtc-saccharomyces cerevisiae] |
| b9x13909.x | 14188817_f1_1 | 5574 | 19677 | 603 | 201 | YBR031W | 619 | 1.5(10)-60 | Saccharomyces cerevisiae | [ui:ybr031w] [pn:ribosomal protein 12a:60s ribosomal protein 12a:rp2] [gn:rp12a:rp12:ybr0315] [gtcfc:10.4] [keggfc:14.2] [sgdfc:5.1.0:9.2.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4334 | 4475811_f3_4 | 5575 | 19678 | 423 | 141 | YBR048W | 574 | 8.9(10)-56 | Saccharomyces cerevisiae | [ui:ybr048w] [pn:ribosomal protein s11.e.b:ribosomal protein s11.e:40s ribosomal protein rp41:ys12:s18a/s18b] [gn:rps18b:ybr0501:rps18a:yd98l3] [gtcfc:10.4] [keggfc:14.2] [sgdfc:5.1.0:9.2.0] [db:gtc-saccharomyces cerevisiae] |
| CONTIG2123 | 10192175_f1_1 | 5576 | 19679 | 363 | 121 | YBR181C | 475 | 2.7(10)-45 | Saccharomyces cerevisiae | [ui:ybr181c] [pn:ribosomal protein s6.e:40s ribosomal protein s6:s10:ys4:rp9] [gn:rps10a:rps6a:rps101:ybr1244] [gtcfc:10.4] [keggfc:14.2] [sgdfc:5.1.0:9.2.0] [db:gtc-saccharomyces cerevisiae] |
| CONTIG2123 | 21901556_f3_7 | 5577 | 19680 | 204 | 68 | YBR181C | 164 | 2.5(10)-12 | Saccharomyces cerevisiae | [ui:ybr181c] [pn:ribosomal protein s6.e:40s ribosomal protein s6:s10:ys4:rp9] [gn:rps10a:rps6a:rps101:ybr1244] [gtcfc:10.4] [keggfc:14.2] [sgdfc:5.1.0:9.2.0] [db:gtc-saccharomyces cerevisiae] |
| CONTIG5383 | 19578141_c3_15 | 5578 | 19681 | 618 | 206 | YBR189W | 787 | 2.3(10)-78 | Saccharomyces cerevisiae | [ui:ybr189w] [pn:ribosomal protein s9.e:40s ribosomal protein s11:yp28:s13] [gn:rps13a:yys11a:rps13b:sup46:ybr1317] [gtcfc:10.4] [keggfc:14.2] [sgdfc:5.1.0:9.2.0] [db:gtc-saccharomyces cerevisiae] |
| CONTIG2827 | 29511007_c1_4 | 5579 | 19682 | 216 | 72 | YBR191W | 220 | 2.8(10)-18 | Saccharomyces cerevisiae | [ui:ybr191w] [pn:ribosomal protein 121.e:60s ribosomal protein 121e] [gn:urp1a:aurp1:ybr1401] [gtcfc:10.4] [keggfc:14.2] [sgdfc:5.1.0:9.2.0] [db:gtc-saccharomyces cerevisiae] |
| CONTIG5383 | 33359385_c1_7 | 5580 | 19683 | 201 | 67 | YBR191W | 205 | 1.1(10)-16 | Saccharomyces cerevisiae | [ui:ybr191w] [pn:ribosomal protein 121.e:60s ribosomal protein 121e] [gn:urp1a:aurp1:ybr1401] [gtcfc:10.4] [keggfc:14.2] [sgdfc:5.1.0:9.2.0] [db:gtc-saccharomyces cerevisiae] |
| CONTIG5163 | 24414078_f1_1 | 5581 | 19684 | 900 | 300 | YDL202W | 466 | 2.5(10)-44 | Saccharomyces cerevisiae | [ui:ydl202w] [pn:weak similarity to ribosomal protein] [gtcfc:10.4] [keggfc:14.2] [sgdfc:5.1.0] [db:gtc-saccharomyces cerevisiae] |
| CONTIG5492 | 23486658_f2_2 | 5582 | 19685 | 360 | 120 | YDL191W | 376 | 8.5(10)-35 | Saccharomyces cerevisiae | [ui:ydl191w] [pn:ribosomal protein:60s ribosomal protein 135e] [gn:sos1:d1249:sos2:d2170] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5216 | 23718757_f1_6 | 5583 | 19686 | 408 | 136 | YDL083C | 529 | 5.2(10)-51 | *Saccharomyces cerevisiae* | [ui:ydl083c] [pn:ribosomal protein s16.e:40s ribosomal protein rs16 homolog:rp61 homolog] [gn:rps16b:rps16a:rp61r:ym9375] [gtcfc:10.4] [keggfc:14.2] [sgdfc:5.1.0:9.2.0] [db:gtc-saccharomyces cerevisiae] |
| CONTIG5216 | 9770037_c2_13 | 5584 | 19687 | 669 | 223 | YDL082W | 658 | 1.1(10)-64 | *Saccharomyces cerevisiae* | [ui:ydl082w] [pn:ribosomal protein 113] [gtcfc:10.4] [keggfc:14.2] [sgdfc:5.1.0] [db:gtc-saccharomyces cerevisiae] |
| CONTIG1465 | 12922192_f1_1 | 5585 | 19688 | 402 | 134 | YDL081C | 204 | 1.3(10)-16 | *Saccharomyces cerevisiae* | [ui:ydl081c] [pn:acidic ribosomal protein a1 60s acidic ribosomal protein p1-alpha:a1:112eiia] [gn:rpla1:112eiia:rpa1] [gtcfc:10.4:10.7] [keggfc:14.2] [sgdfc:5.1.0:5.2.0:9.2.0] [db:gtc-saccharomyces cerevisiae] |
| CONTIG5216 | 13703275_f1_3 | 5586 | 19689 | 333 | 111 | YDL081C | 262 | 1.0(10)-22 | *Saccharomyces cerevisiae* | [ui:ydl081c] [pn:acidic ribosomal protein a1 60s acidic ribosomal protein p1-alpha:a1:112eiia] [gn:rpla1:112eiia:rpa1] [gtcfc:10.4:10.7] [keggfc:14.2] [sgdfc:5.1.0:5.2.0:9.2.0] [db:gtc-saccharomyces cerevisiae] |
| b2x14827.y | 6145175_f3_2 | 5587 | 19690 | 201 | 67 | YDL075W | 206 | 8.8(10)-17 | *Saccharomyces cerevisiae* | [ui:ydl075w] [pn:ribosomal protein 13L.e:60s ribosomal protein 134:y128] [gn:rp134:rp134a:rp134b:18084] [gtcfc:10.4] [keggfc:14.2] [sgdfc:5.1.0:9.2.0] [db:gtc-saccharomyces cerevisiae] |
| CONTIG4967 | 36615676_f3_6 | 5588 | 19691 | 447 | 149 | YDR041W | 184 | 1.8(10)-14 | *Saccharomyces cerevisiae* | [ui:ydr041w] [pn:weak similarity to bacterial ribosomal s10 proteins] [gtcfc:10.4] [keggfc:14.2] [sgdfc:5.1.0] [db:gtc-saccharomyces cerevisiae] |
| CONTIG4935 | 4195268_f3_2 | 5589 | 19692 | 435 | 145 | YDR064W | 685 | 1.5(10)-67 | *Saccharomyces cerevisiae* | [ui:ydr064w] [pn:ribosomal protein:40s ribosomal protein s13:ys15:s27a] [gn:ys15:rps13:yd9609] [gtcfc:10.4] [keggfc:14.2] [sgdfc:5.1.0:9.2.0] [db:gtc-saccharomyces cerevisiae] |
| CONTIG5053 | 21604035_c2_11 | 5590 | 19693 | 405 | 135 | YDR115W | 197 | 7.9(10)-16 | *Saccharomyces cerevisiae* | [ui:ydr115w] [pn:similarity to bacterial ribosomal 134 proteins] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3607 | 25800716_c3_8 | 5591 | 19694 | 444 | 148 | YDR116C | 239 | 2.7(10)-20 | Saccharomyces cerevisiae | [ui:ydr116c] [pn:similarity to bacterial ribosomal 11 proteins] [gtcfc:10.4] [keggfc:14.2] [sgdfc:5.1.0] [db:gtc-saccharomyces cerevisiae] |
| b3x13209.x | 23548178_f3_1 | 5592 | 19695 | 261 | 87 | YDR237W | 196 | 1.0(10)-15 | Saccharomyces cerevisiae | [ui:ydr237w] [pn:similarity to bacterial ribosomal 15 protein:mitochondrial 60s ribosomal protein 17 precursor:ym17] [gn:mrp17:yd8419] [gtcfc:10.4] [keggfc:14.2] [sgdfc:5.1.0] [db:gtc-saccharomyces cerevisiae] |
| CONTIG4623 | 16286629_c1_5 | 5593 | 19696 | 615 | 205 | YDR237W | 459 | 1.3(10)-43 | Saccharomyces cerevisiae | [ui:ydr237w] [pn:similarity to bacterial ribosomal 15 protein:mitochondrial 60s ribosomal protein 17 precursor:ym17] [gn:mrp17:yd8419] [gtcfc:10.4] [keggfc:14.2] [sgdfc:5.1.0] [db:gtc-saccharomyces cerevisiae] |
| CONTIG4056 | 19690675_c1_4 | 5594 | 19697 | 369 | 123 | YDR382W | 245 | 6.5(10)-21 | Saccharomyces cerevisiae | [ui:ydr382w] [pn:acidic ribosomal protein:60s acidic ribosomal protein p2-beta:145:y144e:cypa1:112eia] [gn:rpla4:112eia:rp145] [gtcfc:10.4] [keggfc:14.2] [sgdfc:5.1.0:9.2.0] [db:gtc-saccharomyces cerevisiae] |
| CONTIG3711 | 6031261_c1_7 | 5595 | 19698 | 354 | 118 | YDR382W | 188 | 7.0(10)-15 | Saccharomyces cerevisiae | [ui:ydr382w] [pn:acidic ribosomal protein:60s acidic ribosomal protein p2-beta:145:y144e:cypa1:112eia] [gn:rpla4:112eia:rp145] [gtcfc:10.4] [keggfc:14.2] [sgdfc:5.1.0:9.2.0] [db:gtc-saccharomyces cerevisiae] |
| CONTIG5811 | 12932805_f2_13 | 5596 | 19699 | 504 | 168 | YDR418W | 739 | 2.8(10)-73 | Saccharomyces cerevisiae | [ui:ydr418w] [pn:ribosomal protein 112.e:60s ribosomal protein 112:y115:y123] [gn:rp115b:rp115a:d9461] [gtcfc:10.4] [keggfc:14.2] [sgdfc:5.1.0:9.2.0] [db:gtc-saccharomyces cerevisiae] |
| CONTIG5562 | 1031517_c3_15 | 5597 | 19700 | 408 | 136 | YDR450W | 540 | 3.6(10)-52 | Saccharomyces cerevisiae | [ui:ydr450w] [pn:ribosomal protein s18.e.c4:ribosomal protein s18.e.c13:40s ribosomal protein s18e] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2546 | 6831302_f2_2 | 5598 | 19701 | 342 | 114 | YDR500C | 365 | 1.2(10)-33 | *Saccharomyces cerevisiae* | [gn:rps18eb:rps18ea:rps13c:ydr064w:d9461] [gtcfc:10.4] [keggfc:14.2] [sgdfc:5.1.0:9.2.0] [db:gtc-*saccharomyces cerevisiae*] [ui:ydr500c] [pn:ribosomal protein 1.37.e:60s ribosomal protein 137e byp55] [gn:rp135b:d9719] [gtcfc:10.4] [keggfc:14.2] [sgdfc:5.1.0:9.2.0] [db:gtc-*saccharomyces cerevisiae*] |
| CONTIG3339 | 26210927_c3_8 | 5599 | 19702 | 402 | 134 | YDR500C | 357 | 8.8(10)-33 | *Saccharomyces cerevisiae* | [ui:ydr500c] [pn:ribosomal protein 1.37.e:60s ribosomal protein 137e byp55] [gn:rp135b:d9719] [gtcfc:10.4] [keggfc:14.2] [sgdfc:5.1.0:9.2.0] [db:gtc-*saccharomyces cerevisiae*] |
| CONTIG5720 | 26353216_c3_29 | 5600 | 19703 | 828 | 276 | YEL050C | 733 | 1.3(10)-72 | *Saccharomyces cerevisiae* | [ui:yel050c] [pn:similarity to bacterial ribosomal 12 protein:putative 60s ribosomal protein yel050c] [gn:sygp-orf37] [gtcfc:10.4] [keggfc:14.2] [sgdfc:5.1.0] [db:gtc-*saccharomyces cerevisiae*] |
| CONTIG5720 | 26370418_c2_22 | 5601 | 19704 | 549 | 183 | YEL050C | 199 | 1.8(10)-15 | *Saccharomyces cerevisiae* | [ui:yel050c] [pn:similarity to bacterial ribosomal 12 protein:putative 60s ribosomal protein yel050c] [gn:sygp-orf37] [gtcfc:10.4] [keggfc:14.2] [sgdfc:5.1.0] [db:gtc-*saccharomyces cerevisiae*] |
| CONTIG3279 | 2189062_f1_1 | 5602 | 19705 | 465 | 155 | YER074W | 498 | 1.0(10)-47 | *Saccharomyces cerevisiae* | [ui:yer074w] [pn:ribosomal protein s24.e:40s ribosomal protein s24:rp50] [gn:rp50a:rps50b:rps24ea:rps24eb] [gtcfc:10.4] [keggfc:14.2] [sgdfc:5.1.0:9.2.0] [db:gtc-*saccharomyces cerevisiae*] |
| CONTIG5435 | 12926550_c2_14 | 5603 | 19706 | 366 | 122 | YGL189C | 522 | 2.8(10)-50 | *Saccharomyces cerevisiae* | [ui:ygl189c] [pn:40s ribosomal protein s26c:c7-40s ribosomal protein s26e-a] [gn:rps26a:rps26:g1355] [gtcfc:10.4] [keggfc:14.2] [sgdfc:5.1.0:9.2.0] [db:gtc-*saccharomyces cerevisiae*] |
| CONTIG4954 | 10979677_c2_14 | 5604 | 19707 | 660 | 220 | YGL135W | 897 | 5.2(10)-90 | *Saccharomyces cerevisiae* | [ui:ygl135w] [pn:ribosomal protein:60s ribosomal protein 110a] [gn:ssm1b:ssm2:g2834:ssm1a:yp1220w:ssm1] [gtcfc:10.4] [keggfc:14.2] [sgdfc:5.1.0:9.2.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5409 | 10975925_f2_7 | 5605 | 19708 | 756 | 252 | YGL123W | 836 | 1.5(10)-83 | *Saccharomyces cerevisiae* | [db:gtc-saccharomyces cerevisiae] [ui:ygl123w] [pn:ribosomal protein:40s ribosomal protein s4:omnipotent supressor protein sup44:rp12:s2e] [gn:sup44:g2893] [gtcfc:10.4] [keggfc:14.2] [sgdfc:5.1.0:9.2.0] [db:gtc-saccharomyces cerevisiae] |
| CONTIG2928 | 26364033_c1_6 | 5606 | 19709 | 627 | 209 | YGL076C | 850 | 5.0(10)-85 | *Saccharomyces cerevisiae* | [ui:ygl076c] [pn:ribosomal protein 17.e.a:60s ribosomal protein yl18:16:rp11] [gn:rp16a:rp16:rp18a:yl18a] [gtcfc:10.4] [keggfc:14.2] [sgdfc:5.1.0:9.2.0] [db:gtc-saccharomyces cerevisiae] |
| CONTIG4731 | 5275312_f2_5 | 5607 | 19710 | 471 | 157 | YGL031C | 475 | 2.7(10)-45 | *Saccharomyces cerevisiae* | [ui:ygl031c] [pn:ribosomal protein 124.e.a:60s ribosomal protein 130a:rp29:yl21] [gn:rp130a:rp29] [gtcfc:10.4] [keggfc:14.2] [sgdfc:5.1.0:9.2.0] [db:gtc-saccharomyces cerevisiae] |
| CONTIG3829 | 30178908_c3_7 | 5608 | 19711 | 318 | 106 | YGL030W | 410 | 2.1(10)-38 | *Saccharomyces cerevisiae* | [ui:ygl030w] [pn:ribosomal protein 130.e:60s ribosomal protein 130e:yl132:rp73] [gn:rp132] [gtcfc:10.4] [keggfc:14.2] [sgdfc:5.1.0:9.2.0] [db:gtc-saccharomyces cerevisiae] |
| CONTIG545 | 10445193_c2_4 | 5609 | 19712 | 219 | 73 | YGR027C | 255 | 5.7(10)-22 | *Saccharomyces cerevisiae* | [ui:ygr027c] [pn:ribosomal protein s25.e.ec7] [gn:rps31a] [gtcfc:10.4] [keggfc:14.2] [sgdfc:5.1.0:9.2.0] [db:gtc-saccharomyces cerevisiae] |
| CONTIG5036 | 10739130_c1_8 | 5610 | 19713 | 522 | 174 | YGR085C | 789 | 1.5(10)-78 | *Saccharomyces cerevisiae* | [ui:ygr085c] [pn:ribosomal protein yl16.b:60s ribosomal protein l16:yl16:39a:rp39] [gn:rp116r:rp39b] [gtcfc:10.4] [keggfc:14.2] [sgdfc:5.1.0:9.2.0] [db:gtc-saccharomyces cerevisiae] |
| CONTIG5247 | 35392568_c2_15 | 5611 | 19714 | 576 | 192 | YGR118W | 723 | 1.3(10)-71 | *Saccharomyces cerevisiae* | [ui:ygr118w] [pn:ribosomal protein s23.e:40s ribosomal protein s28] [gn:rps28a:rps28bp9659] [gtcfc:10.4] [keggfc:14.2] [sgdfc:5.1.0:9.2.0] [db:gtc-saccharomyces cerevisiae] |
| b1x14649.x | 11177068_f1_1 | 5612 | 19715 | 660 | 220 | YGR214W | 715 | 1.0(10)-70 | *Saccharomyces cerevisiae* | [ui:ygr214w] [pn:40s ribosomal protein p40 homolog a:40s ribosomal protein sa homolog a:nucleic acid-binding protein nab1a] [gn:nab1a:nab1:yst1] [gtcfc:10.4:12.16] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5577 | 4820187_f1_2 | 5613 | 19716 | 231 | 77 | YHL015W | 243 | 1.1(10)-20 | Saccharomyces cerevisiae | [sgdfc:5.1.0:6.4.0:9.2.0] [db:gtc-saccharomyces cerevisi [ui:yhl015w] [pn:ribosomal protein:40s ribosomal protein] [gn:urp2] [gtcfc:10.4] [keggfc:14.2] [sgdfc:5.1.0:9.2.0] |
| CONTIG5735 | 1564051_c2_17 | 5614 | 19717 | 393 | 131 | YHR010W | 458 | 1.7(10)-43 | Saccharomyces cerevisiae | [db:gtc-saccharomyces cerevisiae] [ui:yhr010w] [pn:ribosomal protein 127,e:probable 60s ribosomal protein 127] [gn:rp127a:rp127:rp127b:ydr471w:d 8035] [gtcfc:10.4] [keggfc:14.2] [sgdfc:5.1.0:9.2.0] [db:gtc-saccharomyces cerevisiae] |
| CONTIG5339 | 23441910_f2_4 | 5615 | 19718 | 582 | 194 | YHR148W | 763 | 8.3(10)-76 | Saccharomyces cerevisiae | [ui:yhr148w] [pn:similarity to ribosomal protein:putative 40s ribosomal protein yhr148w] [gtcfc:10.4] [keggfc:14.2] [sgdfc:5.1.0] [db:gtc-saccharomyces cerevisiae] |
| CONTIG5795 | 428_f3_20 | 5616 | 19719 | 708 | 236 | YIL133C | 766 | 4.0(10)-76 | Saccharomyces cerevisiae | [ui:yil133c] [pn:ribosomal protein:60s ribosomal protein 113a:rp22] [gn:rp22:rp113a] [gtcfc:10.4] [keggfc:14.2] [sgdfc:5.1.0:9.2.0] [db:gtc-saccharomyces cerevisiae] |
| CONTIG3584 | 23546950_f2_2 | 5617 | 19720 | 789 | 263 | YIL018W | 1116 | 3.2(10)-113 | Saccharomyces cerevisiae | [ui:yil018w] [pn:ribosomal protein 18,e:60s ribosomal protein yl6.15:rp8] [gn:rp15b:yfr031bc:rp15a] [gtcfc:10.4] [keggfc:14.2] [sgdfc:5.1.0:9.2.0] [db:gtc-saccharomyces cerevisiae] |
| CONTIG1243 | 4680_f2_1 | 5618 | 19721 | 327 | 109 | YJL190C | 434 | 6.0(10)-41 | Saccharomyces cerevisiae | [ui:yjl190c] [pn:ribosomal protein s15a.e.c10:40s ribosomal protein s22:ys24:yp58] [gn:rps24a:rps24:j0355:rps24b:180 39] [gtcfc:10.4] [keggfc:14.2] [sgdfc:5.1.0:9.2.0] [db:gtc-saccharomyces cerevisiae] |
| CONTIG975 | 14882762_c2_3 | 5619 | 19722 | 186 | 62 | YJL190C | 208 | 5.4(10)-17 | Saccharomyces cerevisiae | [ui:yjl190c] [pn:ribosomal protein s15a.e.c10:40s ribosomal protein s22:ys24:yp58] [gn:rps24a:rps24:j0355:rps24b:180 39] [gtcfc:10.4] [keggfc:14.2] [sgdfc:5.1.0:9.2.0] [db:gtc-saccharomyces cerevisiae] |
| CONTIG5151 | 23837563_f2_2 | 5620 | 19723 | 354 | 118 | YJL177W | 359 | 5.4(10)-33 | Saccharomyces cerevisiae | [ui:yjl177w] [pn:ribosomal protein 117,e:60s ribosomal protein yl17-b] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3372 | 34433128_f3_5 | 5621 | 19724 | 210 | 70 | YJL177W | 129 | 1.3(10)-8 | Saccharomyces cerevisiae | [gn:rp120b:j0493] [gtcfc:10.4] [keggfc:14.2] [sgdfc:5.1.0:9.2.0] [db:gtc-saccharomyces cerevisiae] [ui:yjl177w] [pn:ribosomal protein l17,e:60s ribosomal protein yl17-b] [gn:rp120b:j0493] [gtcfc:10.4] [keggfc:14.2] [sgdfc:5.1.0:9.2.0] [db:gtc-saccharomyces cerevisiae] |
| CONTIG5328 | 20320378_c2_15 | 5622 | 19725 | 195 | 65 | YJL136C | 258 | 2.7(10)-22 | Saccharomyces cerevisiae | [ui:yjl136c] [pn:ribosomal protein s21,e] [gn:rps25b] [gtcfc:10.4] [keggfc:14.2] [sgdfc:5.1.0:9.2.0] [db:gtc-saccharomyces cerevisiae] |
| CONTIG4189 | 10979656_c2_4 | 5623 | 19726 | 684 | 228 | YJR123W | 873 | 1.8(10)-87 | Saccharomyces cerevisiae | [ui:yjr123w] [pn:ribosomal protein s5,e:40s ribosomal protein s5,rp14:ys8] [gn:rps5:j2045] [gtcfc:10.4] [keggfc:14.2] [sgdfc:5.1.0:9.2.0] [db:gtc-saccharomyces cerevisiae] |
| CONTIG3175 | 32282527_c2_5 | 5624 | 19727 | 321 | 107 | YJR145C | 251 | 1.5(10)-21 | Saccharomyces cerevisiae | [ui:yjr145c] [pn:ribosomal protein s4,e,c10:40s ribosomal protein s4s7:ys6:rp5] [gn:rps7b:j2186] [gtcfc:10.4] [keggfc:14.2] [sgdfc:5.1.0:9.2.0] [db:gtc-saccharomyces cerevisiae] |
| CONTIG5815 | 36366532_f2_15 | 5625 | 19728 | 795 | 265 | YJR145C | 1118 | 2.0(10)-113 | Saccharomyces cerevisiae | [ui:yjr145c] [pn:ribosomal protein s4,e,c10:40s ribosomal protein s4s7:ys6:rp5] [gn:rps7b:j2186] [gtcfc:10.4] [keggfc:14.2] [sgdfc:5.1.0:9.2.0] [db:gtc-saccharomyces cerevisiae] |
| CONTIG4699 | 2117752_c3_9 | 5626 | 19729 | 357 | 119 | YKL156W | 316 | 1.8(10)-28 | Saccharomyces cerevisiae | [ui:ykl156w] [pn:ribosomal protein s27,e:40s ribosomal protein s27-1] [gn:rps27a] [gtcfc:10.4] [keggfc:14.2] [sgdfc:5.1.0:9.2.0] [db:gtc-saccharomyces cerevisiae] |
| CONTIG5791 | 33306557_c2_24 | 5627 | 19730 | 696 | 232 | YKL009W | 862 | 2.7(10)-86 | Saccharomyces cerevisiae | [ui:ykl009w] [pn:weak similarity to red goosefoot acidic ribosomal protein p0 and m.jannaschii acidic ribosomal protein p0:hypothetical 27.1 kd protein ufd4-cap1 intergenic region] [gn:ykl160] [gtcfc:10.4] [keggfc:14.2] [sgdfc:5.1.0] |
| CONTIG3549 | 25431253_c2_5 | 5628 | 19731 | 285 | 95 | YKL006W | 255 | 5.7(10)-22 | Saccharomyces cerevisiae | [ui:ykl006w] [pn:ribosomal protein:probable 60s ribosomal protein 114ea] [gn:rp114a:ykl153] [gtcfc:10.4] [keggfc:14.2] [sgdfc:5.1.0:9.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3386 | 4081505_c1_3 | 5629 | 19732 | 609 | 203 | YLL045C | 840 | 5.7(10)-84 | Saccharomyces cerevisiae | [ui:yll045c] [pn:ribosomal protein 17a.e.b:60s ribosomal protein 17a-1:14-1:y15:rp6] [gn:rp14b] [gtcfc:10.4] [keggfc:14.2] [sgdfc:5.1.0] [db:gtc-saccharomyces cerevisiae] |
| CONTIG4586 | 4770001_c3_7 | 5630 | 19733 | 798 | 266 | YLL045C | 993 | 3.5(10)-100 | Saccharomyces cerevisiae | [ui:yll045c] [pn:ribosomal protein 17a.e.b:60s ribosomal protein 17a-1:14-1:y15:rp6] [gn:rp14b] [gtcfc:10.4] [keggfc:14.2] [sgdfc:5.1.0] [db:gtc-saccharomyces cerevisiae] |
| CONTIG2752 | 20423136_f1_1 | 5631 | 19734 | 612 | 204 | YLR009W | 544 | 1.3(10)-52 | Saccharomyces cerevisiae | [ui:ylr009w] [pn:similarity to ribosomal protein l24.e.b] [gtcfc:10.4] [keggfc:14.2] [sgdfc:5.1.0] [db:gtc-saccharomyces cerevisiae] |
| CONTIG5362 | 24779507_c2_15 | 5632 | 19735 | 363 | 121 | YLR061W | 231 | 2.0(10)-19 | Saccharomyces cerevisiae | [ui:ylr061w] [pn:ribosomal protein:60s ribosomal protein y131] [gn:121168] [gtcfc:10.4] [keggfc:14.2] [sgdfc:5.1.0] [db:gtc-saccharomyces cerevisiae] |
| CONTIG1362 | 1363817_f3_2 | 5633 | 19736 | 198 | 66 | YLR075W | 233 | 1.2(10)-19 | Saccharomyces cerevisiae | [ui:ylr075w] [pn:ribosomal protein:ubiquinol-cytochrome c reductase complex subunit vi requiring protein] [gn:qsr1:grc5] [gtcfc:10.4:12.8] [keggfc:14.2] [sgdfc:3.8.0:5.1.0] [db:gtc-saccharomyces cerevisiae] |
| CONTIG4663 | 4453427_f2_2 | 5634 | 19737 | 753 | 251 | YLR075W | 916 | 5.0(10)-92 | Saccharomyces cerevisiae | [ui:ylr075w] [pn:ribosomal protein:ubiquinol-cytochrome c reductase complex subunit vi requiring protein] [gn:qsr1:grc5] [gtcfc:10.4:12.8] [keggfc:14.2] [sgdfc:3.8.0:5.1.0] [db:gtc-saccharomyces cerevisiae] |
| CONTIG3605 | 21539018_f3_3 | 5635 | 19738 | 189 | 63 | YLR287c-A | 189 | 5.5(10)-15 | Saccharomyces cerevisiae | [ui:ylr287c-a] [pn:ribosomal protein:strong similarity to human ubiquitin-like protein/ribosomal protein s30] [gn:rps30a:rps30b] [gtcfc:10.4] [keggfc:14.2] [sgdfc:5.1.0] [db:gtc-saccharomyces cerevisiae] |
| b3x14645.x | 12672056_c3_2 | 5636 | 19739 | 264 | 88 | YLR325C | 206 | 8.8(10)-17 | Saccharomyces cerevisiae | [ui:ylr325c] [pn:putative ribosomal protein 138:putative 60s ribosomal protein 138] [gn:18543] [sgdfc:5.1.0] [db:gtc-saccharomyces cerevisiae] |
| CONTIG4548 | 29332305_c3_7 | 5637 | 19740 | 315 | 105 | YLR340W | 142 | 1.8(10)-9 | Saccharomyces cerevisiae | [ui:ylr340w] [pn:acidic ribosomal |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4875 | 25835912_f3_5 | 5638 | 19741 | 525 | 175 | YLR340W | 594 | 6.7(10)-58 | Saccharomyces cerevisiae | protein 110.e:60s acidic ribosomal protein p0:110e [gn:rpla0:rpa0:rp110e:110e:18300] [gtcfc:10.4] [keggfc:14.2] [sgdfc:5.1.0:9.2.0] [db:gtc-saccharomyces cerevisiae] [ui:ylr340w] [pn:acidic ribosomal protein 110.e:60s acidic ribosomal protein p0:110e] [gn:rpla0:rpa0:rp110e:110e:18300] [gtcfc:10.4] [keggfc:14.2] [sgdfc:5.1.0:9.2.0] [db:gtc-saccharomyces cerevisiae] |
| CONTIG4263 | 24016512_c1_6 | 5639 | 19742 | 393 | 131 | YLR344W | 508 | 8.8(10)-49 | Saccharomyces cerevisiae | [ui:ylr344w] [pn:ribosomal protein:60s ribosomal protein 126-a:y133] [gn:rp133a:rp126a:rp:126:18300] [gtcfc:10.4] [keggfc:14.2] [sgdfc:5.1.0:9.2.0] [db:gtc-saccharomyces cerevisiae] |
| CONTIG4231 | 5338452_f1_1 | 5640 | 19743 | 399 | 133 | YML073C | 460 | 1.1(10)-43 | Saccharomyces cerevisiae | [ui:yml073c] [pn:ribosomal protein:60s ribosomal protein] [gn:y116a] [gtcfc:10.4] [keggfc:14.2] [sgdfc:5.1.0:9.2.0] [db-gtc-saccharomyces cerevisiae] |
| CONTIG4687 | 13671937_c2_11 | 5641 | 19744 | 843 | 281 | YML063W | 961 | 8.6(10)-97 | Saccharomyces cerevisiae | [ui:yml063w] [pn:ribosomal protein s3a.e:40s ribosomal protein rp10b] [gn:rp10b:rps10b:plc2] [gtcfc:10.4] [keggfc:14.2] [sgdfc:5.1.0:9.2.0] [db:gtc-saccharomyces cerevisiae] |
| CONTIG2652 | 13775442_f3_4 | 5642 | 19745 | 615 | 205 | YMR121C | 787 | 2.3(10)-78 | Saccharomyces cerevisiae | [ui:ymr121c] [pn:ribosomal protein 115.e.c13:60s ribosomal protein y110b:113:rp115:ryp18] [gn:rp113b:rp110b:y110b:ym8564] [gtcfc:10.4] [keggfc:14.2] [sgdfc:5.1.0:9.2.0] [db:gtc-saccharomyces cerevisiae] |
| b1x10611.y | 22742890_f2_2 | 5643 | 19746 | 324 | 108 | YMR188C | 174 | 2.2(10)-13 | Saccharomyces cerevisiae | [ui:ymr188c] [pn:weak similarity to 30s ribosomal protein s17] [gtcfc:10.4] [keggfc:14.2] [sgdfc:5.1.0] [db:gtc-saccharomyces cerevisiae] |
| CONTIG2692 | 15664802_c2_6 | 5644 | 19747 | 300 | 100 | YMR194W | 260 | 1.7(10)-22 | Saccharomyces cerevisiae | [ui:ymr194w] [pn:ribosomal protein:60s ribosomal protein y139] [gn:rp139:rp139:rp139b:ym9646] [gtcfc:10.4] [keggfc:14.2] [sgdfc:5.1.0:9.2.0] [db-gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3837 | 2928442_c3_9 | 5645 | 19748 | 342 | 114 | YMR230W | 292 | 6.7(10)-26 | Saccharomyces cerevisiae | [ui:ymr230w] [pn:strong similarity to ribosomal protein s10:putative 40s ribosomal protein in mtf1-rnh1 intergenic region] [gn:ym9959] [gtcfc:10.4] [keggfc:14.2] [sgdfc:5.1.0:9.2.0] [db:gtc-saccharomyces cerevisiae] |
| CONTIG3701 | 1054677_c2_7 | 5646 | 19749 | 561 | 187 | YMR242C | 738 | 3.7(10)-73 | Saccharomyces cerevisiae | [ui:ymr242c] [pn:ribosomal protein:60s ribosomal protein 118a] [gn:rp118a:rp118a1:ym9408] [gtcfc:10.4] [keggfc:14.2] [sgdfc:5.1.0:9.2.0] [db:gtc-saccharomyces cerevisiae] |
| CONTIG5802 | 24016500_f1_13 | 5647 | 19750 | 447 | 149 | YNL302C | 632 | 6.4(10)-62 | Saccharomyces cerevisiae | [ui:ynl302c] [pn:ribosomal protein s19.e:40s ribosomal protein s19b:s16b:ys16:rp55] [gn:rp55b:rps16b:n0422] [gtcfc:10.4] [keggfc:14.2] [sgdfc:5.1.0:9.2.0] [db:gtc-saccharomyces cerevisiae] |
| CONTIG3291 | 5132933_c3_9 | 5648 | 19751 | 495 | 165 | YNL301C | 571 | 1.8(10)-55 | Saccharomyces cerevisiae | [ui:ynl301c] [pn:ribosomal protein 118.e:ribosomal protein s18.e:60s ribosomal protein 118:rp28] [gn:rp28b:rp28a:n0425] [gtcfc:10.4] [keggfc:14.2] [sgdfc:5.1.0:9.2.0] [db:gtc-saccharomyces cerevisiae] |
| CONTIG5406 | 2189382_c3_12 | 5649 | 19752 | 864 | 288 | YNL284C | 650 | 7.9(10)-64 | Saccharomyces cerevisiae | [ui:ynl284c] [pn:similarity to ribosomal protein 115:mitochondrial 60s ribosomal protein 110 precursor:ym110] [gn:mrp110:n0580] [gtcfc:10.4] [keggfc:14.2] [sgdfc:5.1.0] [db:gtc-saccharomyces cerevisiae] |
| CONTIG1882 | 16605383_f1_2 | 5650 | 19753 | 393 | 131 | YNL185C | 359 | 5.4(10)-33 | Saccharomyces cerevisiae | [ui:ynl185c] [pn:strong similarity to ribosomal protein 111:putative 60s mitochondrial ribosomal protein ynl185c] [gn:n1623] [gtcfc:10.4] [keggfc:14.2] [sgdfc:5.1.0] [db:gtc-saccharomyces cerevisiae] |
| CONTIG3963 | 35672937_c2_5 | 5651 | 19754 | 192 | 64 | YNL185C | 154 | 2.8(10)-11 | Saccharomyces cerevisiae | [ui:ynl185c] [pn:strong similarity to ribosomal protein 111:putative 60s mitochondrial ribosomal protein ynl185c] [gn:n1623] [gtcfc:10.4] [keggfc:14.2] [sgdfc:5.1.0] [db:gtc-saccharomyces cerevisiae] |
| CONTIG617 | 25565962_f2_2 | 5652 | 19755 | 561 | 187 | YNL178W | 568 | 3.7(10)-55 | Saccharomyces | [ui:ynl178w] [pn:ribosomal protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | s3,e:40s ribosomal protein s3;ys3:rp13] [gn:rps3:suf14:n1653] [gtcfc:10.4] [keggfc:14.2] [sgdfc:5.1.0:9.2.0] [db:gtc-saccharomyces cerevisiae] |
| CONTIG5558 | 29378811_f3_9 | 5653 | 19756 | 336 | 112 | YNL162W | 526 | 1.1(10)-50 | Saccharomyces cerevisiae | [ui:ynl162w] [pn:ribosomal protein 136a.e] [gn:rp141a] [gtcfc:10.4] [keggfc:14.2] [sgdfc:5.1.0:9.2.0] [db:gtc-saccharomyces cerevisiae] |
| CONTIG5165 | 4878516_f2_6 | 5654 | 19757 | 378 | 126 | YNL081C | 287 | 2.2(10)-25 | Saccharomyces cerevisiae | [ui:ynl081c] [pn:similarity to ribosomal protein s13:putative 40s mitochondrial ribosomal protein ynl081c] [gn:n2322] [gtcfc:10.4] [keggfc:14.2] [sgdfc:5.1.0] [db:gtc-saccharomyces cerevisiae] |
| CONTIG1297 | 31382010_f1_1 | 5655 | 19758 | 186 | 62 | YNL067W | 200 | 3.7(10)-16 | Saccharomyces cerevisiae | [ui:ynl067w] [pn:ribosomal protein 19_e.cl4:60s ribosomal protein 19 by111:rp25] [gn:rp19b:n2406:ynl2406w] [gtcfc:10.4] [keggfc:14.2] [sgdfc:5.1.0:9.2.0] [db:gtc-saccharomyces cerevisiae] |
| CONTIG3671 | 4954192_c2_3 | 5656 | 19759 | 399 | 133 | YNL002C | 156 | 5.7(10)-11 | Saccharomyces cerevisiae | [ui:ynl002c] [pn:ribosomal protein 17.e:60s ribosomal protein 17] [gn:rp17:rlp7:n2014] [gtcfc:10.4] [keggfc:14.2] [sgdfc:5.1.0] [db:gtc-saccharomyces cerevisiae] |
| CONTIG5057 | 24428437_f2_2 | 5657 | 19760 | 381 | 127 | YNL002C | 146 | 7.5(10)-10 | Saccharomyces cerevisiae | [ui:ynl002c] [pn:ribosomal protein 17.e:60s ribosomal protein 17] [gn:rp17:rlp7:n2014] [gtcfc:10.4] [keggfc:14.2] [sgdfc:5.1.0] [db:gtc-saccharomyces cerevisiae] |
| CONTIG1854 | 12610930_f1_1 | 5658 | 19761 | 591 | 197 | YNR036C | 423 | 8.9(10)-40 | Saccharomyces cerevisiae | [ui:ynr036c] [pn:strong similarity to ribosomal protein s12:putative 40s mitochondrial ribosomal protein ynr036c] [gn:n3298] [gtcfc:10.4] [keggfc:14.2] [sgdfc:5.1.0] [db:gtc-saccharomyces cerevisiae] |
| CONTIG653 | 12610930_f3_2 | 5659 | 19762 | 597 | 199 | YNR036C | 420 | 1.8(10)-39 | Saccharomyces cerevisiae | [ui:ynr036c] [pn:strong similarity to ribosomal protein s12:putative 40s mitochondrial ribosomal protein ynr036c] [gn:n3298] [gtcfc:10.4] [keggfc:14.2] [sgdfc:5.1.0] [db:gtc-saccharomyces cerevisiae] |
| CONTIG5496 | 1953127_c2_16 | 5660 | 19763 | 438 | 146 | YOL127W | 527 | 8.5(10)-51 | Saccharomyces cerevisiae | [ui:yol127w] [pn:ribosomal protein 123a.e:60s ribosomal protein 125:y125:rp611] [gn:rp125] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4890 | 24804625_c3_9 | 5661 | 19764 | 387 | 129 | YOL040C | 339 | 7.0(10)-31 | *Saccharomyces cerevisiae* | [ui:yol040c] [pn:ribosomal protein:40s ribosomal protein s15:ys21:rp52:rig protein] [gn:rps15:rps21] [gtcfc:10.4] [keggfc:14.2] [sgdfc:5.1.0:9.2.0] [db:gtc-*saccharomyces cerevisiae*] |
| CONTIG3180 | 1408438_c2_9 | 5662 | 19765 | 426 | 142 | YOR063W | 466 | 2.5(10)-44 | *Saccharomyces cerevisiae* | [ui:yor063w] [pn:ribosomal protein 13:e60s ribosomal protein 13:trichodermin resistance protein:y11:rp1] [gn:tcm1:mak8] [gtcfc:10.4] [keggfc:14.2] [sgdfc:5.1.0:9.2.0] [db:gtc-*saccharomyces cerevisiae*] |
| b1x11845.x | 10167087_c2_1 | 5663 | 19766 | 801 | 267 | YOR096W | 666 | 1.6(10)-65 | *Saccharomyces cerevisiae* | [ui:yor096w] [pn:ribosomal protein:40s ribosomal protein rp30] [gn:rp30:yor3177w:rps30] [gtcfc:10.4] [keggfc:14.2] [sgdfc:5.1.0:9.2.0] [db:gtc-*saccharomyces cerevisiae*] |
| CONTIG5608 | 4882938_c1_18 | 5664 | 19767 | 471 | 157 | YOR369C | 453 | 5.9(10)-43 | *Saccharomyces cerevisiae* | [ui:yor369c] [pn:acidic ribosomal protein s12:40s ribosomal protein s12] [gn:rs12:rps12] [gtcfc:10.4] [keggfc:14.2] [sgdfc:5.1.0:9.2.0] [db:gtc-*saccharomyces cerevisiae*] |
| CONTIG5797 | 3906261_c3_33 | 5665 | 19768 | 318 | 106 | YPL143W | 445 | 4.2(10)-42 | *Saccharomyces cerevisiae* | [ui:ypl143w] [pn:ribosomal protein 135a.e.c16:60s ribosomal protein 137a:yl137:rp47] [gn:rp137a:lpi4w:rp2625] [gtcfc:10.4] [keggfc:14.2] [sgdfc:5.1.0:9.2.0] [db:gtc-*saccharomyces cerevisiae*] |
| CONTIG5634 | 9791087_c3_29 | 5666 | 19769 | 408 | 136 | YPL131W | 331 | 5.0(10)-30 | *Saccharomyces cerevisiae* | [ui:ypl131w] [pn:ribosomal protein 15.e60s ribosomal protein 11:15:y13:ribosomal 5 s rna-binding protein] [gn:rp11:lpi14w] [gtcfc:10.4] [keggfc:14.2] [sgdfc:5.1.0:9.2.0] [db:gtc-*saccharomyces cerevisiae*] |
| CONTIG5634 | 12110026_c2_25 | 5667 | 19770 | 636 | 212 | YPL131W | 630 | 1.0(10)-61 | *Saccharomyces cerevisiae* | [ui:ypl131w] [pn:ribosomal protein 15.e60s ribosomal protein 11:15:y13:ribosomal 5 s rna-binding protein] [gn:rp11:lpi14w] [gtcfc:10.4] [keggfc:14.2] [sgdfc:5.1.0:9.2.0] [db:gtc-*saccharomyces cerevisiae*] |
| CONTIG3400 | 31501_f3_4 | 5668 | 19771 | 300 | 100 | YPR043W | 259 | 2.1(10)-22 | *Saccharomyces cerevisiae* | [ui:ypr043w] [pn:ribosomal protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3918 | 24432842_c3_6 | 5669 | 19772 | 870 | 290 | YDL143W | 881 | 2.6(10)-88 | Saccharomyces cerevisiae | 137a:e;probable 60s ribosomal protein 137a] [gn:yp9499] [gtcfc:10.4] [keggfc:14.2] [sgdfc:5.1.0:9.2.0] [db:gtc-saccharomyces cerevisiae] [ui:ydl143w] [pn:component of chaperonin-containing t-complext-complex protein 1, delta subunit:tcp-1-delta:cct-delta] [gn:cct4:tcp4:anc2] [gtcfc:10.5:10.7:12.7] [keggfc:14.2] [sgdfc:6.1.0:9.2.0] [db:gtc-saccharomyces cerevisiae] |
| b9x11364.y | 24665678_c3_2 | 5670 | 19773 | 555 | 185 | YDL143W | 705 | 1.2(10)-69 | Saccharomyces cerevisiae | [ui:ydl143w] [pn:component of chaperonin-containing t-complext-complex protein 1, delta subunit:tcp-1-delta:cct-delta] [gn:cct4:tcp4:anc2] [gtcfc:10.5:10.7:12.7] [keggfc:14.2] [sgdfc:6.1.0:9.2.0] [db:gtc-saccharomyces cerevisiae] |
| CONTIG4653 | 1179503_c3_10 | 5671 | 19774 | 246 | 82 | YDR155C | 227 | 5.2(10)-19 | Saccharomyces cerevisiae | [ui:ydr155c] [pn:peptidylprolyl isomerase:epeptidyl-prolyl cis-trans isomerase:ppiase:rotamase:cyclophilin:cyclosporin a-binding protein:cph:ppi-ii] [gn:cpr1:cyp1:cph1:scc1:yd8358] [gtcfc:10.5:10.7:12.7:13.2:14.1] [ec:5.2.1.8] [keggfc: |
| CONTIG5279 | 35781556_c1_11 | 5672 | 19775 | 207 | 69 | YDR155C | 236 | 5.7(10)-20 | Saccharomyces cerevisiae | [ui:ydr155c] [pn:peptidylprolyl isomerase:epeptidyl-prolyl cis-trans isomerase:ppiase:rotamase:cyclophilin:cyclosporin a-binding protein:cph:ppi-ii] [gn:cpr1:cyp1:cph1:scc1:yd8358] [gtcfc:10.5:10.7:12.7:13.2:14.1] [ec:5.2.1.8] [keggfc: |
| CONTIG626 | 107761050_c2_4 | 5673 | 19776 | 1185 | 395 | YDR188W | 1303 | 5.0(10)-133 | Saccharomyces cerevisiae | [ui:ydr188w] [pn:component of chaperonin-containing t-complex:zeta subunit:tcp-1-zeta:cct-zeta] [gn:cct6:tcp6:tcp20:yd9395] [gtcfc:10.5:10.7:12.7] [keggfc:14.2] [sgdfc:6.1.0:9.2.0] [db:gtc-saccharomyc |
| CONTIG5630 | 4798262_f3_9 | 5674 | 19777 | 1677 | 559 | YDR212W | 2163 | 3.7(10)-224 | Saccharomyces cerevisiae | [ui:ydr212w] [pn:component of chaperonin-containing t-complext-complex protein 1, alpha |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4322 | 78192_c3_5 | 5675 | 19778 | 867 | 289 | YDR304C | 455 | 3.6(10)-43 | Saccharomyces cerevisiae | subunit:tcp-1-alpha:cct-alpha] [gn:cct1:tcp1:yd8142] [gtcfc:10.5:10.7:12.7] [keggfc:14.2] [sgdfc:6.10.9.2.0] [db:gtc-saccharomyces cerevisiae] [ui:ydr304c] [pn:cyclophilin d of the er:peptidyl-prolyl cis-trans isomerase d precursor:ppiase:rotamase:cyclophilin d] [gn:cpr5:cyp5:cypd:d9740] [gtcfc:10.5:10.7:12.16:12.7] [ec:5.2.1.8] [keggfc:14.1] |
| CONTIG5744 | 32711061_c3_32 | 5676 | 19779 | 741 | 247 | YDR304C | 504 | 2.2(10)-48 | Saccharomyces cerevisiae | [sgdfc:6.1.0:9.4.0] [db:gtc-sacc] [ui:ydr304c] [pn:cyclophilin d of the er:peptidyl-prolyl cis-trans isomerase d precursor:ppiase:rotamase:cyclophilin d] [gn:cpr5:cyp5:cypd:d9740] [gtcfc:10.5:10.7:12.16:12.7] [ec:5.2.1.8] [keggfc:14.1] |
| CONTIG1065 | 23453438_c2_1 | 5677 | 19780 | 363 | 121 | YDR519W | 250 | 1.8(10)-21 | Saccharomyces cerevisiae | [sgdfc:6.1.0:9.4.0] [db:gtc-sacc] [ui:ydr519w] [pn:fk506/rapamycin-binding protein of the er:fk506-binding protein precursor:fkbp-13:fkbp-15:peptidyl-prolyl cis-trans isomerase:ppiase] [gn:fpr2:fkb2:d9719] [gtcfc:10.5:10.7:12.16:12.7:13.2] [ec:5.2.1.8] [keggfc:14.1] |
| CONTIG2082 | 4688425_f3_1 | 5678 | 19781 | 927 | 309 | YER048C | 154 | 9.8(10)-9 | Saccharomyces cerevisiae | [ui:yer048c] [pn:dnaj homolog:protein] [gn:caj1] [gtcfc:10.5:10.7:12.7] [keggfc:14.2] [sgdfc:6.10] [db-gtc-saccharomyces cerevisiae] |
| CONTIG3227 | 3932812_f1_1 | 5679 | 19782 | 609 | 203 | YER048C | 163 | 3.2(10)-17 | Saccharomyces cerevisiae | [ui:yer048c] [pn:dnaj homolog:protein] [gn:caj1] [gtcfc:10.5:10.7:12.7] [keggfc:14.2] [sgdfc:6.1.0] [db:gtc-saccharomyces cerevisiae] |
| CONTIG4756 | 3320192_c2_13 | 5680 | 19783 | 591 | 197 | YER048C | 215 | 2.8(10)-17 | Saccharomyces cerevisiae | [ui:yer048c] [pn:dnaj homolog:protein] [gn:caj1] [gtcfc:10.5:10.7:12.7] [keggfc:14.2] [sgdfc:6.1.0] [db:gtc-saccharomyces cerevisiae] |
| CONTIG4472 | 34259382_c2_4 | 5681 | 19784 | 1017 | 339 | YFR041C | 334 | 2.3(10)-30 | Saccharomyces cerevisiae | [ui:yfr041c] [pn:weak similarity to dnaj-like heat shock proteins:hypothetical 34.2 kd protein in sap155-ymr31 intergenic region precursor] [gtcfc:12.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG883 | 882781_c2_4 | 5682 | 19785 | 870 | 290 | YIL142W | 1022 | 3.0(10)-103 | *Saccharomyces cerevisiae* | [keggfc:14.2] [sgdfc:6.1.0] [dbgtc-*saccharomyces cerevisiae*] [ui:yil142w] [pn:chaperonin of the tcp1 ring complex, cytosolict-complex protein 1, beta subunit:tcp1-beta:cct-beta] [gn:cct2:tcp2:bin3] [gtcfc:10.5:10.7:12.7] |
| CONTIG3227 | 24417882_f3_2 | 5683 | 19786 | 300 | 100 | YIR004W | 164 | 1.6(10)-11 | *Saccharomyces cerevisiae* | [keggfc:14.2] [sgdfc:6.10.9.2.0] [db-gtc-*saccharomyces cerevisiae*] [ui:yir004w] [pn:similarity to caj1p, ydj1p and to dnaj-like proteins:hypothetical 48.6 kd protein in bet1-pan1 intergenic region] [gn:yib4w] [gtcfc:10.5:10.7:12.7] |
| CONTIG3906 | 2834632_f1_1 | 5684 | 19787 | 1548 | 516 | YIR004W | 375 | 6.0(10)-86 | *Saccharomyces cerevisiae* | [keggfc:14.2] [sgdfc:6.1.0] [dbgtc-*saccharomyces cerevisiae*] [ui:yir004w] [pn:similarity to caj1p, ydj1p and to dnaj-like proteins:hypothetical 48.6 kd protein in bet1-pan1 intergenic region] [gn:yib4w] [gtcfc:10.5:10.7:12.7] |
| CONTIG4172 | 9788936_c3_4 | 5685 | 19788 | 1461 | 487 | YJL111W | 1803 | 5.2(10)-186 | *Saccharomyces cerevisiae* | [keggfc:14.2] [sgdfc:6.1.0] [dbgtc-*saccharomyces cerevisiae*] [ui:yjl111w] [pn:component of chaperonin-containing t-complex:t-complex protein 1, eta subunit:tcp1-eta:cct7:j0804] [gtcfc:10.5:10.7:12.7] |
| CONTIG5775 | 23829512_c2_26 | 5686 | 19789 | 2079 | 693 | YJL034W | 2374 | 1.6(10)-246 | *Saccharomyces cerevisiae* | [keggfc:14.2] [sgdfc:6.10.9.2.0] [db:gtc-*saccharomyces cerevisiae*] [ui:yjl034w] [pn:nuclear fusion protein:78 kd glucose regulated protein homolog precursor:grp 78:immunoglobulin heavy chain binding protein homolog:bip] [gn:kar2:ssd1:grp78:j1248] [gtcfc:10.5:10.7:11.1:12.16:12.7:1 2.8] [keggfc:14.2] [ |
| CONTIG5204 | 21522577_c2_4 | 5687 | 19790 | 1590 | 530 | YJL014W | 2030 | 4.5(10)-210 | *Saccharomyces cerevisiae* | [ui:yjl014w] [pn:chaperonin of the tcp1 ring complex, cytosolict-complex protein 1, gamma subunit:tcp-1-gamma:cct-gamma] [gn:cct3:tcp3:bin2:j1336] [gtcfc:10.5:10.7:12.7] [keggfc:14.2] [sgdfc:6.10.9.2.0] [db:*saccharomyces cerevi* |
| CONTIG2981 | 24024074_c1_6 | 5688 | 19791 | 1473 | 491 | YJL008C | 1546 | 8.9(10)-159 | *Saccharomyces* | [ui:yjl008c] [pn:component of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | chaperonin-containing t-complex:t-complex protein 1, theta subunit:tcp-1-theta:cct-theta [gn:cct8:j1374] [gtcfc:10.5:10.7:12.7] [keggfc:14.2] [sgdfc:6.1.0:9.2.0] [db:gtc-saccharomyces cerevisiae] |
| CONTIG5230 | 22672051_c1_13 | 5689 | 19792 | 1701 | 567 | YJR064W | 2039 | 5.0(10)-211 | Saccharomyces cerevisiae | [ui:yjr064w] [pn:t-complex protein 1, epsilon subunit:tcp-1-epsilon] [gn:cct5:tcp5:j1752] [gtcfc:10.5:10.7:12.7] [keggfc:14.2] [sgdfc:6.1.0:9.2.0] [db:gtc-saccharomyces cerevisiae] |
| CONTIG5289 | 267012_f1_2 | 5690 | 19793 | 477 | 159 | YJR097W | 264 | 6.2(10)-23 | Saccharomyces cerevisiae | [ui:yjr097w] [pn:weak similarity to caj1p:hypothetical 20.0 kd protein in acr1-yuh1 intergenic region] [gn:j1931] [gtcfc:10.5:10.7:12.7] [keggfc:14.2] [sgdfc:6.1.0] [db:gtc-saccharomyces cerevisiae] |
| CONTIG4803 | 10171900_c1_8 | 5691 | 19794 | 2055 | 685 | YKL073W | 692 | 2.7(10)-68 | Saccharomyces cerevisiae | [ui:ykl073w] [pn:chaperone of the er lumen:heat shock protein 70 homolog lhs1 precursor] [gn:lhs1:yk1355] [gtcfc:12.7.12.16:11.1] [keggfc:14.2] [sgdfc:6.1.0:6.2.0:9.4.0] [db:gtc-saccharomyces cerevisiae] |
| CONTIG3857 | 4103453_f1_1 | 5692 | 19795 | 1107 | 369 | YLR449W | 476 | 8.0(10)-62 | Saccharomyces cerevisiae | [ui:ylr449w] [pn:strong similarity to peptidylprolyl isomerase fpr3p] [gtcfc:10.5:10.7:12.7] [keggfc:14.2] [sgdfc:6.1.0] [db:gtc-saccharomyces cerevisiae] |
| CONTIG862 | 20431663_f3_2 | 5693 | 19796 | 564 | 188 | YLR449W | 95 | 0.023 | Saccharomyces cerevisiae | [ui:ylr449w] [pn:strong similarity to peptidylprolyl isomerase fpr3p] [gtcfc:10.5:10.7:12.7] [keggfc:14.2] [sgdfc:6.1.0] [db:gtc-saccharomyces cerevisiae] |
| CONTIG3583 | 30660886_f3_3 | 5694 | 19797 | 288 | 96 | YMR161W | 251 | 1.5(10)-21 | Saccharomyces cerevisiae | [ui:ymr161w] [pn:similarity to dnaj proteins:hlj1 protein] [gn:hlj1:ym8520] [gtcfc:10.5:10.7:12.7] [keggfc:14.2] [sgdfc:6.1.0] [db:gtc-saccharomyces cerevisiae] |
| CONTIG4414 | 24390652_f1_1 | 5695 | 19798 | 357 | 119 | YNL227C | 280 | 8.0(10)-24 | Saccharomyces cerevisiae | [ui:ynl227c] [pn:weak similarity to dnaj-like proteins:hypothetical 68.8 kd protein in ure2-ssu72 intergenic region] [gn:n1254] [gtcfc:10.5:10.7:12.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4414 | 23923442_f2_3 | 5696 | 19799 | 1299 | 433 | YNL227C | 247 | 1.5(10)-41 | Saccharomyces cerevisiae | [keggfc:14.2] [sgdfc:6.1.0] [db:gtc-saccharomyces cerevisiae] [ui:ynl227c] [pn:weak similarity to dnaj-like proteins:hypothetical 68.8 kd protein in ure2-ssu72 intergenic region] [gnn1254] [gtcfc:10.5:10.7:12.7] |
| CONTIG1898 | 15022061_f2_2 | 5697 | 19800 | 918 | 306 | YOR288C | 452 | 7.5(10)-43 | Saccharomyces cerevisiae | [keggfc:14.2] [sgdfc:6.1.0] [db:gtc-saccharomyces cerevisiae] [ui:yor288c] [pn:disulfide isomerase related protein] [gn:mpd1] [gtcfc:10.11:2.7] [keggfc:14.2] [sgdfc:6.1.0] [db:gtc-saccharomyces cerevisiae] |
| CONTIG5499 | 12_c3_13 | 5698 | 19801 | 1992 | 664 | YDR341C | 1345 | 2.8(10)-209 | Saccharomyces cerevisiae | [ui:ydr341c] [pn:strong similarity to arginine-trna ligase] [gtcfc:10.6] [keggfc:14.2] [sgdfc:5.4.0] [db:gtc-saccharomyces cerevisiae] |
| CONTIG5735 | 26798200_c1_13 | 5699 | 19802 | 642 | 214 | YOL097C | 690 | 4.5(10)-68 | Saccharomyces cerevisiae | [ui:yol097c] [pn:tryptophan-trna ligase] [gn:wrs1] [gtcfc:10.6] [keggfc:14.2] [sgdfc:5.4.0.9.2.0] [db:gtc-saccharomyces cerevisiae] |
| CONTIG5735 | 26196061_c2_18 | 5700 | 19803 | 768 | 256 | YOL097C | 1010 | 5.5(10)-102 | Saccharomyces cerevisiae | [ui:yol097c] [pn:tryptophan-trna ligase] [gn:wrs1] [gtcfc:10.6] [keggfc:14.2] [sgdfc:5.4.0.9.2.0] [db:gtc-saccharomyces cerevisiae] |
| CONTIG2571 | 24501442_f2_2 | 5701 | 19804 | 1308 | 436 | YHR006W | 393 | 1.3(10)-36 | Saccharomyces cerevisiae | [ui:yhr006w] [pn:involved in pre-trna splicing:putative 60.8 kd zinc finger protein in gpa1-erg11 intergenic region] [gn:stp2] [gtcfc:10.6] [keggfc:14.2] [sgdfc:4.5.0] [db:gtc-saccharomyces cerevisiae] |
| CONTIG5303 | 9957192_c1_10 | 5702 | 19805 | 1329 | 443 | YHR006W | 354 | 3.2(10)-32 | Saccharomyces cerevisiae | [ui:yhr006w] [pn:involved in pre-trna splicing:putative 60.8 kd zinc finger protein in gpa1-erg11 intergenic region] [gn:stp2] [gtcfc:10.6] [keggfc:14.2] [sgdfc:4.5.0] [db:gtc-saccharomyces cerevisiae] |
| CONTIG5764 | 4895137_c3_31 | 5703 | 19806 | 1182 | 394 | YHR006W | 119 | 0.00023 | Saccharomyces cerevisiae | [ui:yhr006w] [pn:involved in pre-trna splicing:putative 60.8 kd zinc finger protein in gpa1-erg11 intergenic region] [gn:stp2] [gtcfc:10.6] [keggfc:14.2] [sgdfc:4.5.0] [db:gtc-saccharomyces cerevisiae] |
| CONTIG4159 | 79186_f1_1 | 5704 | 19807 | 774 | 258 | YHR163W | 497 | 1.3(10)-47 | Saccharomyces cerevisiae | [ui:yhr163w] [pn:weak multicopy suppressor of los1-1:protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5654 | 4735640_c3_17 | 5705 | 19808 | 1371 | 457 | YLR375W | 249 | 1.5(10)-20 | *Saccharomyces cerevisiae* | [gn:sol3] [gtcfc:10.6] [keggfc:14.2] [sgdfc:4.5.0] [dbgtc-*saccharomyces cerevisiae*] [ui:ylr375w] [pn:involved in pre-trna splicing and in uptake of branched-chain amino acids] [gn:stp3] [gtcfc:10.6.12.1] [keggfc:14.2] [gtcfc:1.1.3:4.5.0] [db:gtc-*saccharomyces cerevisiae*] |
| CONTIG4402 | 24489005_c1_4 | 5706 | 19809 | 1104 | 368 | YNR034W | 894 | 6.9(10)-100 | *Saccharomyces cerevisiae* | [ui:ynr034w] [pn:multicopy suppressor of los1-1:sol1 protein] [gn:sol1:n3291] [gtcfc:10.6] [keggfc:14.2] [sgdfc:4.5.0] [dbgtc-*saccharomyces cerevisiae*] |
| CONTIG5140 | 4688933_c3_12 | 5707 | 19810 | 744 | 248 | YOL102C | 371 | 2.8(10)-34 | *Saccharomyces cerevisiae* | [ui:yol102c] [pn:trna 2''-phosphotransferase] [gn:tpt1] [gtcfc:10.6] [keggfc:14.2] [sgdfc:4.5.0] [dbgtc-*saccharomyces cerevisiae*] |
| CONTIG5385 | 4492160_c2_12 | 5708 | 19811 | 1260 | 420 | YFR010W | 663 | 3.2(10)-65 | *Saccharomyces cerevisiae* | [ui:yfr010w] [pn:similarity to c.elegans trna-guanine transglycosylase:putative ubiquitin carboxyl-terminal hydrolase yfr010w:ubiquitin thiolesterase:ubiquitin-specific processing protease:deubiquitinating enzyme] [gtcfc:10.6:10.11] |
| CONTIG2795 | 36110408_c3_7 | 5709 | 19812 | 648 | 216 | YGL105W | 542 | 2.2(10)-52 | *Saccharomyces cerevisiae* | [ui:ygl105w] [pn:protein with specific affinity for g4 quadruplex nucleic acids:gu4 nucleic-binding protein 1:p42:arc1 protein] [gn:g4p1:arc1:g3085] [gtcfc:10.6] [keggfc:14.2] [sgdfc:4.6.0] [dbgtc-*saccharomyces cerevisiae*] |
| CONTIG5624 | 26360285_f2_4 | 5710 | 19813 | 525 | 175 | YGL105W | 266 | 3.8(10)-23 | *Saccharomyces cerevisiae* | [ui:ygl105w] [pn:protein with specific affinity for g4 quadruplex nucleic acids:gu4 nucleic-binding protein 1:p42:arc1 protein] [gn:g4p1:arc1:g3085] [gtcfc:10.6] [keggfc:14.2] [sgdfc:4.6.0] [dbgtc-*saccharomyces cerevisiae*] |
| CONTIG990 | 4768913_f2_1 | 5711 | 19814 | 690 | 230 | YGL105W | 191 | 1.2(10)-14 | *Saccharomyces cerevisiae* | [ui:ygl105w] [pn:protein with specific affinity for g4 quadruplex nucleic acids:gu4 nucleic-binding protein 1:p42:arc1 protein] [gn:g4p1:arc1:g3085] [gtcfc:10.6] [keggfc:14.2] [sgdfc:4.6.0] [dbgtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3516 | 23849143_c2_7 | 5712 | 19815 | 714 | 238 | YAL003W | 529 | 5.2(10)-51 | Saccharomyces cerevisiae | [ui:yal003w] [pn:translation elongation factor eef1beta:elongation factor 1-beta] [gn:efb1:tef5] [gcfc:10.7] [keggfc:14.2] [sgdfc:5.2.0.9.2.0] [db:gtc-saccharomyces cerevisiae] |
| CONTIG292 | 14875252_f2_2 | 5713 | 19816 | 525 | 175 | YBL091C | 173 | 9.5(10)-13 | Saccharomyces cerevisiae | [ui:ybl091c] [pn:methionine aminopeptidase, isoform 2:methionine aminopeptidase 2:metap 2:peptidase m 2] [gn:map2:ybl0701] [gcfc:10.7] [ec:3.4.11.18] [keggfc:14.1] [sgdfc:5.2.0.6.3.0] [db:gtc-saccharomyces cerevisiae] |
| CONTIG4487 | 16828377_f3_1 | 5714 | 19817 | 1323 | 441 | YBL091C | 1062 | 1.7(10)-107 | Saccharomyces cerevisiae | [ui:ybl091c] [pn:methionine aminopeptidase, isoform 2:methionine aminopeptidase 2:metap 2:peptidase m 2] [gn:map2:ybl0701] [gcfc:10.7] [ec:3.4.11.18] [keggfc:14.1] [sgdfc:5.2.0.6.3.0] [db:gtc-saccharomyces cerevisiae] |
| CONTIG3041 | 36362805_f1_2 | 5715 | 19818 | 615 | 205 | YBR118W | 923 | 9.3(10)-93 | Saccharomyces cerevisiae | [ui:ybr118w] [pn:translation elongation factor eef1 alpha-a chain, cytosolic:elongation factor 1-alpha:ef-1-alpha] [gn:tef2;ybr0913:tef1p9513] [gcfc:10.7] [keggfc:14.2] [sgdfc:5.2.0.9.2.0] [db:gtc-saccharomyces cerevisiae] |
| CONTIG5539 | 36362805_f1_2 | 5716 | 19819 | 1383 | 461 | YBR118W | 2083 | 1.1(10)-215 | Saccharomyces cerevisiae | [ui:ybr118w] [pn:translation elongation factor eef1 alpha-a chain, cytosolic:elongation factor 1-alpha:ef-1-alpha] [gn:tef2;ybr0913:tef1p9513] [gcfc:10.7] [keggfc:14.2] [sgdfc:5.2.0.9.2.0] [db:gtc-saccharomyces cerevisiae] |
| CONTIG5583 | 4964037_c2_16 | 5717 | 19820 | 1320 | 440 | YBR143C | 1766 | 4.2(10)-182 | Saccharomyces cerevisiae | [ui:ybr143c] [pn:translational release factor:eukaryotic peptide chain release factor subunit 1:erf1:omnipotent suppressor protein 1] [gn:sup1:sup45:sal4:ybr1120] [gcfc:10.7] [keggfc:14.2] [sgdfc:5.2.0.9.2.0] [db:gtc-saccharomyces cerevisiae] |
| CONTIG5804 | 21928252_c3_69 | 5718 | 19821 | 1086 | 362 | YDL084W | 1542 | 2.3(10)-158 | Saccharomyces cerevisiae | [ui:ydl084w] [pn:strong similarity to nuclear rna helicase:dead family] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5804 | 5250252_c2_56 | 5719 | 19822 | 201 | 67 | YDL084W | 189 | 3.2(10)-14 | Saccharomyces cerevisiae | [gtcfc:10.7] [keggfc:14.2] [sgdfc:5.2.0] [dbgtc-saccharomyces cerevisiae] [ui:ydl084w] [pn:strong similarity to nuclear rna helicase:dead family] [gtcfc:10.7] [keggfc:14.2] [sgdfc:5.2.0] [dbgtc-saccharomyces cerevisiae] |
| CONTIG5421 | 26600300_c2_10 | 5720 | 19823 | 1206 | 402 | YDR021W | 1323 | 3.7(10)-135 | Saccharomyces cerevisiae | [ui:ydr021w] [pn:strong similarity to human translation initiation factor eif4a homolog] [gtcfc:10.7] [keggfc:14.2] [sgdfc:5.2.0] [dbgtc-saccharomyces cerevisiae] |
| CONTIG228 | 7276031_f3_3 | 5721 | 19824 | 477 | 159 | YDR172W | 117 | 3.7(10)-6 | Saccharomyces cerevisiae | [ui:ydr172w] [pn:eukaryotic peptide chain release factor gtp-binding subunit:erf2:omnipotent suppressor protein 2:erf3:erf-3:g1 to s phase transition protein 1] [gn:sup2:sup35:suf12:gst1:sal3:pn m2:yd9395] [gtcfc:10.7:12.8] [keggfc:14. |
| CONTIG2600 | 433217_f1_1 | 5722 | 19825 | 420 | 140 | YDR172W | 129 | 1.8(10)-7 | Saccharomyces cerevisiae | [ui:ydr172w] [pn:eukaryotic peptide chain release factor gtp-binding subunit:erf2:omnipotent suppressor protein 2:erf3:erf-3:g1 to s phase transition protein 1] [gn:sup2:sup35:suf12:gst1:sal3:pn m2:yd9395] [gtcfc:10.7:12.8] [keggfc:14. |
| CONTIG2600 | 22290936_f2_3 | 5723 | 19826 | 534 | 178 | YDR172W | 386 | 3.6(10)-35 | Saccharomyces cerevisiae | [ui:ydr172w] [pn:eukaryotic peptide chain release factor gtp-binding subunit:erf2:omnipotent suppressor protein 2:erf3:erf-3:g1 to s phase transition protein 1] [gn:sup2:sup35:suf12:gst1:sal3:pn m2:yd9395] [gtcfc:10.7:12.8] [keggfc:14. |
| CONTIG2600 | 36033263_f3_5 | 5724 | 19827 | 192 | 64 | YDR172W | 300 | 8.0(10)-26 | Saccharomyces cerevisiae | [ui:ydr172w] [pn:eukaryotic peptide chain release factor gtp-binding subunit:erf2:omnipotent suppressor protein 2:erf3:erf-3:g1 to s phase transition protein 1] [gn:sup2:sup35:suf12:gst1:sal3:pn m2:yd9395] [gtcfc:10.7:12.8] [keggfc:14. |
| CONTIG2600 | 9970452_f3_6 | 5725 | 19828 | 831 | 277 | YDR172W | 1032 | 2.6(10)-104 | Saccharomyces cerevisiae | [ui:ydr172w] [pn:eukaryotic peptide chain release factor gtp-binding subunit:erf2:omnipotent suppressor protein 2:erf3:erf-3:g1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5345 | 14711558_c3_21 | 5726 | 19829 | 2163 | 721 | YDR211W | 1422 | 1.2(10)-145 | Saccharomyces cerevisiae | to s phase transition protein 1] [gn:sup2:sup35:suf12:gst1:sal3:pn m2:yd9395] [gtcfc:10.7:12.8] [keggfc:14. [ui:ydr211w] [pn:translation initiation factor eif2b epsilon, 81 kda subunit:translation initiation factor eif-2b-epsilon subunit:eif-2b gdp-gtp exchange factor:guanine nucleotide exchange factor subunit gcd6:gcd complex subunit gcd6] |
| CONTIG5306 | 10641063_c3_16 | 5727 | 19830 | 1458 | 486 | YDR385W | 2139 | 1.3(10)-221 | Saccharomyces cerevisiae | [ui:ydr385w] [pn:translation elongation factor eef2:elongation factor 2:ef-2] [gn:eft2:eft1:o3317] [gtcfc:10.7] [keggfc:14.2] [sgdfc:5.2.0:9.2.0] [db:gtc-saccharomyces cerevisiae] |
| CONTIG5306 | 5100713_c3_15 | 5728 | 19831 | 714 | 238 | YDR385W | 1011 | 4.4(10)-102 | Saccharomyces cerevisiae | [ui:ydr385w] [pn:translation elongation factor eef2:elongation factor 2:ef-2] [gn:eft2:eft1:o3317] [gtcfc:10.7] [keggfc:14.2] [sgdfc:5.2.0:9.2.0] [db:gtc-saccharomyces cerevisiae] |
| CONTIG5306 | 6672140_c2_12 | 5729 | 19832 | 426 | 142 | YDR385W | 620 | 1.2(10)-60 | Saccharomyces cerevisiae | [ui:ydr385w] [pn:translation elongation factor eef2:elongation factor 2:ef-2] [gn:eft2:eft1:o3317] [gtcfc:10.7] [keggfc:14.2] [sgdfc:5.2.0:9.2.0] [db:gtc-saccharomyces cerevisiae] |
| CONTIG4326 | 25391536_f1_2 | 5730 | 19833 | 462 | 154 | YEL034W | 674 | 2.2(10)-66 | Saccharomyces cerevisiae | [ui:yel034w] [pn:translation initiation factor eif5a.1:initiation factor 5a-2:eif-5a:eif-4d:hypusine containing protein hp2] [gn:hyp2:tif51a:sygp-orf21] [gtcfc:10.7] [keggfc:14.2] [sgdfc:5.2.0:9.2.0] [db:gtc-saccharomyces cerevisiae] |
| CONTIG5665 | 20400292_f2_4 | 5731 | 19834 | 1596 | 532 | YER025W | 2098 | 2.7(10)-217 | Saccharomyces cerevisiae | [ui:yer025w] [pn:translation initiation factor eif2 gamma chain:translational initiation factor 2 gamma subunit:eif-2-gamma] [gn:gcd11] [gtcfc:10.7] [keggfc:14.2] [sgdfc:5.2.0:9.2.0] [db:gtc-saccharomyces cerevisiae] |
| CONTIG5017 | 24414661_c3_7 | 5732 | 19835 | 1200 | 400 | YGL169W | 850 | 1.1(10)-103 | Saccharomyces cerevisiae | [ui:ygl169w] [pn:translation initiation protein:sua5 protein] [gn:sua5:g1660] [gtcfc:10.7] [keggfc:14.2] [sgdfc:5.2.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2627 | 26367752_f2_1 | 5733 | 19836 | 645 | 215 | YGL094C | 501 | 6.2(10)-47 | Saccharomyces cerevisiae | [ui:ygl094c] [pn:component of pab1p-stimulated poly:a ribonuclease:pab-dependent poly:a-specific ribonuclease subunit:pab1p-dependent poly:a-nuclease] [gn:pan2] [gtcfc:10.7:10.9] [ec:3.1.13.4] [keggfc:14.1] [sgdfc:4.10.0:5.2.0] [db:gt |
| CONTIG3648 | 210892_c3_6 | 5734 | 19837 | 945 | 315 | YGL094C | 171 | 2.1(10)-15 | Saccharomyces cerevisiae | [ui:ygl094c] [pn:component of pab1p-stimulated poly:a ribonuclease:pab-dependent poly:a-specific ribonuclease subunit:pab1p-dependent poly:a-nuclease] [gn:pan2] [gtcfc:10.7:10.9] [ec:3.1.13.4] [keggfc:14.1] [sgdfc:4.10.0:5.2.0] [db:gt |
| CONTIG3648 | 21492182_c3_5 | 5735 | 19838 | 804 | 268 | YGL094C | 311 | 1.3(10)-26 | Saccharomyces cerevisiae | [ui:ygl094c] [pn:component of pab1p-stimulated poly:a ribonuclease:pab-dependent poly:a-specific ribonuclease subunit:pab1p-dependent poly:a-nuclease] [gn:pan2] [gtcfc:10.7:10.9] [ec:3.1.13.4] [keggfc:14.1] [sgdfc:4.10.0:5.2.0] [db:gt |
| CONTIG2402 | 16519663_f2_1 | 5736 | 19839 | 1809 | 603 | YGL049C | 627 | 2.8(10)-73 | Saccharomyces cerevisiae | [ui:ygl049c] [pn:mrna cap-binding protein:eif4f, 130k subunit:eukaryotic initiation factor 4f subunit p130:eif-4f:mrna cap-binding protein complex subunit p1301 [gn:tif4632] [gtcfc:10.7] [keggfc:14.2] [sgdfc:5.2.0:9.2.0] [db:gt-ssacch |
| CONTIG5035 | 5937562_c1_11 | 5737 | 19840 | 1563 | 521 | YGR083C | 567 | 3.0(10)-60 | Saccharomyces cerevisiae | [ui:ygr083c] [pn:translation initiation factor eif2b, 71 kda:delta subunit:translation initiation factor eif-2b delta subunit:eif-2b gdp-gtp exchange factor:guanine nucleotide exchange factor subunit gcd2:gcd complex subunit gcd2] [gn: |
| CONTIG5278 | 23470005_f1_1 | 5738 | 19841 | 1221 | 407 | YJL138C | 1491 | 6.0(10)-153 | Saccharomyces cerevisiae | [ui:yjl138c] [pn:translation initiation factor eif4a:translation initiation factor 4a:eukaryotic initiation factor 4a:eif-4a:stimulator factor i 37 kd component:p37] [gn:tif1:tif2;j0660] [gtcfc:10.7] [keggfc:14.2] [sgdfc:5.2.0:9.2.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4464 | 24641888_c2_7 | 5739 | 19842 | 531 | 177 | YJR007W | 462 | 6.5(10)-44 | *Saccharomyces cerevisiae* | [ui:yjr007w] [pn:translation initiation factor eif2, alpha chain:translational initiation factor 2 alpha subunit:eif-2-alpha] [gn:sui2;j1429] [gtcfc:10.7:11.1] [keggfc:14.2] [sgdfc:5.2.0:9.1.0] [db:gtc-*saccharomyces cerevisiae*] |
| CONTIG5702 | 13947217_c1_20 | 5740 | 19843 | 357 | 119 | YJR007W | 437 | 2.8(10)-41 | *Saccharomyces cerevisiae* | [ui:yjr007w] [pn:translation initiation factor eif2, alpha chain:translational initiation factor 2 alpha subunit:eif-2-alpha] [gn:sui2;j1429] [gtcfc:10.7:11.1] [keggfc:14.2] [sgdfc:5.2.0:9.1.0] [db:gtc-*saccharomyces cerevisiae*] |
| CONTIG2481 | 4785900_f1_1 | 5741 | 19844 | 615 | 205 | YKL173W | 413 | 1.3(10)-37 | *Saccharomyces cerevisiae* | [ui:ykl173w] [pn:similarity to elongation factor 2 ef1:gin10 protein] [gn:gin10;ykl637] [gtcfc:10.7] [keggfc:14.2] [sgdfc:5.2.0] [db:gtc-*saccharomyces cerevisiae*] |
| CONTIG2814 | 26610288_f2_2 | 5742 | 19845 | 1557 | 519 | YKL173W | 433 | 6.9(10)-57 | *Saccharomyces cerevisiae* | [ui:ykl173w] [pn:similarity to elongation factor 2 ef1:gin10 protein] [gn:gin10;ykl637] [gtcfc:10.7] [keggfc:14.2] [sgdfc:5.2.0] [db:gtc-*saccharomyces cerevisiae*] |
| CONTIG4289 | 35593750_f1_2 | 5743 | 19846 | 690 | 230 | YKL081W | 283 | 6.0(10)-25 | *Saccharomyces cerevisiae* | [ui:ykl081w] [pn:translation elongation factor eef1, gamma chain:elongation factor 1-gamma 2:ef-1-gamma 2] [gn:tef4:efe1] [gtcfc:10.7] [keggfc:14.2] [sgdfc:5.2.0:9.2.0] [db:gtc-*saccharomyces cerevisiae*] |
| CONTIG1883 | 23882758_c2_5 | 5744 | 19847 | 276 | 92 | YKR026C | 235 | 7.5(10)-20 | *Saccharomyces cerevisiae* | [ui:ykr026c] [pn:translation initiation factor eif2b, 34 kd, alpha subunit:eif-2b alpha subunit:eif-2b gdp-gtp exchange factor:guanine nucleotide exchange factor subunit gcn3:gcd complex subunit gcn3:trans |
| CONTIG4950 | 16836505_c2_9 | 5745 | 19848 | 435 | 145 | YKR026C | 469 | 1.2(10)-44 | *Saccharomyces cerevisiae* | [ui:ykr026c] [pn:translation initiation factor eif2b, 34 kd, alpha subunit:translation initiation factor eif-2b alpha subunit:eif-2b gdp-gtp exchange factor:guanine nucleotide exchange factor subunit gcn3:gcd complex subunit gcn3:trans |
| CONTIG5254 | 24115537_c3_24 | 5746 | 19849 | 528 | 176 | YKR084C | 455 | 3.6(10)-43 | *Saccharomyces cerevisiae* | [ui:ykr084c] [pn:translation elongation factor eef-1 alpha chain |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5254 | 4375703_c3_23 | 5747 | 19850 | 711 | 237 | YKR084C | 154 | 2.1(10)-9 | Saccharomyces cerevisiae | homolog:elongation factor 1 alpha-like protein] [gn:hbs1:ykr404] [gtcfc:10.7] [keggfc:14.2] [sgdfc:5.2.0:9.2.0] [dbgtc-saccharomyces cerevisiae |
| CONTIG5254 | 4100936_c3_22 | 5748 | 19851 | 423 | 141 | YKR084C | 115 | 5.2(10)-6 | Saccharomyces cerevisiae | [ui:ykr084c] [pn:translation elongation factor eef-1 alpha chain homolog:elongation factor 1 alpha-like protein] [gn:hbs1:ykr404] [gtcfc:10.7] [keggfc:14.2] [sgdfc:5.2.0:9.2.0] [dbgtc-saccharomyces cerevisiae |
| CONTIG989 | 56_f1_1 | 5749 | 19852 | 597 | 199 | YKR084C | 176 | 1.5(10)-12 | Saccharomyces cerevisiae | [ui:ykr084c] [pn:translation elongation factor eef-1 alpha chain homolog:elongation factor 1 alpha-like protein] [gn:hbs1:ykr404] [gtcfc:10.7] [keggfc:14.2] [sgdfc:5.2.0:9.2.0] [dbgtc-saccharomyces cerevisiae |
| CONTIG3453 | 1562_c1_6 | 5750 | 19853 | 1317 | 439 | YLR249W | 1265 | 5.2(10)-129 | Saccharomyces cerevisiae | [ui:ylr249w] [pn:translation elongation factor eef3:elongation factor 3:ef-3] [gn:yef3:tef3:efc1:l9672] [gtcfc:10.7] [keggfc:14.2] [sgdfc:5.2.0:9.2.0] [dh:gtc-saccharomyces cerevisiae |
| CONTIG3994 | 132962_c3_10 | 5751 | 19854 | 564 | 188 | YLR249W | 690 | 1.5(10)-67 | Saccharomyces cerevisiae | [ui:ylr249w] [pn:translation elongation factor eef3:elongation factor 3:ef-3] [gn:yef3:tef3:efc1:l9672] [gtcfc:10.7] [keggfc:14.2] [sgdfc:5.2.0:9.2.0] [dbgtc |
| CONTIG3994 | 1288135_c3_9 | 5752 | 19855 | 234 | 78 | YLR249W | 138 | 3.6(10)-8 | Saccharomyces cerevisiae | [ui:ylr249w] [pn:translation elongation factor eef3:elongation factor 3:ef-3] [gn:yef3:tef3:efc1:l9672] [gtcfc:10.7] [keggfc:14.2] [sgdfc:5.2.0:9.2.0] [dbgtc-saccharomyces cerevisiae |
| CONTIG4952 | 25636466_f2_2 | 5753 | 19856 | 1782 | 594 | YLR289W | 1866 | 1.1(10)-192 | Saccharomyces cerevisiae | [ui:ylr289w] [pn:strong similarity to e. coli elongation factor-type gtp. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5506 | 21969677_f3_6 | 5754 | 19857 | 1128 | 376 | YLR291C | 902 | 1.6(10)-90 | Saccharomyces cerevisiae | binding protein [epa:gtp-binding protein:gtpase] [gn:guf1] [gtcfc:10.7] [keggfc:14.2] [sgdfc:5.2.0] [db:gtc-saccharomyces cerevisiae] [ui:ylr291c] [pn:translation initiation factor eif2b, 43 kda subunit:translation initiation factor eif-2b gamma subunit:eif-2b gdp-gtp exchange factor:guanine nucleotide exchange factor subunit gcd7:gcd complex subunit gcd7] [gn:gcd7:1 |
| CONTIG5782 | 36504568_c3_24 | 5755 | 19858 | 906 | 302 | YMR146C | 858 | 7.2(10)-86 | Saccharomyces cerevisiae | [ui:ymr146c] [pn:translation initiation factor eif3, p39 subunit:translation initiation factor eif-3 p39 subunit] [gn:tif34:ym9375] [gtcfc:10.7] [keggfc:14.2] [sgdfc:5.2.0.9.2.0] [db:gtc-saccharomyces cerevisiae] |
| CONTIG5466 | 4566_c3_16 | 5756 | 19859 | 507 | 169 | YMR260C | 542 | 2.2(10)-52 | Saccharomyces cerevisiae | [ui:ymr260c] [pn:translation initiation factor eif1a:eukaryotic initiation factor 1a:eif-1a:eif-4c] [gn:tif11:ym8156] [gtcfc:10.7] [keggfc:14.2] [sgdfc:5.2.0.9.2.0] [db:gtc-saccharomyces cerevisiae] |
| CONTIG4683 | 16281457_c3_5 | 5757 | 19860 | 1890 | 630 | YMR309C | 1048 | 5.2(10)-106 | Saccharomyces cerevisiae | [ui:ymr309c] [pn:associated with 40s ribosomal subunit:nuclear transport protein nip1] [gn:nip1:ym9924] [gtcfc:10.4:10.7:10.1:12.6] [keggfc:14.2] [sgdfc:5.2.0.9.2.0] [db:gtc-saccharomyces cerevisiae] |
| CONTIG959 | 6325_f2_2 | 5758 | 19861 | 351 | 117 | YNL244C | 404 | 9.1(10)-38 | Saccharomyces cerevisiae | [ui:ynl244c] [pn:translation initiation factor 3:eif3:protein translation factor sui1] [gn:sui1:rfr1:n0905] [gtcfc:10.7] [keggfc:14.2] [sgdfc:5.2.0.9.2.0] [db:gtc-saccharomyces cerevisiae] |
| CONTIG4356 | 10969075_f1_1 | 5759 | 19862 | 1965 | 655 | YNL163C | 919 | 1.8(10)-110 | Saccharomyces cerevisiae | [ui:ynl163c] [pn:translation elongation factor eef4:hypothetical 124.5 kd protein in sko1-rpl44a intergenic region] [gn:n1718] [gtcfc:10.7] [keggfc:14.2] [sgdfc:5.2.0] [db:gtc-saccharomyces cerevisiae] |
| b1x18355.x | 14554563_c3_3 | 5760 | 19863 | 483 | 161 | YNL163C | 502 | 4.9(10)-47 | Saccharomyces cerevisiae | [ui:ynl163c] [pn:translation elongation factor eef4:hypothetical 124.5 kd protein in sko1-rpl44a |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1921 | 33375286_f1_1 | 5761 | 19864 | 246 | 82 | YNL062C | 165 | 1.5(10)-11 | Saccharomyces cerevisiae | intergenic region] [gn:n1718] [gtcfc:10.7] [keggfc:14.2] [sgdfc:5.2.0] [db:gtc-saccharomyces cerevisiae] [ui:ynl062c] [pn:translation initiation factor eif3 rna-binding subunit:gcd10 protein] [gn:gcd10:n2422] [sgdfc:14.2] [keggfc:14.2] [sgdfc:5.2.0:9.2.0] [db:gtc-saccharomyces cerevisiae] |
| CONTIG3550 | 35283312_f2_1 | 5762 | 19865 | 948 | 316 | YNL062C | 616 | 3.2(10)-60 | Saccharomyces cerevisiae | [ui:ynl062c] [pn:translation initiation factor eif3 rna-binding subunit:gcd10 protein] [gn:gcd10:n2422] [gtcfc:10.7] [keggfc:14.2] [sgdfc:5.2.0:9.2.0] [db:gtc-saccharomyces cerevisiae] |
| CONTIG1531 | 31808333_f3_2 | 5763 | 19866 | 984 | 328 | YNL014W | 1377 | 7.2(10)-141 | Saccharomyces cerevisiae | [ui:ynl014w] [pn:translation elongation factor eef3 homolog:putative elongation elongation factor 3 homolog:ef-3] [gn:n2846] [gtcfc:10.7:12.6] [keggfc:14.2] [sgdfc:5.2.0:7.9.0] [db:gtc-saccharomyces cerevisiae] |
| CONTIG3994 | 14628192_c2_7 | 5764 | 19867 | 354 | 118 | YNL014W | 429 | 2.8(10)-39 | Saccharomyces cerevisiae | [ui:ynl014w] [pn:translation elongation factor eef3 homolog:putative elongation elongation factor 3 homolog:ef-3] [gn:n2846] [gtcfc:10.7:12.6] [keggfc:14.2] [sgdfc:5.2.0:7.9.0] [db:gtc-saccharomyces cerevisiae] |
| CONTIG3078 | 5312510_c2_6 | 5765 | 19868 | 1122 | 374 | YOL139C | 120 | 2.0(10)-5 | Saccharomyces cerevisiae | [ui:yol139c] [pn:translation initiation factor eif4e:eukaryotic initiation factor 4e:eif-4e:mrna cap-binding protein] [gn:tif45:cdc33] [gtcfc:10.7] [keggfc:14.2] [sgdfc:5.2.0:9.2.0] [db:gtc-saccharomyces cerevisiae] |
| CONTIG4733 | 25476625_f2_4 | 5766 | 19869 | 669 | 223 | YOL139C | 583 | 9.9(10)-57 | Saccharomyces cerevisiae | [ui:yol139] [pn:translation initiation factor eif4e:eukaryotic initiation factor 4e:mrna cap-binding protein] [gn:tif45:cdc33] [gtcfc:10.7] [keggfc:14.2] [sgdfc:5.2.0:9.2.0] [db:gtc-saccharomyces cerevisiae] |
| b3x16009.y | 14095287_f1_1 | 5767 | 19870 | 270 | 90 | YOL139C | 230 | 2.5(10)-19 | Saccharomyces cerevisiae | [ui:yol139c] [pn:translation initiation factor eif4e:eukaryotic initiation factor 4e:mrna cap-binding protein] [gn:tif45:cdc33] [gtcfc:10.7] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2719 | 35803130_f3_2 | 5768 | 19871 | 855 | 285 | YOR260W | 303 | 1.5(10)-38 | *Saccharomyces cerevisiae* | [sgdfc:5.2.0:9.2.0] [db:gtc-*saccharomyces cerevisiae*] [ui:yor260w] [pn:translation initiation factor eif2bgamma subunit:translation initiation factor eif-2b gamma subunit:eif-2b gdp-gtp exchange factor:guanine nucleotide exchange factor subunit gcd1:gcd complex subunit gcd1] [gn:gcd1:tra3 |
| CONTIG3491 | 26604767_f2_5 | 5769 | 19872 | 459 | 153 | YOR260W | 172 | 1.1(10)-15 | *Saccharomyces cerevisiae* | [ui:yor260w] [pn:translation initiation factor eif2bgamma subunit:translation initiation factor eif-2b gamma subunit:eif-2b gdp-gtp exchange factor:guanine nucleotide exchange factor subunit gcd1:gcd complex subunit gcd1] [gn:gcd1:tra3 |
| CONTIG3568 | 19943775_f3_1 | 5770 | 19873 | 546 | 182 | YOR276W | 161 | 5.2(10)-12 | *Saccharomyces cerevisiae* | [ui:yor276w] [pn:mrna cap-binding protein:eif4f, 20k subunit:20 kd cap associated protein] [gn:caf20:cap20] [gtcfc:10.7] [keggfc:14.2] [sgdfc:5.2.0:9.2.0] [db:gtc-*saccharomyces cerevisiae*] |
| CONTIG4524 | 10156507_c2_6 | 5771 | 19874 | 927 | 309 | YOR361C | 402 | 1.3(10)-54 | *Saccharomyces cerevisiae* | [ui:yor361c] [pn:translation initiation factor cif3 subunit:cell cycle regulation and translation initiation protein] [gn:prt1:cdc63] [gtcfc:10.7:12.8] [keggfc:14.2] [sgdfc:3.8.0:5.2.0:9.2.0] [db:gtc-*saccharomyces cerevisiae* |
| CONTIG3920 | 25478412_f2_1 | 5772 | 19875 | 858 | 286 | YPL237W | 693 | 2.2(10)-68 | *Saccharomyces cerevisiae* | [ui:ypl237w] [pn:translation initiation factor eif2 beta subunit:translational initiation factor 2 beta subunit:eif-2-beta] [gn:sui3] [gtcfc:10.7] [keggfc:14.2] [sgdfc:5.2.0:9.2.0] [db:gtc-*saccharomyces cerevisiae* |
| CONTIG5642 | 23915932_f2_3 | 5773 | 19876 | 3591 | 1197 | YPL226W | 3359 | 0 | *Saccharomyces cerevisiae* | [ui:ypl226w] [pn:similarity to translation elongation factor ecf3] [gtcfc:10.7:12.6] [keggfc:14.2] [sgdk:5.2.0:7.9.0] [db:gtc-*saccharomyces cerevisiae* |
| CONTIG4304 | 23478550_c3_9 | 5774 | 19877 | 585 | 195 | YPL048W | 310 | 8.4(10)-28 | *Saccharomyces cerevisiae* | [ui:ypl048w] [pn:translation elongation factor eef1 alpha chain:elongation factor 1-gamma 1:ef-1-gamma 1] [gn:tef3:cam1] [gtcfc:10.7] [keggfc:14.2] [sgdfc:5.2.0:9.2.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4304 | 4297162_c2_8 | 5775 | 19878 | 234 | 78 | YPL048W | 186 | 5.5(10)-14 | *Saccharomyces cerevisiae* | *saccharomyces cerevisiae* [ui:ypl048w] [pn:translation elongation factor eef1 alpha chain:elongation factor 1-gamma 1:ef-1-gamma 1] [gn:tef3:cam1] [gtcfc:10.7] [keggfc:14.2] [sgdfc:5.2.0:9.2.0] [db:gtc-*saccharomyces cerevisiae*] |
| CONTIG4885 | 7308137_c1_9 | 5776 | 19879 | 1170 | 390 | YPL048W | 713 | 1.0(10)-96 | *Saccharomyces cerevisiae* | [ui:ypl048w] [pn:translation elongation factor eef1 alpha chain:elongation factor 1-gamma 1:ef-1-gamma 1] [gn:tef3:cam1] [gtcfc:10.7] [keggfc:14.2] [sgdfc:5.2.0:9.2.0] [db:gtc-*saccharomyces cerevisiae*] |
| CONTIG2323 | 4303191_f2_1 | 5777 | 19880 | 1089 | 363 | YPR041W | 537 | 4.5(10)-84 | *Saccharomyces cerevisiae* | *saccharomyces cerevisiae* [ui:ypr041w] [pn:translation initiation factor eif5:eukaryotic initiation factor 5:eif-5] [gn:tif5:yp3085] [gtcfc:10.7] [keggfc:14.2] [sgdfc:5.2.0:9.2.0] [db:gtc-*saccharomyces cerevisiae*] |
| CONTIG3182 | 29376640_f2_2 | 5778 | 19881 | 756 | 252 | YPR041W | 303 | 4.2(10)-41 | *Saccharomyces cerevisiae* | [ui:ypr041w] [pn:translation initiation factor eif5:eukaryotic initiation factor 5:eif-5] [gn:tif5:yp3085] [gtcfc:10.7] [keggfc:14.2] [sgdfc:5.2.0:9.2.0] [db:gtc-*saccharomyces cerevisiae*] |
| CONTIG1758 | 5207026_f3_3 | 5779 | 19882 | 948 | 316 | YPR163C | 344 | 2.1(10)-31 | *Saccharomyces cerevisiae* | [ui:ypr163c] [pn:translation initiation factor eif4b:translation initiation factor tif3/stm1:eif- 4b] [gn:tif3:stm1:p9325] [gtcfc:10.7] [keggfc:14.2] [sgdfc:5.2.0:9.2.0] [db:gtc-*saccharomyces cerevisiae*] |
| CONTIG3827 | 24697182_f3_3 | 5780 | 19883 | 867 | 289 | YFR009W | 893 | 1.3(10)-89 | *Saccharomyces cerevisiae* | [ui:yfr009w] [pn:positive effector of gcn2p:protein] [gn:gcn20] [gtcfc:10.7:12.6] [keggfc:14.2] [sgdfc:5.3.0:7.9.0:9.2.0] [db:gtc-*saccharomyces cerevisiae*] |
| CONTIG3827 | 6843955_f3_4 | 5781 | 19884 | 1026 | 342 | YFR009W | 1247 | 4.2(10)-127 | *Saccharomyces cerevisiae* | [ui:yfr009w] [pn:positive effector of gcn2p:protein] [gn:gcn20] [gtcfc:10.7:12.6] [keggfc:14.2] [sgdfc:5.3.0:7.9.0:9.2.0] [db:gtc-*saccharomyces cerevisiae*] |
| CONTIG2245 | 5913393_f1_1 | 5782 | 19885 | 897 | 299 | YGL195W | 597 | 1.8(10)-56 | *Saccharomyces cerevisiae* | [ui:ygl195w] [pn:translational activator:translational activator gcn1] [gn:gcn1:g1318] [gtcfc:10.7] [keggfc:14.2] [sgdfc:5.3.0:9.2.0] [db:gtc-*saccharomyces cerevisiae*] |
| CONTIG4938 | 24778825_f1_3 | 5783 | 19886 | 1338 | 446 | YGL195W | 193 | 1.0(10)-23 | *Saccharomyces cerevisiae* | [ui:ygl195w] [pn:translational |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | activator:translational activator gcn1] [gn:gcn1:g1318] [gtcfc:10.7] [keggfc:14.2] [sgdfc:5.3.0:9.2.0] [db:gtc-saccharomyces cerevisiae] |
| CONTIG5175 | 15663535_c2_9 | 5784 | 19887 | 3177 | 1059 | YGL195W | 1442 | 1.3(10)-235 | Saccharomyces cerevisiae | [ui:ygl195w] [pn:translational activator:translational activator gcn1] [gn:gcn1:g1318] [gtcfc:10.7] [keggfc:14.2] [sgdfc:5.3.0:9.2.0] [db:gtc-saccharomyces cerevisiae] |
| b9x13s54.x | 23955187_f2_1 | 5785 | 19888 | 363 | 121 | YGL195W | 172 | 2.0(10)-14 | Saccharomyces cerevisiae | [ui:ygl195w] [pn:translational activator:translational activator gcn1] [gn:gcn1:g1318] [gtcfc:10.7] [keggfc:14.2] [sgdfc:5.3.0:9.2.0] [db:gtc-saccharomyces cerevisiae] |
| CONTIG2020 | 10976532_f1_1 | 5786 | 19889 | 900 | 300 | YJL125C | 655 | 2.2(10)-64 | Saccharomyces cerevisiae | [ui:yjl125c] [pn:translational repressor of gcn4:gcd14 protein] [gn:gcd14:j0710] [gtcfc:10.7] [keggfc:14.2] [sgdfc:5.3.0] [db-gtc-saccharomyces cerevisiae] |
| CONTIG3643 | 782750_f3_2 | 5787 | 19890 | 549 | 183 | YMR028W | 151 | 3.8(10)-14 | Saccharomyces cerevisiae | [ui:ymr028w] [pn:component of the tor signaling pathway] [gn:tap42] [gtcfc:12.13] [keggfc:14.2] [sgdfc:3.8.0:5.3.0] [db:gtc-saccharomyces cerevisiae] |
| CONTIG2486 | 22926268_f2_2 | 5788 | 19891 | 981 | 327 | YNL139C | 114 | 0.0015 | Saccharomyces cerevisiae | [ui:ynl139c] [pn:regulatory protein:rlr1 protein] [gn:rlr1:n1209:n1835] [gtcfc:10.7] [keggfc:14.2] [sgdfc:5.3.0] [db:gtc-saccharomyces cerevisiae] |
| CONTIG3826 | 4489075_c3_4 | 5789 | 19892 | 1431 | 477 | YNL139C | 234 | 4.5(10)-16 | Saccharomyces cerevisiae | [ui:ynl139c] [pn:regulatory protein:rlr1 protein] [gn:rlr1:n1209:n1835] [gtcfc:10.7] [keggfc:14.2] [sgdfc:5.3.0] [fdb:gtc-saccharomyces cerevisiae] |
| CONTIG2848 | 964062_f1_1 | 5790 | 19893 | 555 | 185 | YGR147C | 151 | 1.5(10)-10 | Saccharomyces cerevisiae | [ui:ygr147c] [pn:n-acetyltransferase for n-terminal methionine:n-terminal acetyltransferase 2:amino-terminal, alpha-amino, acetyltransferase 2] [gn:nat2:g6630] [gtcfc:10.7:14.1] [ec:2.3.1.88] [keggfc:14.1] [sgdfc:5.5.0:6.3.0:9.2.0] [d |
| CONTIG5076 | 1206562_c1_7 | 5791 | 19894 | 465 | 155 | YHR189W | 184 | 1.8(10)-14 | Saccharomyces cerevisiae | [ui:yhr189w] [pn:similarity to peptidyl-trna hydrolases:putative peptidyl-trna hydrolase:pth] [gtcfc:10.7] [keggfc:14.1] [sgdfc:5.5.0] [db:gtc-saccharomyces cerevisiae] |
| CONTIG1050 | 24303779_c1_2 | 5792 | 19895 | 621 | 207 | YHR189W | 243 | 1.1(10)-20 | Saccharomyces cerevisiae | [ui:yhr189w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | peptidyl-trna hydrolases:putative peptidyl-trna hydrolase:epth] [gtcfc:10.7] [ec:3.1.1.29] [keggfc:14.1] [sgdfc:5.5.0] [db:gtc-saccharomyces cerevisiae] |
| CONTIG3362 | 4942012_c2_6 | 5793 | 19896 | 1119 | 373 | YMR005W | 234 | 5.7(10)-34 | Saccharomyces cerevisiae | [ui:ymr005w] [pn:required for protein synthesis:mpt1 protein] [gn:mpt1:ym8270] [keggfc:14.2] [sgdfc:5.5.0] [db:gtc-saccharomyces cerevisiae] |
| CONTIG3952 | 14260931_c3_7 | 5794 | 19897 | 1650 | 550 | YNL209W | 2231 | 2.2(10)-231 | Saccharomyces cerevisiae | [ui:ynl209w] [pn:heat shock protein of hsp70 family, cytosolic:heat shock protein ssb2] [gn:ssb2:n1333] [gtcfc:12.7] [keggfc:14.2] [sgdfc:5.5.0:9.2.0] [db:gtc-saccharomyces cerevisiae] |
| CONTIG5378 | 20319182_c2_15 | 5795 | 19898 | 543 | 181 | YBR164C | 708 | 5.5(10)-70 | Saccharomyces cerevisiae | [ui:ybr164c] [pn:adp-ribosylation factor:adp-ribosylation factor-like protein 1] [gn:arf1:arf3:ybr1216] [gtcfc:10.7:12.10] [keggfc:14.2] [sgdfc:6.3.0:8.3.0] [db:gtc-saccharomyces cerevisiae] |
| CONTIG5109 | 41034_f1_1 | 5796 | 19899 | 720 | 240 | YDL212W | 314 | 3.2(10)-28 | Saccharomyces cerevisiae | [ui:ydl212w] [pn:endoplasmic reticulum membrane protein:secretory component protein] [gn:shr3] [gtcfc:10.7:11.1:12.16] [keggfc:14.2] [sgdfc:6.2.0:6.3.0:9.4.0] [db:gtc-saccharomyces cerevisiae] |
| CONTIG5715 | 24022191_c1_10 | 5797 | 19900 | 801 | 267 | YDR098C | 676 | 1.3(10)-66 | Saccharomyces cerevisiae | [ui:ydr098c] [pn:similarity to legionella glutaredoxin-like protein] [gtcfc:10.7] [keggfc:14.2] [sgdfc:6.3.0] [db:gtc-saccharomyces cerevisiae] |
| CONTIG5792 | 20120390_f2_9 | 5798 | 19901 | 2463 | 821 | YDR495C | 103 | 0.11 | Saccharomyces cerevisiae | [ui:ydr495c] [pn:vacuolar sorting protein:vacuolar protein sorting-associated protein vps3] [gn:vps3:d9719] [gtcfc:10.7:11.1:12.16] [keggfc:14.2] [sgdfc:6.2.0:6.3.0:6.4.0:9.10.0] [db:gtc-saccharomyces cerevisiae] |
| CONTIG4598 | 14879155_f1_1 | 5799 | 19902 | 579 | 193 | YEL012W | 462 | 6.5(10)-44 | Saccharomyces cerevisiae | [ui:yel012w] [pn:ubiquitin-conjugating enzyme:ubiquitin-conjugating enzyme e2-24 kd:ubiquitin-protein ligase:ubiquitin carrier protein] [gn:ubc8] [gtcfc:10.7] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5659 | 11719175_f3_11 | 5800 | 19903 | 1395 | 465 | YER005W | 1212 | 2.2(10)-123 | Saccharomyces cerevisiae | [ui:yer005w] [pn:similarity to gda1p:hypothetical 71.9 kd protein in pmi40-pac2 intergenic region] [gtcfc:10.7] [keggfc:14.2] [sgdfr:6.3.0] [db:gtc-saccharomyces cerevisiae] [ec:6.3.2.19] [keggfc:14.1] [sgdfc:6.3.0] [db:gtc-saccharomyces cerevisiae] |
| CONTIG5659 | 4882788_f3_12 | 5801 | 19904 | 801 | 267 | YER005W | 121 | 8.5(10)-5 | Saccharomyces cerevisiae | [ui:yer005w] [pn:similarity to gda1p:hypothetical 71.9 kd protein in pmi40-pac2 intergenic region] [gtcfc:10.7] [keggfc:14.2] [sgdfr:6.3.0] [db:gtc-saccharomyces cerevisiae] |
| CONTIG225 | 32032160_c3_2 | 5802 | 19905 | 327 | 109 | YGL203C | 103 | 0.00012 | Saccharomyces cerevisiae | [ui:ygl203c] [pn:carboxypeptidase:ysc-alpha:carboxypeptidase precursor:carboxypeptidase d [gn:kex1] [gtcfc:10.7.12.16] [ec:3.4.16.6] [keggfc:14.1] [sgdfc:6.3.0:9.4.0] [db:gtc-saccharomyces cerevisiae] |
| CONTIG5562 | 22456555_c1_8 | 5803 | 19906 | 1578 | 526 | YGL203C | 971 | 7.5(10)-98 | Saccharomyces cerevisiae | [ui:ygl203c] [pn:carboxypeptidase:ysc-alpha:carboxypeptidase precursor:carboxypeptidase d [gn:kex1] [gtcfc:10.7.12.16] [ec:3.4.16.6] [keggfc:14.1] [sgdfc:6.3.0:9.4.0] [db:gtc-saccharomyces cerevisiae] |
| CONTIG5531 | 4354803_c3_34 | 5804 | 19907 | 570 | 190 | YGR133W | 276 | 3.3(10)-24 | Saccharomyces cerevisiae | [ui:ygr133w] [pn:ubiquitin-conjugating enzyme:ubiquitin-conjugating enzyme e2-21 kd:ubiquitin-protein ligase:ubiquitin carrier protein] [gn:pas2:ubc10] [gtcfc:10.7.12.16:12.6] [ec:6.3.2.19] [keggfc:14.1] |
| CONTIG4597 | 19584530_f1_1 | 5805 | 19908 | 378 | 126 | YGR209C | 126 | 2.6(10)-8 | Saccharomyces cerevisiae | [ui:ygr209c] [pn:thioredoxin ii:thioredoxin i:tr-i] [gn:trx2:trx1:g7746] [gtcfc:10.7.12.12.8] [keggfc:14.2] [sgdfc:3.8.0:6.3.0:11.3.0] [db:gtc-saccharomyces cerevisiae] |
| CONTIG5028 | 10979805_f3_6 | 5806 | 19909 | 990 | 330 | YGR209C | 194 | 3.2(10)-15 | Saccharomyces cerevisiae | [ui:ygr209c] [pn:thioredoxin ii:thioredoxin i:tr-i] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5804 | 22689062_f1_11 | 5807 | 19910 | 1473 | 491 | YJR117W | 1227 | 5.7(10)-125 | Saccharomyces cerevisiae | [gn:trx2:trx1:g7746] [gtcfc:10.7:12.12:12.8] [keggfc:14.2] [sgdfc:3.8.0:6.3.0:11.3.0] [db:gtc-saccharomyces cerevisiae] [ui:yjr117w] [pn:zinc metallo-protease:hypothetical 52.3 kd protein in mnf1-atp2 intergenic region] [gn:ste24;j2032] [gtcfc:10.11:12.9] [keggfc:14.2] [sgdfc:3.3.0:6.3.0] [db:gtc-saccharomyces cerevisiae] |
| CONTIG2164 | 1300_c2_3 | 5808 | 19911 | 330 | 110 | YLR043C | 332 | 3.8(10)-30 | Saccharomyces cerevisiae | [ui:yer043c] [pn:thioredoxin ii:thioredoxin ii:tr-ii] [gn:trx1:trx2] [keggfc:14.2] [sgdfc:3.8.0:6.3.0:11.3.0] [db:gtc-saccharomyces cerevisiae] |
| CONTIG3792 | 6095437_c1_10 | 5809 | 19912 | 627 | 209 | YLR066W | 403 | 1.2(10)-37 | Saccharomyces cerevisiae | [ui:ylr066w] [pn:similarity to signal peptidase] [gtcfc:11.1] [keggfc:14.2] [sgdfc:6.3.0] [db:gtc-saccharomyces cerevisiae] |
| CONTIG1309 | 31645177_c2_4 | 5810 | 19913 | 1179 | 393 | YLR121C | 144 | 5.2(10)-7 | Saccharomyces cerevisiae | [ui:ylr121c] [pn:strong similarity to aspartyl proteases] [gtcfc:10.11:5.2] [keggfc:14.2] [sgdfc:6.3.0] [db:gtc-saccharomyces cerevisiae] |
| b2x10323.y | 7219712_f3_1 | 5811 | 19914 | 477 | 159 | YLR244C | 616 | 3.2(10)-60 | Saccharomyces cerevisiae | [ui:ylr244c] [pn:methionine aminopeptidase, isoform 1:methionine aminopeptidase 1 precursor:metap 1:peptidase m 1:map] [gn:map1;i9672] [gtcfc:10.7:14.1] [ec:3.4.11.18] [keggfc:14.1] [sgdfc:6.3.0:9.2.0] [db:gtc-saccharomyces cerevisiae] |
| CONTIG2489 | 11907537_f1_3 | 5812 | 19915 | 465 | 155 | YLR389C | 143 | 1.0(10)-8 | Saccharomyces cerevisiae | [ui:ylr389c] [pn:protease involved in a-factor processing] [gn:ste23] [gtcfc:10.11:12.9] [keggfc:14.2] [sgdfc:3.3.0:6.3.0] [db:gtc-saccharomyces cerevisiae] |
| CONTIG5476 | 21523515_f3_7 | 5813 | 19916 | 1077 | 359 | YLR389C | 790 | 1.1(10)-78 | Saccharomyces cerevisiae | [ui:ylr389c] [pn:protease involved in a-factor processing] [gn:ste23] [gtcfc:10.11:12.9] [keggfc:14.2] [sgdfc:3.3.0:6.3.0] [db:gtc-saccharomyces cerevisiae] |
| CONTIG5476 | 33396075_f2_5 | 5814 | 19917 | 2469 | 823 | YLR389C | 1272 | 9.5(10)-130 | Saccharomyces cerevisiae | [ui:ylr389c] [pn:protease involved in a-factor processing] [gn:ste23] [gtcfc:10.11:12.9] [keggfc:14.2] [sgdfc:3.3.0:6.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG882 | 4509775_f1_1 | 5815 | 19918 | 819 | 273 | YLR389C | 313 | 6.7(10)-27 | Saccharomyces cerevisiae | [ui:ylr389c] [pn:protease involved in a-factor processing] [gn:ste23] [gtcfc:10.11:12.9] [keggfc:14.2] [sgdfc:3.3.0:6.3.0] [fdb:gtc-saccharomyces cerevisiae] |
| CONTIG5196 | 13671877_f1_2 | 5816 | 19919 | 573 | 191 | YML055W | 189 | 5.5(10)-15 | Saccharomyces cerevisiae | [ui:yml055w] [pn:signal peptidase 18 kd subunit] [gn:spc2] [gtcfc:11.1:10.7:12.16] [keggfc:14.2] [sgdfc:6.3.0:9.4.0] [db:gtc-saccharomyces cerevisiae] |
| CONTIG3894 | 14063427_c2_7 | 5817 | 19920 | 1125 | 375 | YMR152W | 305 | 2.8(10)-27 | Saccharomyces cerevisiae | [ui:ymr152w] [pn:mitochondrial inner membrane protease:hypothetical 41.6 kd protein in imp1-hlj1 intergenic region:rf1095] [gn:ym9375] [gtcfc:10.11:12.16] [keggfc:14.2] [sgdfc:6.3.0] [db:gtc-saccharomyces cerevisiae] |
| CONTIG5708 | 23469680_f1_9 | 5818 | 19921 | 1089 | 363 | YMR152W | 248 | 6.7(10)-20 | Saccharomyces cerevisiae | [ui:ymr152w] [pn:mitochondrial inner membrane protease:hypothetical 41.6 kd protein in imp1-hlj1 intergenic region:rf1095] [gn:ym9375] [gtcfc:10.11:12.16] [keggfc:14.2] [sgdfc:6.3.0] [db:gtc-saccharomyces cerevisiae] |
| CONTIG4441 | 995300_c3_5 | 5819 | 19922 | 840 | 280 | YNL238W | 650 | 7.9(10)-64 | Saccharomyces cerevisiae | [ui:ynl238w] [pn:endoproteinase of late golgi compartment:kexin precursor:kex2 protease:proteinase yscf] [gn:kex2:qds1:n1122] [gkfc:10.11:12.16:12.9] [ec:3.4.21.61] [keggfc:14.1] [sgdfc:3.3.0:6.3.0:9.4.0] [db:gtc-saccharomyces cerevisiae] |
| CONTIG5003 | 506693_f1_1 | 5820 | 19923 | 1191 | 397 | YOR219C | 226 | 8.9(10)-16 | Saccharomyces cerevisiae | [ui:yor219c] [pn:type iv dipeptidyl aminopeptidase:dipeptidyl aminopeptidase a:dpap a:ysciv] [gn:ste13:ycl1:yor50-9] [gtcfc:10.7:12.16:12.9] [ec:3.4.14.-] [keggfc:14.1] [sgdfc:3.3.0:6.3.0:9.4.0] [db:gtc-saccharomyces cerevisiae] |
| CONTIG5003 | 24238387_f2_4 | 5821 | 19924 | 1581 | 527 | YOR219C | 958 | 1.8(10)-96 | Saccharomyces cerevisiae | [ui:yor219c] [pn:type iv dipeptidyl aminopeptidase:dipeptidyl aminopeptidase a:dpap a:ysciv] [gn:ste13:ycl1:yor50-9] [gtcfc:10.7:12.16:12.9] [ec:3.4.14.-] [keggfc:14.1] [sgdfc:3.3.0:6.3.0:9.4.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x12432.y | 980002_c3_10 | 5822 | 19925 | 459 | 153 | YPL051W | 161 | 5.2(10)-12 | *Saccharomyces cerevisiae* | *saccharomyces cerevisiae* [ui:ypl051w] [pn:strong similarity to adp-ribosylation factors] [gtcfc:10.7:12.10] [keggfc:14.2] [sgdfc:6.3.0:8.3.0] [db:gtc-*saccharomyces cerevisiae*] |
| CONTIG3269 | 16485902_c3_2 | 5823 | 19926 | 1122 | 374 | YPL050C | 1025 | 1.3(10)-103 | *Saccharomyces cerevisiae* | [ui:ypl050c] [pn:required for complex n-glycosylation:protein] [gn:mnn9] [gtcfc:10.7:12.16] [keggfc:14.2] [sgdfc:6.3.0:9.4.0] [db:gtc-*saccharomyces cerevisiae*] |
| CONTIG5127 | 33477192_c3_10 | 5824 | 19927 | 465 | 155 | YPR131C | 394 | 1.1(10)-36 | *Saccharomyces cerevisiae* | [ui:ypr131c] [pn:similarity to n-acetyltransferases] [gtcfc:10.7] [keggfc:14.2] [sgdfc:6.3.0] [db:gtc-*saccharomyces cerevisiae*] |
| CONTIG4781 | 23945177_c2_4 | 5825 | 19928 | 1926 | 642 | YAL002W | 254 | 7.5(10)-36 | *Saccharomyces cerevisiae* | [ui:yal002w] [pn:vacuolar sorting protein, 134 kd:vacuolar protein sorting-associated protein vps8] [gn:vps8:fun15] [gtcfc:10.7:11.1:12.13] [keggfc:14.2] [sgdfc:6.2.0:8.5.0] [db:gtc-*saccharomyces cerevisiae*] |
| CONTIG4781 | 26368752_c2_3 | 5826 | 19929 | 804 | 268 | YAL002W | 188 | 2.6(10)-12 | *Saccharomyces cerevisiae* | [ui:yal002w] [pn:vacuolar sorting protein, 134 kd:vacuolar protein sorting-associated protein vps8] [gn:vps8:fun15] [gtcfc:10.7:11.1:12.13] [keggfc:14.2] [sgdfc:6.2.0:8.5.0] [db:gtc-*saccharomyces cerevisiae*] |
| CONTIG5445 | 1194062_c1_9 | 5827 | 19930 | 1035 | 345 | YBL017C | 802 | 9.0(10)-79 | *Saccharomyces cerevisiae* | [ui:ybl017c] [pn:vacuolar protein sorting/targeting protein:vacuolar protein sorting/targeting protein pep 1 precursor:vacuolar carboxypeptidase sorting receptor vps10:carboxypeptidase y receptor] [gn:pep1:vps10:ybl0302:ybl03] [gtcfc:10 |
| CONTIG5445 | 15648387_c1_8 | 5828 | 19931 | 306 | 102 | YBL017C | 183 | 9.5(10)-13 | *Saccharomyces cerevisiae* | [ui:ybl017c] [pn:vacuolar protein sorting/targeting protein:vacuolar protein sorting/targeting protein pep1 precursor:vacuolar carboxypeptidase sorting receptor vps10:carboxypeptidase y receptor] [gn:pep1:vps10:ybl0302:ybl03] [gtcfc:10 |
| CONTIG5445 | 19735877_c3_14 | 5829 | 19932 | 1089 | 363 | YBL017C | 466 | 7.0(10)-43 | *Saccharomyces cerevisiae* | [ui:ybl017c] [pn:vacuolar protein sorting/targeting protein:vacuolar protein sorting/targeting protein pep1 precursor:vacuolar |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3639 | 2835062_f2_2 | 5830 | 19933 | 738 | 246 | YBR171W | 341 | 4.4(10)-31 | Saccharomyces cerevisiae | carboxypeptidase sorting receptor vps10:carboxypeplidase y receptor] [gn:pep1.vps10:ybl0302:ybl03] (gtcfc:10 [ui:ybr171w] [pn:er protein translocation complex subunit:translocation protein sec66:hss1 protein] [gn:sec66:hss1:sec71:ybr1232] [gtcfc:10.7:11.1:12.16:12.6] [keggfc:14.2] [sgdfc:6.20:7.11.0:8.8.0:9.4.0] [db:gtc-saccharomyces cerevi |
| CONTIG5674 | 897627_f3_10 | 5831 | 19934 | 1509 | 503 | YBR283C | 870 | 3.7(10)-87 | Saccharomyces cerevisiae | [ui:ybr283c] [pn:strong similarity to sec61p:hypothetical 53.3 kd protein in mrpl37-ape3 intergenic region] [gn:ybr2020] [gtcfc:10.7:11.1:12.6] [keggfc:14.2] [sgdfc:6.2.0:17.0.0] [db:gtc-saccharomyces cerevisiae] |
| CONTIG3000 | 24022761_c2_5 | 5832 | 19935 | 975 | 325 | YBR288C | 180 | 1.1(10)-23 | Saccharomyces cerevisiae | [ui:ybr288c] [pn:clathrin-associated protein complex, medium subunit:adaptin medium chain homolog apm3] [gn:apm3:yks6:ybr2035] [gtcfc:10.7:11.1:12.10:12.16] [keggfc:14.2] [sgdfc:6.2.0:8.3.0:9.9.0] [db:gtc-saccharomyces cerevisiae] |
| CONTIG3000 | 1067626_c2_4 | 5833 | 19936 | 615 | 205 | YBR288C | 103 | 0.0028 | Saccharomyces cerevisiae | [ui:ybr288c] [pn:clathrin-associated protein complex, medium subunit:adaptin medium chain homolog apm3] [gn:apm3:yks6:ybr2035] [gtcfc:10.7:11.1:12.10:12.16] [keggfc:14.2] [sgdfc:6.2.0:8.3.0:9.9.0] [db:gtc-saccharomyces cerevisiae] |
| CONTIG5426 | 23546918_f2_4 | 5834 | 19937 | 630 | 210 | YDR005C | 205 | 4.0(10)-16 | Saccharomyces cerevisiae | [ui:ydr005c] [pn:required for sorting of mod5p:maf1 protein] [gn:maf1:yd8119] [gtcfc:10.7:11.1] [keggfc:14.2] [sgdfc:6.2.0] [db:gtc-saccharomyces cerevisiae] |
| CONTIG685 | 33707807_c1_1 | 5835 | 19938 | 495 | 165 | YDR005C | 207 | 2.3(10)-16 | Saccharomyces cerevisiae | [ui:ydr005c] [pn:required for sorting of mod5p:maf1 protein] [gn:maf1:yd8119] [gtcfc:10.7:11.1] [keggfc:14.2] [sgdfc:6.2.0] [db:gtc-saccharomyces cerevisiae] |
| CONTIG1218 | 23828127_c3_7 | 5836 | 19939 | 405 | 135 | YDR244W | 303 | 2.7(10)-26 | Saccharomyces cerevisiae | [ui:ydr244w] [pn:putative |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | peroxisomal targeting signal receptor:peroxisomal targeting signal receptor:peroxisomal protein pas10/peroxin 5 [gn:pas10;pex5;yd8419] [gtcfc:11.3:12.6:12.12] [keggfc:14.2] |
| CONTIG441 | 1988968_c3_7 | 5837 | 19940 | 867 | 289 | YDR244W | 402 | 3.0(10)-37 | Saccharomyces cerevisiae | [sgdfc:6.2.0:8.4.0:9.8.0] [db:gtc-[ui:ydr244w] [pn:putative peroxisomal targeting signal receptor:peroxisomal protein pas10/peroxin 5 [gn:pas10;pex5;yd8419] [gtcfc:11.3:12.6:12.12] [keggfc:14.2] |
| CONTIG3841 | 19703135_f3_4 | 5838 | 19941 | 747 | 249 | YDR323C | 209 | 1.1(10)-27 | Saccharomyces cerevisiae | [sgdfc:6.2.0:8.4.0:9.8.0] [db:gtc-[ui:ydr323c] [pn:vacuolar segregation protein:vac1 protein] [gn:vac1;pep7;vps19] [gtcfc:10.7:11.1:12.13:12.16] [keggfc:14.2] [sgdfc:6.2.0:8.5.0:9.10.0] [db:gtc-saccharomyces cerevisiae |
| CONTIG4931 | 2128317_c1_10 | 5839 | 19942 | 219 | 73 | YDR323C | 154 | 2.6(10)-10 | Saccharomyces cerevisiae | [ui:ydr323c] [pn:vacuolar segregation protein:vac1 protein] [gn:vac1;pep7;vps19] [gtcfc:10.7:11.1:12.13:12.16] [keggfc:14.2] [sgdfc:6.2.0:8.5.0:9.10.0] [db:gtc-saccharomyces cerevisiae |
| CONTIG2910 | 19722192_c3_2 | 5840 | 19943 | 1179 | 393 | YDR414C | 152 | 2.7(10)-8 | Saccharomyces cerevisiae | [ui:ydr414c] [pn:required for retention of luminal er proteins:erd1 protein] [gn:erd1;d9461] [gtcfc:10.7:11.1:12.16] [keggfc:14.2] [sgdfc:6.2.0:9.4.0] [db:gtc-saccharomyces cerevisiae |
| CONTIG3698 | 21892017_f1_1 | 5841 | 19944 | 1401 | 467 | YER101C | 194 | 1.3(10)-12 | Saccharomyces cerevisiae | [ui:yer101c] [pn:strong similarity to as1p;protein] [gn:ast2] [gtcfc:10.7:11.1] [keggfc:14.2] [sgdfc:6.2.0] [db:gtc-saccharomyces cerevisiae |
| CONTIG2448 | 14725067_c2_3 | 5842 | 19945 | 1620 | 540 | YGL206C | 1665 | 2.2(10)-171 | Saccharomyces cerevisiae | [ui:ygl206c] [pn:clathrin heavy chain] [gn:chc1] [gtcfc:10.7:11.1:12.6] [keggfc:14.2] [sgdfc:6.2.0:8.7.0:9.2.0] [db:gtc-saccharomyces cerevisiae |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2931 | 78182_c3_3 | 5843 | 19946 | 1176 | 392 | YGL206C | 1386 | 8.0(10)-142 | *Saccharomyces cerevisiae* | [ui:ygl206c][pn:clathrin heavy chain][gn:chc1][gtcfc:10.7:11.1:12.6][sgdfc:6.2.0:8.7.0:9.2.0][db:gtc-*saccharomyces cerevisiae*][keggfc:14.2] |
| CONTIG3596 | 24697182_c1_6 | 5844 | 19947 | 825 | 275 | YGL206C | 732 | 3.2(10)-71 | *Saccharomyces cerevisiae* | [ui:ygl206c][pn:clathrin heavy chain][gn:chc1][gtcfc:10.7:11.1:12.6][sgdfc:6.2.0:8.7.0:9.2.0][db:gtc-*saccharomyces cerevisiae*][keggfc:14.2] |
| CONTIG390 | 5079805_f2_1 | 5845 | 19948 | 1143 | 381 | YGL206C | 1280 | 1.3(10)-130 | *Saccharomyces cerevisiae* | [ui:ygl206c][pn:clathrin heavy chain][gn:chc1][gtcfc:10.7:11.1:12.6][sgdfc:6.2.0:8.7.0:9.2.0][db:gtc-*saccharomyces cerevisiae*][keggfc:14.2] |
| CONTIG4107 | 6720900_f2_1 | 5846 | 19949 | 522 | 174 | YGL095C | 240 | 1.7(10)-19 | *Saccharomyces cerevisiae* | [ui:ygl095c][pn:vacuolar protein sorting-associated protein:vacuolar protein sorting-associated protein vps45][gn:vps45:stt10][gtcfc:10.7:11.1:12.13:12.8][keggfc:14.2][sgdfc:3.2.0:6.2.0:8.5.0:10.2.7][db:gtc-*saccharomyces cerevis* |
| CONTIG3468 | 4084567_f2_2 | 5847 | 19950 | 246 | 82 | YHR110W | 121 | 1.3(10)-7 | *Saccharomyces cerevisiae* | [ui:yhr110w][pn:similarity to human gp25l2 protein:hypothetical 24.2 kd protein in cdc12-orc6 intergenic region precursor][gtcfc:10.7:11.1][keggfc:14.2][sgdfc:6.2.0][db:gtc-*saccharomyces cerevisiae*] |
| CONTIG3468 | 25788438_f1_1 | 5848 | 19951 | 435 | 145 | YHR110W | 393 | 1.3(10)-36 | *Saccharomyces cerevisiae* | [ui:yhr110w][pn:similarity to human gp25l2 protein:hypothetical 24.2 kd protein in cdc12-orc6 intergenic region precursor][gtcfc:10.7:11.1][keggfc:14.2][sgdfc:6.2.0][db:gtc-*saccharomyces cerevisiae*] |
| CONTIG5445 | 4863437_c3_15 | 5849 | 19952 | 186 | 62 | YIL173W | 95 | 0.0022 | *Saccharomyces cerevisiae* | [ui:yil173w][pn:strong similarity to pep1p:putative membrane glycoprotein in suc2 5"region precursor][gtcfc:10.7:11.1][keggfc:14.2][sgdfc:6.2.0][db:gtc-*saccharomyces cerevisiae*] |
| CONTIG5445 | 11929700_c1_7 | 5850 | 19953 | 858 | 286 | YIL173W | 154 | 6.0(10)-8 | *Saccharomyces cerevisiae* | [ui:yil173w][pn:strong similarity to pep1p:putative membrane glycoprotein in suc2 5"region |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5445 | 2926675_c1_5 | 5851 | 19954 | 759 | 253 | YIL173W | 154 | 3.7(10)-8 | *Saccharomyces cerevisiae* | precursor] [gcfc:10.7:11.1] [keggfc:14.2] [sgdfc:6.2.0] [db:gtc-saccharomyces cerevisiae] [ui:yil173w] [pn:strong similarity to pep1p;putative membrane glycoprotein in suc2 5"region precursor] [gcfc:10.7:11.1] [keggfc:14.2] [sgdfc:6.2.0] [db:gtc-saccharomyces cerevisiae] |
| CONTIG1678 | 195442_f1_1 | 5852 | 19955 | 804 | 268 | YJL154C | 122 | 0.00013 | *Saccharomyces cerevisiae* | [ui:yjl154c] [pn:protein-sorting protein, vacuolar;vacuolar protein sorting-associated protein vps35] [gn:vps35;j0580] [gcfc:10.7:11.1:12.16] [keggfc:14.2] [sgdfc:6.2.0;9.10.0] [db:gtc-saccharomyces cerevisiae] |
| CONTIG4984 | 25391251_c1_8 | 5853 | 19956 | 780 | 260 | YJL154C | 388 | 3.2(10)-51 | *Saccharomyces cerevisiae* | [ui:yjl154c] [pn:protein-sorting protein, vacuolar;vacuolar protein sorting-associated protein vps35] [gn:vps35;j0580] [gcfc:10.7:11.1:12.16] [keggfc:14.2] [sgdfc:6.2.0;9.10.0] [db:gtc-saccharomyces cerevisiae] |
| CONTIG5545 | 4016642_f3_11 | 5854 | 19957 | 1053 | 351 | YJL053W | 655 | 2.2(10)-64 | *Saccharomyces cerevisiae* | [ui:yjl053w] [pn:vacuolar protein sorting/targeting protein;vacuolar protein sorting/targeting protein pep] [gn:pep8;j1152] [gcfc:10.7:11.1:12.16] [keggfc:14.2] [sgdfc:6.2.0;9.10.0] [db:gtc-saccharomyces cerevisiae] |
| CONTIG5218 | 4140825_f2_6 | 5855 | 19958 | 633 | 211 | YKL196C | 794 | 4.2(10)-79 | *Saccharomyces cerevisiae* | [ui:ykl196c] [pn:similarity to sec22p;hypothetical 22.7 kd protein in pas1-mst1 intergenic region] [gcfc:10.7:11.1:12.10:12.16] [keggfc:14.2] [sgdfc:6.2.0:8.3.0:9.9.0] [db:gtc-saccharomyces cerevisiae] |
| CONTIG5301 | 4884442_f1_2 | 5856 | 19959 | 930 | 310 | YKL154W | 179 | 1.3(10)-26 | *Saccharomyces cerevisiae* | [ui:ykl154w] [pn:similarity to mouse signal recognition particle receptor beta subunit;putative signal recognition particle receptor beta subunit:sr-beta] [gn:ykl609] [gcfc:12.13:11.3] [keggfc:14.2] |
| CONTIG5282 | 1382235_f2_2 | 5857 | 19960 | 1299 | 433 | YKR001C | 1437 | 3.2(10)-147 | *Saccharomyces cerevisiae* | [sgdfc:6.2.0] [db:gtc-saccharomyces cerevisiae] [ui:ykr001c] [pn:member of the dynamin family of gtpases;vacuolar sorting protein 1] [gn:vps1:spo15:lam1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5357 | 10578562_c2_20 | 5858 | 19961 | 570 | 190 | YKR001C | 600 | 1.6(10)-58 | Saccharomyces cerevisiae | [gtcfc:10.7:11.1:12.16] [kegg fc:14.2] [sgdfc:6.2.0:9.4.0] [db:gtc-saccharomyces cerevisiae] [ui:ykr001c] [pn:member of the dynamin family of gtpases;vacuolar sorting protein 1] [gn:vps1;spo15;lam1] [gtcfc:10.7:11.1:12.16] [keggfc:14.2] [sgdfc:6.2.0:9.4.0] [db:gtc-saccharomyces cerevisiae] |
| CONTIG463 | 20359635_f3_1 | 5859 | 19962 | 717 | 239 | YKR014C | 453 | 5.9(10)-43 | Saccharomyces cerevisiae | [ui:ykr014c] [pn:gtp-binding protein of the rab family;gtp-binding protein ypt52] [gn:ypt52;yk112] [gtcfc:10.7:11.1:12.13:12.6] [keggfc:14.2] [sgdfc:6.2.0:8.5:0.8.7.0] [db:gtc-saccharomyces cerevisiae] |
| CONTIG5732 | 15887_f3_22 | 5860 | 19963 | 615 | 205 | YKR014C | 307 | 1.7(10)-27 | Saccharomyces cerevisiae | [ui:ykr014c] [pn:gtp-binding protein of the rab family;gtp-binding protein ypt52] [gn:ypt52;yk112] [gtcfc:10.7:11.1:12.13:12.6] [keggfc:14.2] [sgdfc:6.2.0:8.5:0.8.7.0] [db:gtc-saccharomyces cerevisiae] |
| CONTIG2042 | 2439317_f1_1 | 5861 | 19964 | 486 | 162 | YLR148W | 224 | 2.0(10)-17 | Saccharomyces cerevisiae | [ui:ylr148w] [pn:vacuolar membrane protein;vacuolar membrane protein pep3] [gn:pep3;vps18;19634] [gtcfc:10.7:11.1:12.16] [keggfc:14.2] [sgdfc:6.2.0:9.10.0] [db:gtc-saccharomyces cerevisiae] |
| CONTIG5010 | 23913202_f2_1 | 5862 | 19965 | 2436 | 812 | YLR148W | 346 | 5.0(10)-28 | Saccharomyces cerevisiae | [ui:ylr148w] [pn:vacuolar membrane protein;vacuolar membrane protein pep3] [gn:pep3;vps18;19634] [gtcfc:10.7:11.1:12.16] [keggfc:14.2] [sgdfc:6.2.0:9.10.0] [db:gtc-saccharomyces cerevisiae] |
| CONTIG5505 | 6830381_c2_13 | 5863 | 19966 | 1983 | 661 | YLR148W | 270 | 2.0(10)-25 | Saccharomyces cerevisiae | [ui:ylr148w] [pn:vacuolar membrane protein;vacuolar membrane protein pep3] [gn:pep3;vps18;19634] [gtcfc:10.7:11.1:12.16] [keggfc:14.2] [sgdfc:6.2.0:9.10.0] [db:gtc-saccharomyces cerevisiae] |
| CONTIG5291 | 4454500_f2_5 | 5864 | 19967 | 1125 | 375 | YLR191W | 478 | 3.0(10)-50 | Saccharomyces cerevisiae | [ui:ylr191w] [pn:peroxisomal protein involved in protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5196 | 22304062_f1_1 | 5865 | 19968 | 291 | 97 | YLR292C | 106 | 5.0(10)-6 | Saccharomyces cerevisiae | import:peroxisomal membrane protein pas20;peroxin 13 [gn:pas20;pex13:l9470] [gtcfc:10.7:11.1:12.2:12.6] [keggfc:14.2] [sgdfc:6.2.0:8.4.0:9.8.0] [db:gtc-saccharomyces cerevisiae] [ui:ylr292c] [pn:er protein-translocation complex subunit:translocation protein sec72:p23] |
| CONTIG5432 | 1181442_f1_6 | 5866 | 19969 | 507 | 169 | YLR378C | 328 | 1.1(10)-29 | Saccharomyces cerevisiae | [gn:sec72;sec67;sim2:l8003] [gtcfc:10.7:11.1:12.16:12.6] [keggfc:14.2] [sgdfc:6.2.0:7.11.0:8.8.0:9.4.0] [db:gtc-saccharomyces cerevisiae] [ui:ylr378c] [pn:er protein-translocation complex subunit:protein transport protein sec61 alpha subunit] [gn:sec61:l3502] [gtcfc:12.6:11.1:12.16:10.7] [keggfc:14.2] [sgdfc:6.2.0:7.11.0:8.8.0:9.4.0:17.0.0] [db-gtc-saccharomyces cerevisiae] |
| CONTIG5450 | 644526_f3_6 | 5867 | 19970 | 975 | 325 | YLR378C | 1002 | 3.8(10)-101 | Saccharomyces cerevisiae | [ui:ylr378c] [pn:er protein-translocation complex subunit:protein transport protein sec61 alpha subunit] [gn:sec61:l3502] [gtcfc:12.6:11.1:12.16:10.7] [keggfc:14.2] [sgdfc:6.2.0:7.11.0:8.8.0:9.4.0:17.0.0] [db:gtc-saccharomyces cerevis] |
| CONTIG5669 | 953257_c2_25 | 5868 | 19971 | 2118 | 706 | YLR396C | 294 | 1.8(10)-24 | Saccharomyces cerevisiae | [ui:ylr396c] [pn:vacuolar sorting protein:slp1 protein:vacuolar protein sorting protein 33] [gn:slp1;vps33;vam5:l8084] [gtcfc:10.7:11.1:12.10:12.16] [keggfc:14.2] [sgdfc:6.2.0:8.3.0:9.10.0] [db:gtc-saccharomyces cerevisiae] |
| CONTIG2831 | 192137_f3_2 | 5869 | 19972 | 600 | 200 | YML097C | 247 | 1.3(10)-20 | Saccharomyces cerevisiae | [ui:yml097c] [pn:vacuolar sorting protein:vacuolar protein sorting-associated protein vps9] [gn:vps9;vpt9] [gtcfc:10.7:11.1:12.10:12.13] [keggfc:14.2] [sgdfc:6.2.0:8.3.0:8.5.0:9.2.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2831 | 11728500_f2_1 | 5870 | 19973 | 1017 | 339 | YML097C | 312 | 1.2(10)-31 | Saccharomyces cerevisiae | [db:gtc-saccharomyces cerevisiae] [ui:yml097c][[pn:vacuolar sorting protein:vacuolar protein sorting-associated protein vps9] [gn:vps9:vpt9] [gtcfc:10.7:11.1:12.10:12.13] [keggfc:14.2] [sgdfc:6.2.0:8.3.0:8.5.0:9.2.0] [db:gtc-saccharomyces cerevisiae] |
| CONTIG1858 | 25491258_f3_1 | 5871 | 19974 | 495 | 165 | YMR004W | 276 | 1.3(10)-23 | Saccharomyces cerevisiae | [ui:ymr004w] [pn:required for vacuolar protein sorting:mvp1 protein] [gn:mvp1:ym8270] [gtcfc:10.7:11.1:12.13:12.16] [keggfc:14.2] [sgdfc:6.2.0:8.5.0:9.4.0] [db:gtc-saccharomyces cerevisiae] |
| CONTIG1858 | 25398561_f3_2 | 5872 | 19975 | 543 | 181 | YMR004W | 206 | 6.0(10)-16 | Saccharomyces cerevisiae | [ui:ymr004w] [pn:required for vacuolar protein sorting:mvp1 protein] [gn:mvp1:ym8270] [gtcfc:10.7:11.1:12.13:12.16] [keggfc:14.2] [sgdfc:6.2.0:8.5.0:9.4.0] [db:gtc-saccharomyces cerevisiae] |
| CONTIG3564 | 819682_f1_1 | 5873 | 19976 | 1434 | 478 | YMR091C | 378 | 7.9(10)-50 | Saccharomyces cerevisiae | [ui:ymr091c] [pn:nuclear protein localization factor:npl6 protein] [gn:npl6:ym9582] [gtcfc:10.7:11.1] [keggfc:14.2] [sgdfc:6.2.0] [db:gtc-saccharomyces cerevisiae] |
| CONTIG4357 | 25578887_c1_4 | 5874 | 19977 | 993 | 331 | YMR214W | 464 | 1.3(10)-55 | Saccharomyces cerevisiae | [ui:ymr214w] [pn:similarity to to e. coli dnaj:scj1 protein] [gn:scj1:ym8261] [gtcfc:10.7:11.1:12.16] [keggfc:14.2] [sgdfc:6.2.0:9.4.0] [db:gtc-saccharomyces cerevisiae] |
| CONTIG2466 | 4298260_f3_6 | 5875 | 19978 | 189 | 63 | YNR006W | 105 | 6.4(10)-5 | Saccharomyces cerevisiae | [ui:ynr006w] [pn:vacuolar protein sorting-associated protein:vacuolar protein sorting-associated protein vps27] [gn:vps27:grd11:n2038] [gtcfc:10.7:11.1:12.10:12.13:12.16] [keggfc:14.2] [sgdfc:6.2.0:8.5.0:9.9.0] [db:gtc-saccharomyces c |
| CONTIG5346 | 2458276_f1_1 | 5876 | 19979 | 2241 | 747 | YNR006W | 358 | 1.3(10)-42 | Saccharomyces cerevisiae | [ui:ynr006w] [pn:vacuolar protein sorting-associated protein:vacuolar protein sorting-associated protein vps27] [gn:vps27:grd11:n2038] [gtcfc:10.7:11.1:12.10:12.13:12.16] [keggfc:14.2] [sgdfc:6.2.0:8.5.0:9.9.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG200 | 5906442_f3_2 | 5877 | 19980 | 468 | 156 | YOL122C | 238 | 3.1(10)-23 | *Saccharomyces cerevisiae* | saccharomyces c [ui:yol122c][pn:manganese transporter:transporter protein smf1/esp1][gn:smf1:esp1] [gtcfc:12.6:10.7:11.1] [keggfc:14.2] [sgdfc:1.8.1:6.2:0:7.2.1:8.7:0:9.1.0] [db:gtc-*saccharomyces cerevisiae*] |
| CONTIG1547 | 5344466_c3_4 | 5878 | 19981 | 654 | 218 | YOL122C | 422 | 1.1(10)-39 | *Saccharomyces cerevisiae* | [ui:yol122c][pn:manganese transporter:transporter protein smf1/esp1][gn:smf1:esp1] [gtcfc:12.6:10.7:11.1] [keggfc:14.2] [sgdfc:1.8.1:6.2:0:7.2.1:8.7:0:9.1.0] [db:gtc-*saccharomyces cerevisiae*] |
| CONTIG2632 | 4103127_c1_5 | 5879 | 19982 | 1521 | 507 | YOL122C | 728 | 6.0(10)-118 | *Saccharomyces cerevisiae* | [ui:yol122c][pn:manganese transporter:transporter protein smf1/esp1][gn:smf1:esp1] [gtcfc:12.6:10.7:11.1] [keggfc:14.2] [sgdfc:1.8.1:6.2:0:7.2.1:8.7:0:9.1.0] [db:gtc-*saccharomyces cerevisiae*] |
| CONTIG1162 | 1956388_f1_1 | 5880 | 19983 | 837 | 279 | YOL062C | 230 | 2.7(10)-36 | *Saccharomyces cerevisiae* | [ui:yol062c][pn:clathrin-associate protein yap54][gn:apm4] [gtcfc:10.7:11.1:12.10:12.16] [keggfc:14.2] [sgdfc:6.2.0:8.3.0:9.4.0] [db:gtc-*saccharomyces cerevisiae*] |
| CONTIG5658 | 12898438_f1_1 | 5881 | 19984 | 369 | 123 | YOL062C | 255 | 2.5(10)-21 | *Saccharomyces cerevisiae* | [ui:yol062c][pn:clathrin-associate protein yap54][gn:apm4] [gtcfc:10.7:11.1:12.10:12.16] [keggfc:14.2] [sgdfc:6.2.0:8.3.0:9.4.0] [db:gtc-*saccharomyces cerevisiae*] |
| CONTIG1497 | 23439632_c1_4 | 5882 | 19985 | 531 | 177 | YOR016C | 158 | 1.1(10)-11 | *Saccharomyces cerevisiae* | [ui:yor016c][pn:similarity to hamster cop-coated vesicle membrane protein] [gtcfc:10.7:11.1][keggfc:14.2] [sgdfc:6.2.0][db:gtc-*saccharomyces cerevisiae*] |
| CONTIG1324 | 9852253_f3_3 | 5883 | 19986 | 444 | 148 | YOR036W | 127 | 7.2(10)-8 | *Saccharomyces cerevisiae* | [ui:yor036w][pn:syntaxint-snare:pep12 protein] [gn:pep12:vps6:vpt13:or26] [gtcfc:10.7:11.1:12.13:12.16] [keggfc:14.2] [sgdfc:6.2.0:8.5.0:9.0.0][db:gtc-*saccharomyces cerevisiae*] |
| CONTIG5649 | 236258_c3_20 | 5884 | 19987 | 927 | 309 | YOR036W | 206 | 8.8(10)-17 | *Saccharomyces cerevisiae* | [ui:yor036w][pn:syntaxint-snare:pep12 protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x18145.y | 24862567_f3_1 | 5885 | 19988 | 471 | 157 | YOR036W | 142 | 1.5(10)-9 | Saccharomyces cerevisiae | [gn:pep12:vps6:vpt13:or26] [gtcfc:10.7:11.1:12.13:12.16] [keggfc:14.2] [sgdfc:6.2:0:8.5:0:9.10.0] [db-gtc-saccharomyces cerevisiae] [ui:yor036w] [pn:syntaxin:t-snare:pep12 protein] |
| CONTIG2932 | 20081260_f1_1 | 5886 | 19989 | 714 | 238 | YOR089C | 723 | 1.3(10)-71 | Saccharomyces cerevisiae | [gn:pep12:vps6:vpt13:or26] [gtcfc:10.7:11.1:12.13:12.16] [keggfc:14.2] [sgdfc:6.2:0:8.5:0:9.10.0] [db-gtc-saccharomyces cerevisiae] [ui:yor189c] [pn:gtp-binding protein:gtp-binding protein ypt51/vps21] [gn:ypt51:vps21:yor3154c] [gtcfc:10.7:11.1:12.10:12.13:12.16: 12.6] [keggfc:14.2] [sgdfc:6.2:0:8.5:0:8.7:0:9.9.0] [db:gtc-saccharomyces cerevisiae] |
| CONTIG2891 | 22460877_c3_4 | 5887 | 19990 | 492 | 164 | YOR132W | 205 | 9.1(10)-16 | Saccharomyces cerevisiae | [ui:yor132w] [pn:vacuolar protein sorting-associated protein:vacuolar protein sorting-associated protein vps17] [gn:vps17:pep21:o3314:yor3314w] [gtcfc:10.7:11.1] [keggfc:14.2] [sgdfc:6.2.0] [db-gtc-saccharomyces cerevisiae] |
| CONTIG707 | 25673905_f3_2 | 5888 | 19991 | 957 | 319 | YOR132W | 380 | 3.6(10)-39 | Saccharomyces cerevisiae | [ui:yor132w] [pn:vacuolar protein sorting-associated protein:vacuolar protein sorting-associated protein vps17] [gn:vps17:pep21:o3314:yor3314w] [gtcfc:10.7:11.1] [keggfc:14.2] [sgdfc:6.2.0] [db-gtc-saccharomyces cerevisiae] |
| CONTIG5413 | 4725328_c1_15 | 5889 | 19992 | 2031 | 677 | YOR254C | 1021 | 3.7(10)-103 | Saccharomyces cerevisiae | [ui:yor254c] [pn:er protein-translocation complex subunit:npl1 protein:sec63 protein] [gn:npl1:sec63:ptl1] [gtcfc:10.7:11.1:12.16:12.6] [keggfc:14.2] [sgdfc:6.2.0:7.11.0:8.8.0:9.4.0] [db-gtc-saccharomyces cerevisiae] |
| CONTIG4807 | 33260968_f2_5 | 5890 | 19993 | 285 | 95 | YOR286W | 221 | 2.2(10)-18 | Saccharomyces cerevisiae | [ui:yor286w] [pn:similarity to d. melanogaster heat shock protein 67b2] [gtcfc:12.7:11.1] [keggfc:14.2] [sgdfc:6.2.0] [db-gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1534 | 25597186_c2_4 | 5891 | 19994 | 228 | 76 | YOR327C | 288 | 1.8(10)-25 | *Saccharomyces cerevisiae* | [ui:yor327c] [pn:strong similarity to synaptobrevin:synaptobrevin homolog 2] [gn:snc2] [gcfc:10.7:11.1:12.10:12.16] [keggfc:14.2] [sgdfc:6.2.0:8.3.0:9.9.0] [db:gtc-*saccharomyces cerevisiae*] |
| CONTIG3832 | 19540675_f2_3 | 5892 | 19995 | 1422 | 474 | YOR329C | 203 | 3.7(10)-18 | *Saccharomyces cerevisiae* | [ui:yor329c] [pn:suppressor of clathrin deficiency:scd5 protein:ftb1 protein] [gn:scd5:ftb1] [gcfc:10.7:11.1:12.6] [keggfc:14.2] [sgdfc:6.2.0:8.7.0] [db:gtc-*saccharomyces cerevisiae*] |
| CONTIG5798 | 23875200_f1_9 | 5893 | 19996 | 627 | 209 | YPL259C | 588 | 2.8(10)-57 | *Saccharomyces cerevisiae* | [ui:ypl259c] [pn:clathrin-associated protein:clathrin coat assembly protein ap54:golgi associated protein ap-1 54 kd protein:hal 54 kd subunit:clathrin assembly protein complex 1 medium chain] [gn:apm1:yap54:] |
| CONTIG4518 | 22344008_f2_2 | 5894 | 19997 | 1131 | 377 | YPL243W | 134 | 7.2(10)-6 | *Saccharomyces cerevisiae* | [ui:ypl243w] [pn:signal recognition particle protein:signal recognition particle 68 kd protein homolog] [gn:srp68] [gcfc:12.13:11.3] [keggfc:14.2] [sgdfc:6.2.0:9.2.0] [db:gtc-*saccharomyces cerevisiae*] |
| CONTIG3924 | 11805416_f1_1 | 5895 | 19998 | 1353 | 451 | YPL210C | 114 | 1.3(10)-7 | *Saccharomyces cerevisiae* | [ui:ypl210c] [pn:signal recognition particle protein:signal recognition particle 72 kd protein homolog] [gn:srp72] [gcfc:12.13:11.3] [keggfc:14.2] [sgdfc:6.2.0:9.2.0] [db:gtc-*saccharomyces cerevisiae*] |
| CONTIG4942 | 22850187_c2_20 | 5896 | 19999 | 960 | 320 | YPL094C | 383 | 1.5(10)-35 | *Saccharomyces cerevisiae* | [ui:ypl094c] [pn:er protein-translocation complex subunit:translocation protein sec62] [gn:sec62:lpg14c] [gcfc:10.7:11.1:12.16:12.6] [keggfc:14.2] [sgdfc:6.2.0:7.11.0:8.8.0:9.4.0] [db:gtc-*saccharomyces cerevisiae*] |
| CONTIG3632 | 16882330_c3_9 | 5897 | 20000 | 975 | 325 | YPL045W | 201 | 2.3(10)-13 | *Saccharomyces cerevisiae* | [ui:ypl045w] [pn:vacuolar sorting protein:vacuolar protein sorting-associated protein vps16] [gn:vps16:vam9] [gcfc:10.7:11.1:12.13:12.16] [keggfc:14.2] [sgdfc:6.2.0:8.5.0:9.3.0:9.10.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3717 | 820337_c3_9 | 5898 | 20001 | 837 | 279 | YPL045W | 256 | 7.4(10)-28 | Saccharomyces cerevisiae | [ui:ypl045w] [pn:vacuolar sorting protein:vacuolar protein sorting-associated protein vps16] [gn:vps16:vam9] [gtcfc:10.7:11.1:12.13:12.16] [keggfc:14.2] [sgdfc:6.2:0:8.5:0:9.3:0:9.10.0] [db:gtc-saccharomyces cerevisiae] |
| CONTIG3717 | 10650305_c1_6 | 5899 | 20002 | 543 | 181 | YPL045W | 113 | 0.00033 | Saccharomyces cerevisiae | [ui:ypl045w] [pn:vacuolar sorting protein:vacuolar protein sorting-associated protein vps16] [gn:vps16:vam9] [gtcfc:10.7:11.1:12.13:12.16] [keggfc:14.2] [sgdfc:6.2:0:8.5:0:9.3:0:9.10.0] [db:gtc-saccharomyces cerevisiae] |
| CONTIG2805 | 9860458_f3_4 | 5900 | 20003 | 759 | 253 | YPR088C | 372 | 2.3(10)-34 | Saccharomyces cerevisiae | [ui:ypr088c] [pn:signal recognition particle subunit:signal recognition particle 54 kd protein homolog:srp54] [gn:srp54:ssrh1:p9513] [gtcfc:12.13:11.3] [sgdfc:6.2:0:9.2.0] [db:gtc-saccharomyces cerevisiae] |
| CONTIG1222 | 4954650_c1_4 | 5901 | 20004 | 888 | 296 | YCR077C | 98 | 0.019 | Saccharomyces cerevisiae | [ui:ycr077c] [pn:topoisomerase ii-associated protein:88.5 kd protein in ers1-stb8 intergenic region] [gtcfc:10.8] [keggfc:14.2] [sgdfc:3.6.0:3.7.0:9.2.0] [db:gtc-saccharomyces cerevisiae] |
| CONTIG1542 | 787811_c3_7 | 5902 | 20005 | 762 | 254 | YCR077C | 415 | 4.4(10)-38 | Saccharomyces cerevisiae | [ui:ycr077c] [pn:topoisomerase ii-associated protein:88.5 kd protein in ers1-stb8 intergenic region] [gtcfc:10.8] [keggfc:14.2] [sgdfc:3.6.0:3.7.0:9.2.0] [db:gtc-saccharomyces cerevisiae] |
| CONTIG5531 | 4179691_c2_33 | 5903 | 20006 | 1692 | 564 | YDR206W | 134 | 9.8(10)-10 | Saccharomyces cerevisiae | [ui:ydr206w] [pn:similarity to est1 protein] [gtcfc:10.8] [keggfc:14.2] [sgdk:3.6.0] [db:gtc-saccharomyces cerevisiae] |
| CONTIG4719 | 36210197_c2_4 | 5904 | 20007 | 1488 | 496 | YGL201C | 1446 | 2.2(10)-174 | Saccharomyces cerevisiae | [ui:ygl201c] [pn:similarity with rat intestinal dna replication protein:hypothetical 113.0 kd protein in kex1-emp24 intergenic region] [gtcfc:10.8] [keggfc:14.2] [sgdfc:3.6.0] [db:gtc-saccharomyces cerevisiae] |
| CONTIG5624 | 10975253_c3_19 | 5905 | 20008 | 1059 | 353 | YGL201C | 662 | 1.8(10)-94 | Saccharomyces cerevisiae | [ui:ygl201c] [pn:similarity with rat intestinal dna replication |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5612 | 10973406_f3_7 | 5906 | 20009 | 858 | 286 | YGR132C | 979 | 1.1(10)-98 | Saccharomyces cerevisiae | protein:hypothetical 113.0 kd protein in kex1-emp24 intergenic region] [gtcfc:10.8] [keggfc:14.2] [sgdfc:3.6.0] [dbgtc-saccharomyces cerevisiae] [ui:ygr132c] [pn:prohibitin, antiproliferative protein/prohibitin [gn:phb1·phb] [gtcfc:10.8:12.8] [keggfc:14.2] [sgdfc:3.6.0:3.8.0] [dbgtc-saccharomyces cerevisiae] |
| CONTIG4991 | 20601678_c2_5 | 5907 | 20010 | 975 | 325 | YGR231C | 1010 | 5.5(10)-102 | Saccharomyces cerevisiae | [ui:ygr231c] [pn:strong similarity to prohibitins:hypothetical 34.9 kd protein in sml1-pho81 intergenic region] [gn:g8561] [gtcfc:10.8:12.8] [keggfc:14.2] [sgdfc:3.6.0:3.8.0] [dbgtc-saccharomyces cerevisiae] |
| CONTIG2191 | 24336567_c3_5 | 5908 | 20011 | 1299 | 433 | YIL150C | 290 | 1.2(10)-23 | Saccharomyces cerevisiae | [ui:yil150c] [pn:required for s-phase initiation or completion:protein] [gn:dna43] [gtcfc:10.8:12.8] [keggfc:14.2] [sgdfc:3.6.0:3.8.0] [dbgtc-saccharomyces cerevisiae] |
| CONTIG4281 | 36597763_f3_2 | 5909 | 20012 | 258 | 86 | YKL113C | 128 | 1.0(10)-7 | Saccharomyces cerevisiae | [ui:ykl113c] [pn:ssdna endonuclease and 5"-3"exonuclease:structure specific endonuclease ykl113c/] [gn:rad27;ykl510] [gtcfc:10.8] [keggfc:14.2] [sgdfc:3.6.0] [dbgtc-saccharomyces cerevisiae] |
| CONTIG4404 | 14477175_c1_7 | 5910 | 20013 | 675 | 225 | YKL113C | 671 | 4.7(10)-66 | Saccharomyces cerevisiae | [ui:ykl113c] [pn:ssdna endonuclease and 5"-3"exonuclease:structure specific endonuclease ykl113c/] [gn:rad27;ykl510] [gtcfc:10.8] [keggfc:14.2] [sgdfc:3.6.0] [dbgtc-saccharomyces cerevisiae] |
| CONTIG5535 | 39125_f2_5 | 5911 | 20014 | 1803 | 601 | YLR103C | 310 | 6.2(10)-67 | Saccharomyces cerevisiae | [ui:ylr103c] [pn:required for minichromosome maintenance and initiation of chromosomal dna replication] [gn:cdc45] [gtcfc:10.8:12.8] [keggfc:13.2] [sgdfc:3.6.0:3.8.0] [dbgtc-saccharomyces cerevisiae] |
| CONTIG5343 | 6251_f2_4 | 5912 | 20015 | 1962 | 654 | YOL095C | 278 | 5.2(10)-32 | Saccharomyces cerevisiae | [ui:yol095c] [pn:similarity to s. aureus dna helicase pcra] [gtcfc:10.8] [keggfc:14.2] [sgdfc:3.6.0] [dbgtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2784 | 11751500_f3_3 | 5913 | 20016 | 1536 | 512 | YPL256C | 336 | 3.8(10)-30 | Saccharomyces cerevisiae | [ui:ypl256c] [pn:cyclin, g1/s-specificg1/s-specific cyclin] [gn:cln2] [gtcfc:10.8:12.9] [keggfc:13.1] [sgdfc:3.2.0:3.3.0:3.6.0:3.8.0:9.2.0] [db:gtc-saccharomyces cerevisiae] |
| CONTIG1980 | 4413900_f3_3 | 5914 | 20017 | 684 | 228 | YPR019W | 271 | 1.8(10)-22 | Saccharomyces cerevisiae | [ui:ypr019w] [pn:member of the cdc46p/mcm2p/mcm3p family:cell division control protein 54] [gn:cdc54:hcd21:ypp9531] [gtcfc:10.8:12.8] [keggfc:14.2] [sgdfc:3.6.0:3.8.0] [db:gtc-saccharomyces cerevisiae] |
| CONTIG474 | 7159683_c3_3 | 5915 | 20018 | 492 | 164 | YPR019W | 359 | 7.2(10)-32 | Saccharomyces cerevisiae | [ui:ypr019w] [pn:member of the cdc46p/mcm2p/mcm3p family:cell division control protein 54] [gn:cdc54:hcd21:ypp9531] [gtcfc:10.8:12.8] [keggfc:14.2] [sgdfc:3.6.0:3.8.0] [db:gtc-saccharomyces cerevisiae] |
| b9x12m21.y | 236094_c1_1 | 5916 | 20019 | 519 | 173 | YPR019W | 593 | 3.2(10)-57 | Saccharomyces cerevisiae | [ui:ypr019w] [pn:member of the cdc46p/mcm2p/mcm3p family:cell division control protein 54] [gn:cdc54:hcd21:ypp9531] [gtcfc:10.8:12.8] [keggfc:14.2] [sgdfc:3.6.0:38.0] [db:gtc-saccharomyces cerevisiae] |
| CONTIG4270 | 10413432_c2_5 | 5917 | 20020 | 1497 | 499 | YPR120C | 507 | 1.1(10)-48 | Saccharomyces cerevisiae | [ui:ypr120c] [pn:cyclin, b-types-phase entry cyclin 5] [gn:clb5:p9642] [gtcfc:10.8:12.8] [keggfc:13.3] [sgdfc:3.6.0:3.8.0] [db:gtc-saccharomyces cerevisiae] |
| CONTIG2912 | 36224063_f2_2 | 5918 | 20021 | 1308 | 436 | YBR136W | 780 | 5.2(10)-76 | Saccharomyces cerevisiae | [ui:ybr136w] [pn:cell cycle checkpoint protein:esr1 protein] [gn:esr1:mec1:sad3:ybr1012] [gtcfc:10.8:12.8] [keggfc:14.2] [sgdfc:3.5.0:3.7.0:3.8.0] [db:gtc-saccharomyces cerevisiae] |
| CONTIG3833 | 1986000_c2_11 | 5919 | 20022 | 345 | 115 | YBR136W | 154 | 1.8(10)-9 | Saccharomyces cerevisiae | [ui:ybr136w] [pn:cell cycle checkpoint protein:esr1 protein] [gn:esr1:mec1:sad3:ybr1012] [gtcfc:10.8:12.8] [keggfc:14.2] [sgdfc:3.5.0:3.7.0:3.8.0] [db:gtc-saccharomyces cerevisiae] |
| CONTIG3833 | 35212787_c2_10 | 5920 | 20023 | 1440 | 480 | YBR136W | 526 | 5.4(10)-49 | Saccharomyces cerevisiae | [ui:ybr136w] [pn:cell cycle checkpoint protein:esr1 protein] [gn:esr1:mec1:sad3:ybr1012] [gtcfc:10.8:12.8] [keggfc:14.2] [sgdfc:3.5.0:3.7.0:3.8.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3833 | 14195175_c3_12 | 5921 | 20024 | 966 | 322 | YBR136W | 302 | 3.5(10)-25 | *Saccharomyces cerevisiae* | *saccharomyces cerevisiae* [ui:ybr136w] [pn:cell cycle checkpoint protein:esr1 protein] [gn:esr1:mec1:sad3:ybr1012] [gtcfc:10.8:12.8] [keggfc:14.2] [sgdfc:3.5.0:3.7.0:3.8.0] [db:gtc-saccharomyces cerevisiae] |
| CONTIG4697 | 30515925_f2_1 | 5922 | 20025 | 2334 | 778 | YBR136W | 122 | 0.0027 | *Saccharomyces cerevisiae* | [ui:ybr136w] [pn:cell cycle checkpoint protein:esr1 protein] [gn:esr1:mec1:sad3:ybr1012] [gtcfc:10.8:12.8] [keggfc:14.2] [sgdfc:3.5.0:3.7.0:2.8.0] [db:gtc-saccharomyces cerevisiae] |
| CONTIG4748 | 10647936_c3_12 | 5923 | 20026 | 690 | 230 | YDL059C | 184 | 1.8(10)-14 | *Saccharomyces cerevisiae* | [ui:ydl059c] [pn:recombination and dna repair protein] [gn:rad59] [gtcfc:10.8] [keggfc:14.2] [sgdfc:3.7.0] [db:gtc-saccharomyces cerevisiae] |
| CONTIG5676 | 1178882_c2_22 | 5924 | 20027 | 1284 | 428 | YDR182W | 872 | 2.3(10)-87 | *Saccharomyces cerevisiae* | [ui:ydr182w] [pn:cell division control protein:cell division control protein 1] [gn:cdc1:dsr1:esp2:yd9395] [gtcfc:3.2.0:3.4.0:3.7.0:3.8.0:9.2.0] [keggfc:14.2] [sgdfc:3.2.0:3.4.0:3.7.0:3.8.0:9.2.0] [db:gtc-saccharomyces cerevisiae] |
| CONTIG5727 | 4079660_f1_3 | 5925 | 20028 | 1467 | 489 | YDR182W | 552 | 1.8(10)-53 | *Saccharomyces cerevisiae* | [ui:ydr182w] [pn:cell division control protein:cell division control protein 1] [gn:cdc1:dsr1:esp2:yd9395] [gtcfc:10.8:12.15:12.8] [keggfc:14.2] [sgdfc:3.2.0:3.4.0:3.7.0:3.8.0:9.2.0] [db:gtc-saccharomyces cerevisiae] |
| CONTIG5715 | 6910183_f1_1 | 5926 | 20029 | 660 | 220 | YER173W | 244 | 2.6(10)-25 | *Saccharomyces cerevisiae* | [ui:yer173w] [pn:cell cycle checkpoint protein:checkpoint protein rad24] [gn:rad24:sygp-orf60] [gtcfc:10.8:12.8] [keggfc:14.2] [sgdfc:3.7.0:3.8.0] [db:gtc-saccharomyces cerevisiae] |
| CONTIG5715 | 5312513_f2_4 | 5927 | 20030 | 978 | 326 | YER173W | 119 | 3.6(10)-7 | *Saccharomyces cerevisiae* | [ui:yer173w] [pn:cell cycle checkpoint protein:checkpoint protein rad24] [gn:rad24:sygp-orf60] [gtcfc:10.8:12.8] [keggfc:14.2] [sgdfc:3.7.0:3.8.0] [db:gtc-saccharomyces cerevisiae] |
| CONTIG5553 | 976556_c2_22 | 5928 | 20031 | 1530 | 510 | YHR031C | 711 | 2.7(10)-70 | *Saccharomyces cerevisiae* | [ui:yhr031c] [pn:similarity to pif1p:hypothetical helicase in slt2-put2 intergenic region] [gtcfc:10.8] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5801 | 21657817_f2_9 | 5929 | 20032 | 2739 | 913 | YHR031C | 743 | 9.0(10)-96 | Saccharomyces cerevisiae | [keggfc:14.2] [sgdfc:3.7.0] [db:gtc-saccharomyces cerevisiae] [ui:yhr031c] [pn:similarity to pif1p:hypothetical helicase in slt2-put2 intergenic region] [gtcfc:10.8] [keggfc:14.2] [sgdfc:3.7.0] [db:gtc-saccharomyces cerevisiae] |
| CONTIG5553 | 23829836_c1_18 | 5930 | 20033 | 303 | 101 | YHR031C | 221 | 2.8(10)-17 | Saccharomyces cerevisiae | [ui:yhr031c] [pn:similarity to pif1p:hypothetical helicase in slt2-put2 intergenic region] [gtcfc:10.8] [keggfc:14.2] [sgdfc:3.7.0] [db:gtc-saccharomyces cerevisiae] |
| CONTIG4667 | 23611251_c3_11 | 5931 | 20034 | 342 | 114 | YHR154W | 154 | 7.4(10)-10 | Saccharomyces cerevisiae | [ui:yhr154w] [pn:putative dna damage responsive cell cycle checkpoint protein:hypothetical 123.0 kd protein in spo16-rec104 intergenic region] [gtcfc:10.8:12.8] [keggfc:14.2] [sgdfc:3.7.0:3.8.0] [db:gtc-saccharomyces cerevisiae] |
| CONTIG4709 | 14729561_c1_13 | 5932 | 20035 | 807 | 269 | YHR154W | 97 | 0.11 | Saccharomyces cerevisiae | [ui:yhr154w] [pn:putative dna damage responsive cell cycle checkpoint protein:hypothetical 123.0 kd protein in spo16-rec104 intergenic region] [gtcfc:10.8:12.8] [keggfc:14.2] [sgdfc:3.7.0:3.8.0] [db:gtc-saccharomyces cerevisiae] |
| CONTIG5190 | 14554813_f3_5 | 5933 | 20036 | 1629 | 543 | YHR154W | 350 | 5.0(10)-29 | Saccharomyces cerevisiae | [ui:yhr154w] [pn:putative dna damage responsive cell cycle checkpoint protein:hypothetical 123.0 kd protein in spo16-rec104 intergenic region] [gtcfc:10.8:12.8] [keggfc:14.2] [sgdfc:3.7.0:3.8.0] [db:gtc-saccharomyces cerevisiae] |
| CONTIG1194 | 15818812_f3_1 | 5934 | 20037 | 471 | 157 | YLR383W | 306 | 4.7(10)-26 | Saccharomyces cerevisiae | [ui:ylr383w] [pn:recombination repair protein] [gn:rhc18] [gtcfc:10.8] [keggfc:14.2] [sgdfc:3.7.0] [db:gtc-saccharomyces cerevisiae] |
| CONTIG2232 | 16462551_c1_2 | 5935 | 20038 | 1227 | 409 | YLR383W | 218 | 8.5(10)-15 | Saccharomyces cerevisiae | [ui:ylr383w] [pn:recombination repair protein] [gn:rhc18] [gtcfc:10.8] [keggfc:14.2] [sgdfc:3.7.0] [db:gtc-saccharomyces cerevisiae] |
| CONTIG865 | 35370305_c2_6 | 5936 | 20039 | 921 | 307 | YLR383W | 328 | 2.1(10)-28 | Saccharomyces cerevisiae | [ui:ylr383w] [pn:recombination repair protein] [gn:rhc18] [gtcfc:10.8] [keggfc:14.2] [sgdfc:3.7.0] [db:gtc-saccharomyces cerevisiae] |
| CONTIG5815 | 26354683_f2_12 | 5937 | 20040 | 2640 | 880 | YMR190C | 1739 | 3.0(10)-183 | Saccharomyces | [ui:ymr190c] [pn:dna |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5430 | 20426588_f3_8 | 5938 | 20041 | 825 | 275 | YOR077W | 347 | 1.0(10)-31 | Saccharomyces cerevisiae | helicase:helicase sgs1:helicase tps1] [gn:sgs1:tps1:ym9646] [gtcfc:10.8] [keggfc:14.2] [sgdfc:3.7.0] [db:gtc-saccharomyces cerevisiae] [ui:yor077w] [pn:similarity to mouse kin17 protein:protein] [gn:rtts2] [gtcfc:10.8 [keggfc:14.2] [sgdfc:3.7.0] [db:gtc-saccharomyces cerevisiae] |
| CONTIG5699 | 24275806_c1_21 | 5939 | 20042 | 993 | 331 | YPL164C | 291 | 8.3(10)-25 | Saccharomyces cerevisiae | [ui:ypl164c] [pn:similarity to mismatch repair protein mlh1p] [gtcfc:10.8] [keggfc:14.2] [sgdfc:3.7.0] [db:gtc-saccharomyces cerevisiae] |
| CONTIG1704 | 12694430_f2_2 | 5940 | 20043 | 606 | 202 | YPL164C | 197 | 1.1(10)-14 | Saccharomyces cerevisiae | [ui:ypl164c] [pn:similarity to mismatch repair protein mlh1p] [gtcfc:10.8] [keggfc:14.2] [sgdfc:3.7.0] [db:gtc-saccharomyces cerevisiae] |
| CONTIG5807 | 9972786_f3_5 | 5941 | 20044 | 528 | 176 | YPL121C | 151 | 5.9(10)-11 | Saccharomyces cerevisiae | ui:ypl121c] [pn:meiotic protein:meiosis protein 5] [gn:mei5] [gtcfc:10.8.12.8] [keggfc:14.2] [sgdfc:3.5.0:3.7.0] [db:gtc-saccharomyces cerevisiae] |
| CONTIG5650 | 265902_c3_23 | 5942 | 20045 | 1449 | 483 | YBR236C | 612 | 8.4(10)-60 | Saccharomyces cerevisiae | [ui:ybr236c] [pn:methyltransferase:abd1 protein] [gn:abd1:ybr1602] [gtcfc:10.9] [keggfc:14.2] [sgdfc:4.10.0] [db:gtc-saccharomyces cerevisiae] |
| CONTIG4457 | 4331510_c2_9 | 5943 | 20046 | 543 | 181 | YJR017C | 355 | 1.3(10)-32 | Saccharomyces cerevisiae | [ui:yjr017c] [pn:ess1 protein:processing/termination factor 1] [gn:ess1:ptf1:j14452] [gtcfc:10.9] [keggfc:14.2] [sgdfc:4.10.0] [db:gtc-saccharomyces cerevisiae] |
| CONTIG2527 | 11179687_c1_6 | 5944 | 20047 | 1617 | 539 | YKL025C | 404 | 9.4(10)-47 | Saccharomyces cerevisiae | [ui:ykl025c] [pn:component of the pab1p-dependent poly:a ribonuclease:hypothetical 76.5 kd protein in tfa1-ura6 intergenic region] [gn:pan3] [gtcfc:10.9] [keggfc:14.2] [sgdfc:4.10.0] [db:gtc-saccharomyces cerevisiae] |
| CONTIG3251 | 21682687_c2_5 | 5945 | 20048 | 414 | 138 | YLR115W | 143 | 8.3(10)-9 | Saccharomyces cerevisiae | [ui:ylr115w] [pn:similarity to cattle cleavage and polyadenylation specificity factor] [gtcfc:10.9] [keggfc:14.2] [sgdfc:4.10.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4585 | 14648437_c3_12 | 5946 | 20049 | 1038 | 346 | YLR115W | 495 | 1.2(10)-46 | *Saccharomyces cerevisiae* | [ui:ylr115w] [pn:similarity to cattle cleavage and polyadenylation specificity factor] [gtcfc:10.9] [kegghc:14.2] [sgdfc:4.10.0] [db:gtc-*saccharomyces cerevisiae*] |
| CONTIG3608 | 14640686_f2_3 | 5947 | 20050 | 579 | 193 | YOL149W | 168 | 6.5(10)-26 | *Saccharomyces cerevisiae* | [ui:yol149w] [pn:component of the yeast decapping enzyme] [gn:dcp1] [gtcfc:10.9] [kegghc:14.2] [sgdfc:4.10.0] [db:gtc-*saccharomyces cerevisiae*] |
| CONTIG5771 | 24414192_f3_18 | 5948 | 20051 | 426 | 142 | YPL178W | 355 | 1.3(10)-32 | *Saccharomyces cerevisiae* | [ui:ypl178w] [pn:cell cycle block in meiotic prophase] [gn:sae1] [gtcfc:10.9:12.8] [kegghc:14.2] [sgdfc:3.8:0:4.10.0] [db:gtc-*saccharomyces cerevisiae*] |
| CONTIG5785 | 14511013_c3_35 | 5949 | 20052 | 696 | 232 | YAL059W | 109 | 2.8(10)-5 | *Saccharomyces cerevisiae* | [ui:yal059w] [pn:involved in cell wall biosynthesis:protein] [gn:sim1] [gtcfc:11.1] [kegghc:14.2] [sgdfc:9.1.0] [db:gtc-*saccharomyces cerevisiae*] |
| CONTIG2940 | 21600465_f2_4 | 5950 | 20053 | 306 | 102 | YBR068C | 143 | 5.2(10)-9 | *Saccharomyces cerevisiae* | [ui:ybr068c] [pn:amino acid permease:leu/val/ile amino-acid permease bap2] [gn:bap2:ybr0629] [gtcfc:11.1:12.1:12.6] [kegghc:14.2] [sgdfc:1.1.3:7.4.0:8.7.0:9.1.0:17.0.0] [db:gtc-*saccharomyces cerevisiae*] |
| CONTIG4339 | 20593915_f1_1 | 5951 | 20054 | 1020 | 340 | YBR298C | 681 | 4.0(10)-67 | *Saccharomyces cerevisiae* | [ui:ybr298c] [pn:maltose permease] [gn:mal31:mal61:mal6l:ybr2 116] [gtcfc:11.1:12.2:12.6] [kegghc:14.2] [sgdfc:1.5.3:7.3.0:8.7.0:9.1.0] [db:gtc-*saccharomyces cerevisiae*] |
| CONTIG2329 | 448958_f2_1 | 5952 | 20055 | 606 | 202 | YCL027W | 122 | 2.0(10)-5 | *Saccharomyces cerevisiae* | [ui:ycl027w] [pn:cell fusion protein:nuclear fusion protein fus1] [gn:fus1:ycl27w] [gtcfc:11.1:12.8:12.9] [kegghc:14.2] [sgdfc:3.3.0:9.1.0:10.1.6] [db:gtc-*saccharomyces cerevisiae*] |
| CONTIG1755 | 34117012_c3_5 | 5953 | 20056 | 393 | 131 | YCR011C | 292 | 1.3(10)-24 | *Saccharomyces cerevisiae* | [ui:ycr011c] [pn:atp-dependent permease:probable atp-dependent permease precursor] [gn:adp1:ycr11:ycyr105] [gtcfc:11.1:12.6] [kegghc:14.2] [sgdfc:7.9.0:9.1.0] [db:gtc-*saccharomyces cerevisiae*] |
| CONTIG1755 | 21687875_c1_3 | 5954 | 20057 | 861 | 287 | YCR011C | 676 | 5.5(10)-66 | *Saccharomyces cerevisiae* | [ui:ycr011c] [pn:atp-dependent permease:probable atp-dependent |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2857 | 4394530_c3_5 | 5955 | 20058 | 1008 | 336 | YCR011C | 957 | 2.2(10)-96 | *Saccharomyces cerevisiae* | permease precursor] [gn:adp1;ycr11cycr105] [gtcfc:11.1:12.6] [keggfc:14.2] [sgdfc:7.9.0:9.1.0] [dbgtc-*saccharomyces cerevisiae*] [ui:ycr011c] [pn:atp-dependent permease;probable atp-dependent permease precursor] [gn:adp1;ycr11cycr105] [gtcfc:11.1:12.6] [keggfc:14.2] [sgdfc:7.9.0:9.1.0] [dbgtc-*saccharomyces cerevisiae*] |
| CONTIG3284 | 1408501_f3_2 | 5956 | 20059 | 465 | 155 | YCR011C | 238 | 7.7(10)-19 | *Saccharomyces cerevisiae* | [ui:ycr011c] [pn:atp-dependent permease;probable atp-dependent permease precursor] [gn:adp1;ycr11cycr105] [gtcfc:11.1:12.6] [keggfc:14.2] [sgdfc:7.9.0:9.1.0] [dbgtc-*saccharomyces cerevisiae*] |
| CONTIG5055 | 32305143_c2_11 | 5957 | 20060 | 4089 | 1363 | YCR038C | 305 | 2.7(10)-31 | *Saccharomyces cerevisiae* | [ui:ycr038c] [pn:gdp/gtp exchange factor for rsr1p/bud1p;bud site selection protein bud5] [gn:bud5;ycr38cycr526] [gtcfc:11.1:12.8] [keggfc:13.3] [sgdfc:3.2.0:9.1.0] [dbgtc-*saccharomyces cerevisiae*] |
| CONTIG1269 | 14472817_f1_1 | 5958 | 20061 | 984 | 328 | YCR098C | 385 | 9.5(10)-36 | *Saccharomyces cerevisiae* | [ui:ycr098c] [pn:similarity to phosphate transporter proteins;probable metabolite transport protein ycr98c] [gn:git1;ycr98cycr137] [gtcfc:12.4:11.1:13.10] [keggfc:14.2] [sgdfc:1.4.3:7.2.3:7.3.0:9.1.0:17.0.0] [db:gtc-*saccharomyces cer*] |
| CONTIG4599 | 484681_c3_9 | 5959 | 20062 | 999 | 333 | YCR098C | 297 | 6.9(10)-26 | *Saccharomyces cerevisiae* | [ui:ycr098c] [pn:similarity to phosphate transporter proteins;probable metabolite transport protein ycr98c] [gn:git1;ycr98cycr137] [gtcfc:12.4:11.1:13.10] [keggfc:14.2] [sgdfc:1.4.3:7.2.3:7.3.0:9.1.0:17.0.0] [db:gtc-*saccharomyces cer*] |
| CONTIG4599 | 5913317_c3_8 | 5960 | 20063 | 468 | 156 | YCR098C | 174 | 1.8(10)-12 | *Saccharomyces cerevisiae* | [ui:ycr098c] [pn:similarity to phosphate transporter proteins;probable metabolite transport protein ycr98c] [gn:git1;ycr98cycr137] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4947 | 434552_f1_1 | 5961 | 20064 | 930 | 310 | YCR098C | 921 | 1.5(10)-92 | *Saccharomyces cerevisiae* | [gtcfc:12.4:11.1:13.10] [keggfc:14.2] [sgdfc:1.4.3:7.2.3:7.3.0:9.1.0:17.0.0] [db:gtc-*saccharomyces cer* [ui:ycr098c] [pn:similarity to phosphate transporter proteins:probable metabolite transport protein ycr98c] [gn:gjt1:ycr98c:cyc137] [gtcfc:12.4:11.1:13.10] [keggfc:14.2] |
| CONTIG98 | 20959800_c1_1 | 5962 | 20065 | 594 | 198 | YCR098C | 224 | 7.0(10)-18 | *Saccharomyces cerevisiae* | [sgdfc:1.4.3:7.2.3:7.3.0:9.1.0:17.0.0] [db:gtc-*saccharomyces cer* [ui:ycr098c] [pn:similarity to phosphate transporter proteins:probable metabolite transport protein ycr98c] [gn:gjt1:ycr98c:cyc137] [gtcfc:12.4:11.1:13.10] [keggfc:14.2] |
| CONTIG3589 | 14235307_f2_1 | 5963 | 20066 | 1599 | 533 | YDL210W | 1196 | 1.1(10)-121 | *Saccharomyces cerevisiae* | [ui:ydl210w] [pn:gaba-specific high-affinity permease:gaba-specific permease:gaba-specific transport protein] [gn:uga4:d1037] [gtcfc:11.1:12.1] [keggfc:14.2] [sgdfc:7.4.0:8.7.0:9.1.0:17.0.0] [db:gtc-*saccharomyces cerevisiae*] |
| CONTIG5100 | 11844785_f3_1 | 5964 | 20067 | 1428 | 476 | YDL210W | 1063 | 1.3(10)-107 | *Saccharomyces cerevisiae* | [ui:ydl210w] [pn:gaba-specific high-affinity permease:gaba-specific transport protein] [gn:uga4:d1037] [gtcfc:11.1:12.1] [keggfc:14.2] [sgdfc:7.4.0:8.7.0:9.1.0:17.0.0] [db:gtc-*saccharomyces cerevisiae*] |
| CONTIG5563 | 20969078_f2_6 | 5965 | 20068 | 2298 | 766 | YDL194W | 1369 | 5.0(10)-140 | *Saccharomyces cerevisiae* | [ui:ydl194w] [pn:high-affinity glucose transporter/regulatory protein:high-affinity glucose transporter snf3] [gn:snf3:d1234] [gtcfc:12.2:11.1:12.13] [keggfc:14.2] |
| b4x10274.y | 9860017_f1_1 | 5966 | 20069 | 405 | 135 | YDL194W | 135 | 6.2(10)-8 | *Saccharomyces cerevisiae* | [sgdfc:1.5.2:1.5.3:7.3.0:8.7.0:9.1.0:17.0.0] [db:gtc-*saccharomyces cer* [ui:ydl194w] [pn:high-affinity glucose transporter/regulatory protein:high-affinity glucose transporter snf3] [gn:snf3:d1234] [gtcfc:12.2:11.1:12.13] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1940 | 26172692_c1_2 | 5967 | 20070 | 1077 | 359 | YDR011W | 1022 | 1.0(10)-102 | *Saccharomyces cerevisiae* | [keggfc:14.2] [sgdfc:1.5.2:1.5.3:7.3.0:8.7.0:9.1.0:17.0.0] [db:gtc-*saccharomyces cer*] [ui:ydr011w] [pn:multidrug resistance protein:snq2 protein] [gn:snq2:yd8119] [gtcfc:11.1:12.12:12.6] |
| CONTIG665 | 23838938_c3_4 | 5968 | 20071 | 915 | 305 | YDR011W | 535 | 2.7(10)-50 | *Saccharomyces cerevisiae* | [keggfc:14.2] [sgdfc:7.9.0:9.1.0:11.3.0] [db:gtc-*saccharomyces cerevisiae*] [ui:ydr011w] [pn:multidrug resistance protein:snq2 protein] [gn:snq2:yd8119] [gtcfc:11.1:12.12:12.6] |
| CONTIG900 | 5269432_f3_1 | 5969 | 20072 | 801 | 267 | YDR011W | 244 | 2.8(10)-19 | *Saccharomyces cerevisiae* | [keggfc:14.2] [sgdfc:7.9.0:9.1.0:11.3.0] [db:gtc-*saccharomyces cerevisiae*] [ui:ydr011w] [pn:multidrug resistance protein:snq2 protein] [gn:snq2:yd8119] [gtcfc:11.1:12.12:12.6] |
| b1x17948.x | 21611632_c1_1 | 5970 | 20073 | 831 | 277 | YDR011W | 618 | 3.8(10)-59 | *Saccharomyces cerevisiae* | [keggfc:14.2] [sgdfc:7.9.0:9.1.0:11.3.0] [db:gtc-*saccharomyces cerevisiae*] [ui:ydr011w] [pn:multidrug resistance protein:snq2 protein] [gn:snq2:yd8119] [gtcfc:11.1:12.12:12.6] |
| CONTIG4946 | 26354552_c2_7 | 5971 | 20074 | 339 | 113 | YDR342C | 108 | 2.7(10)-5 | *Saccharomyces cerevisiae* | [ui:ydr342c] [pn:high-affinity hexose transporter:high affinity hexose transporter hxt6] [gn:hxt7:d9651] [gtcfc:12.2:11.1] [keggfc:14.2] |
| CONTIG5043 | 814092_c2_10 | 5972 | 20075 | 1521 | 507 | YDR342C | 1320 | 7.9(10)-135 | *Saccharomyces cerevisiae* | [sgdfc:1.5.3:7.3.0:8.7.0:9.1.0:17.0.0] [db:gtc-*saccharomyces cerevisiae*] [ui:ydr342c] [pn:high-affinity hexose transporter:high affinity hexose transporter hxt6] [gn:hxt7:d9651] [gtcfc:12.2:11.1] |
| CONTIG5004 | 5866544_c1_2 | 5973 | 20076 | 1257 | 419 | YDR342C | 1100 | 1.6(10)-111 | *Saccharomyces cerevisiae* | [sgdfc:1.5.3:7.3.0:8.7.0:9.1.0:17.0.0] [db:gtc-*saccharomyces cerevisiae*] [ui:ydr342c] [pn:high-affinity hexose transporter:high affinity hexose transporter hxt6] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG473 | 25423837_f1_1 | 5974 | 20077 | 648 | 216 | YDR497C | 256 | 3.1(10)-21 | Saccharomyces cerevisiae | [gn:hxt7:d9651] [gtcfc:12.2:11.1] [keggfc:14.2] [sgdfc:1.5.3:7.3.0:8.7.0:9.1.0:17.0.0] [db:gtc-saccharomyces cerevisiae] |
| CONTIG5237 | 4069677_f1_2 | 5975 | 20078 | 1662 | 554 | YDR536W | 1639 | 1.2(10)-168 | Saccharomyces cerevisiae | [ui:ydr497c] [pn:myo-inositol permease, major myo-inositol transporter 1] [gn:itr1:d9719] [gtcfc:12.2:11.1:8.2] [keggfc:14.2] [sgdfc:1.5.3:7.3.0:8.7.0:9.1.0:17.0.0] [db:gtc-saccharomyces cerevisiae] |
| CONTIG5348 | 26360285_f1_3 | 5976 | 20079 | 1503 | 501 | YDR536W | 549 | 4.0(10)-53 | Saccharomyces cerevisiae | [ui:ydr536w] [pn:strong similarity to members of the sugar permease family:sugar transporter stl1] [gn:stl1:d9719] [gtcfc:12.2:11.1] [keggfc:14.2] [sgdfc:1.5.3:7.3.0:9.1.0:17.0.0] [db:gtc-saccharomyces cerevisiae] |
| CONTIG5348 | 13712753_f3_10 | 5977 | 20080 | 273 | 91 | YDR536W | 150 | 8.3(10)-10 | Saccharomyces cerevisiae | [ui:ydr536w] [pn:strong similarity to members of the sugar permease family:sugar transporter stl1] [gn:stl1:d9719] [gtcfc:12.2:11.1] [keggfc:14.2] [sgdfc:1.5.3:7.3.0:9.1.0:17.0.0] [db:gtc-saccharomyces cerevisiae] |
| CONTIG5655 | 32455327_c3_22 | 5978 | 20081 | 978 | 326 | YEL069C | 289 | 7.2(10)-25 | Saccharomyces cerevisiae | [ui:ydr536w] [pn:strong similarity to members of the sugar permease family:sugar transporter stl1] [gn:stl1:d9719] [gtcfc:12.2:11.1] [keggfc:14.2] [sgdfc:1.5.3:7.3.0:9.1.0:17.0.0] [db:gtc-saccharomyces cerevisiae] |
| CONTIG2731 | 19532625_c1_3 | 5979 | 20082 | 1317 | 439 | YEL063C | 1315 | 2.7(10)-134 | Saccharomyces cerevisiae | [ui:yel069c] [pn:high-affinity hexose transporter hxt13] [gn:hxt13:hxt8] [gtcfc:12.2:11.1] [keggfc:14.2] [sgdfc:1.5.3:7.3.0:8.7.0:9.1.0:17.0.0] [db:gtc-saccharomyces cerevisiae] |
| CONTIG3177 | 2914055_c2_3 | 5980 | 20083 | 432 | 144 | YEL063C | 232 | 1.3(10)-18 | Saccharomyces cerevisiae | [ui:yel063c] [pn:amino acid permease:arginine permease] [gn:can1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| | | | | | | | | | | [ui:yel063c] [pn:amino acid permease:arginine permease] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3579 | 10033577_c2_6 | 5981 | 20084 | 798 | 266 | YEL063C | 709 | 4.4(10)-70 | Saccharomyces cerevisiae | [ui:yel063c] [pn:amino acid permease:arginine permease] [gn:can1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4383 | 2397692_f1_1 | 5982 | 20085 | 594 | 198 | YEL063C | 540 | 3.6(10)-52 | Saccharomyces cerevisiae | [ui:yel063c] [pn:amino acid permease:arginine permease] [gn:can1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4559 | 36564036_f2_1 | 5983 | 20086 | 1215 | 405 | YEL063C | 1160 | 7.0(10)-118 | Saccharomyces cerevisiae | [ui:yel063c] [pn:amino acid permease:arginine permease] [gn:can1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG96 | 13719753_c2_1 | 5984 | 20087 | 618 | 206 | YEL063C | 575 | 7.0(10)-56 | Saccharomyces cerevisiae | [ui:yel063c] [pn:amino acid permease:arginine permease] [gn:can1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG2651 | 15126675_c1_6 | 5985 | 20088 | 1221 | 407 | YER056C | 1172 | 3.7(10)-119 | Saccharomyces cerevisiae | [ui:yer056c] [pn:purine-cytosine permease:pcp:cytosine/purine transport protein] [gn:fcy2] [gtcfc:12.3:11.1:4.1:4.2] [keggfc:14.2] [sgdfc:1.3.7:7.6.0:8.7.0:9.1.0:17.0.0] [db:gtc-saccharomyces cerevisiae] |
| CONTIG105 | 35267137_c2_2 | 5986 | 20089 | 444 | 148 | YER118C | 199 | 1.3(10)-15 | Saccharomyces cerevisiae | [ui:yer118c] [pn:involved in the hog1 high-osmolarity signal transduction pathway:ssu81 protein:sho1 osmosensor] [gn:ssu81:sho1] [gtcfc:12.13:11.3] [keggfc:14.2] [sgdfc:9.1.0:10.3.3:11.1.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4313 | 160902_f1_3 | 5987 | 20090 | 1155 | 385 | YER118C | 270 | 1.3(10)-27 | *Saccharomyces cerevisiae* | [ui:yer118c] [pn:involved in the hog1 high-osmolarity signal transduction pathway:ssu81 protein:sho1 osmosensor] [gn:ssu81:sho1] [gtcfc:12.13:11.3] [keggfc:14.2] [sgdfc:9.10:10.3.3:11.1.0] [db:gtc-*saccharomyces cerevisiae*] |
| b9x10g01.y | 1032761_c1_2 | 5988 | 20091 | 573 | 191 | YFL026W | 201 | 1.3(10)-15 | *Saccharomyces cerevisiae* | [ui:yfl026w] [pn:pheromone alpha-factor receptor:pheromone alpha factor receptor] [gn:ste2] [gtcfc:11.11:11.3:12.8:12.9] [keggfc:13.1] [sgdfc:3.3.0:9.1.0:10.1.1] [db:gtc-*saccharomyces cerevisiae*] |
| CONTIG5813 | 35189635_c2_52 | 5989 | 20092 | 1224 | 408 | YFL011W | 331 | 1.5(10)-29 | *Saccharomyces cerevisiae* | [ui:yfl011w] [pn:hexose transporter] [gn:hxt10] [gtcfc:12.2:11.1] [keggfc:14.2] [sgdfc:1.5.3:7.3.0:8.7.0:9.1.0:17.0.0] [db:gtc-*saccharomyces cerevisiae*] |
| CONTIG4079 | 23939651_c1_4 | 5990 | 20093 | 1872 | 624 | YGL233W | 282 | 2.6(10)-21 | *Saccharomyces cerevisiae* | [ui:ygl233w] [pn:vesicular traffic control protein] [gn:sec15] [gtcfc:11.1:12.10] [keggfc:14.2] [sgdfc:8.3.0:8.6.0:9.1.0:9.2.0] [db:gtc-*saccharomyces cerevisiae*] |
| CONTIG4714 | 12897316_f2_1 | 5991 | 20094 | 678 | 226 | YGL233W | 113 | 2.7(10)-10 | *Saccharomyces cerevisiae* | [ui:ygl233w] [pn:vesicular traffic control protein] [gn:sec15] [gtcfc:11.1:12.10] [keggfc:14.2] [sgdfc:8.3.0:8.6.0:9.1.0:9.2.0] [db:gtc-*saccharomyces cerevisiae*] |
| CONTIG3746 | 12188155_f2_2 | 5992 | 20095 | 1353 | 451 | YGL077C | 1117 | 2.6(10)-113 | *Saccharomyces cerevisiae* | [ui:ygl077c] [pn:choline permease:choline transport protein] [gn:hnm1:ctr1] [gtcfc:12.2:11.1] [keggfc:14.2] [sgdfc:7.4.0:8.7.0:9.1.0:17.0.0] [db:gtc-*saccharomyces cerevisiae*] |
| CONTIG5418 | 26189005_c1_10 | 5993 | 20096 | 1758 | 586 | YGL077C | 1185 | 1.6(10)-120 | *Saccharomyces cerevisiae* | [ui:ygl077c] [pn:choline permease:choline transport protein] [gn:hnm1:ctr1] [gtcfc:12.2:11.1] [keggfc:14.2] [sgdfc:7.4.0:8.7.0:9.1.0:17.0.0] [db:gtc-*saccharomyces cerevisiae*] |
| CONTIG848 | 24882176_c2_6 | 5994 | 20097 | 1143 | 381 | YGL077C | 412 | 1.3(10)-38 | *Saccharomyces cerevisiae* | [ui:ygl077c] [pn:choline permease:choline transport protein] [gn:hnm1:ctr1] [gtcfc:12.2:11.1] [keggfc:14.2] [sgdfc:7.4.0:8.7.0:9.1.0:17.0.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3434 | 10725014_c1_7 | 5995 | 20098 | 1695 | 565 | YGL008C | 2253 | 1.1(10)-233 | Saccharomyces cerevisiae | [ui:ygl008c] [pn:h+-transporting p-type atpase;plasma membrane atpase 1;proton pump] [gn:pma1] [gtcfc:12.5:11.1] [ec:3.6.1.35] [keggfc:14.1] [sgdfc:1.8.2:7.2.2:7.8.0:9.1.0] [db:gtc-saccharomyces cerevisiae] |
| CONTIG4102 | 24397650_c2_3 | 5996 | 20099 | 1083 | 361 | YGR009C | 260 | 1.5(10)-21 | Saccharomyces cerevisiae | [ui:ygr009c] [pn:protein transport protein;protein transport protein sec9] [gn:sec9:hss7] [gtcfc:12.6:11.1:12.10] [keggfc:14.2] [sgdfc:8.3.0:8.6.0:9.1.0] [db:gtc-saccharomyces cerevisiae] |
| CONTIG764 | 24500563_c2_1 | 5997 | 20100 | 192 | 64 | YGR009C | 147 | 2.1(10)-9 | Saccharomyces cerevisiae | [ui:ygr009c] [pn:protein transport protein;protein transport protein sec9] [gn:sec9:hss7] [gtcfc:12.6:11.1:12.10] [keggfc:14.2] [sgdfc:8.3.0:8.6.0:9.1.0] [db:gtc-saccharomyces cerevisiae] |
| CONTIG5663 | 4195250_c2_16 | 5998 | 20101 | 2403 | 801 | YGR014W | 94 | 0.76 | Saccharomyces cerevisiae | [ui:ygr014w] [pn:multicopy suppressor of a cdc24 bud emergence defect;protein:multicopy suppression of a budding defect 2] [gn:msb2] [gtcfc:11.1:12.8] [keggfc:14.2] [sgdfc:3.2.0:9.1.0] [db:gtc-saccharomyces cerevisiae] |
| CONTIG3541 | 553336_c3_3 | 5999 | 20102 | 666 | 222 | YGR055W | 340 | 1.8(10)-30 | Saccharomyces cerevisiae | [ui:ygr055w] [pn:high affinity methionine permease] [gn:mup1] [gtcfc:11.1:7.4.0:8.7.0:9.1.0] [keggfc:14.2] [sgdfc:1.1.3:7.4.0:8.7.0:9.1.0] [db:gtc-saccharomyces cerevisiae] |
| CONTIG2940 | 813803_f1_1 | 6000 | 20103 | 852 | 284 | YGR191W | 451 | 9.5(10)-43 | Saccharomyces cerevisiae | [ui:ygr191w] [pn:histidine permease] [gn:hip1:g7572] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG57 | 31533281_f3_2 | 6001 | 20104 | 630 | 210 | YGR191W | 497 | 1.3(10)-47 | Saccharomyces cerevisiae | [ui:ygr191w] [pn:histidine permease] [gn:hip1:g7572] [gtcfc:11.1:12.1:12.6] [keggfc:14.2] [sgdfc:1.1.3:7.4.0:8.7.0:9.1.0:17.0.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1342 | 3172050_c2_2 | 6002 | 20105 | 1086 | 362 | YGR281W | 464 | 5.5(10)-48 | *Saccharomyces cerevisiae* | [ui:ygr281w] [pn:atp-binding cassette transporter protein:oligomycin resistance atp-dependent permease] [gn:yor1] [gtcfc:11.1:12.6:13.3] [keggfc:14.2] [sgdfc:7.9.0:7.10.0:9.1.0] [db-gtc-*saccharomyces cerevisiae*] |
| CONTIG1526 | 4469127_f2_2 | 6003 | 20106 | 462 | 154 | YGR281W | 234 | 3.2(10)-18 | *Saccharomyces cerevisiae* | [ui:ygr281w] [pn:atp-binding cassette transporter protein:oligomycin resistance atp-dependent permease] [gn:yor1] [gtcfc:11.1:12.6:13.3] [keggfc:14.2] [sgdfc:7.9.0:7.10.0:9.1.0] [db-gtc-*saccharomyces cerevisiae*] |
| CONTIG1500 | 24901912_f1_1 | 6004 | 20107 | 723 | 241 | YGR281W | 512 | 9.6(10)-72 | *Saccharomyces cerevisiae* | [ui:ygr281w] [pn:atp-binding cassette transporter protein:oligomycin resistance atp-dependent permease] [gn:yor1] [gtcfc:11.1:12.6:13.3] [keggfc:14.2] [sgdfc:7.9.0:7.10.0:9.1.0] [db-gtc-*saccharomyces cerevisiae*] |
| b2x10882.x | 24891016_c3_2 | 6005 | 20108 | 495 | 165 | YGR281W | 182 | 1.1(10)-12 | *Saccharomyces cerevisiae* | [ui:ygr281w] [pn:atp-binding cassette transporter protein:oligomycin resistance atp-dependent permease] [gn:yor1] [gtcfc:11.1:12.6:13.3] [keggfc:14.2] [sgdfc:7.9.0:7.10.0:9.1.0] [db-gtc-*saccharomyces cerevisiae*] |
| b3x10485.y | 4004139_c1_1 | 6006 | 20109 | 513 | 171 | YGR281W | 499 | 1.8(10)-46 | *Saccharomyces cerevisiae* | [ui:ygr281w] [pn:atp-binding cassette transporter protein:oligomycin resistance atp-dependent permease] [gn:yor1] [gtcfc:11.1:12.6:13.3] [keggfc:14.2] [sgdfc:7.9.0:7.10.0:9.1.0] [db-gtc-*saccharomyces cerevisiae*] |
| CONTIG3184 | 4884677_c3_9 | 6007 | 20110 | 384 | 128 | YHL028W | 95 | 0.00072 | *Saccharomyces cerevisiae* | [ui:yhl028w] [pn:similarity to mucin and other ser-thr rich proteins:hypothetical 63.8 kd protein in gut1-rim1 intergenic region precursor] [gtcfc:11.1:5.3] [keggfc:14.2] [sgdfc:9.1.0] [dbgtc-*saccharomyces cerevisiae*] |
| CONTIG4476 | 25397177_c2_10 | 6008 | 20111 | 1743 | 581 | YHL028W | 109 | 0.0077 | *Saccharomyces cerevisiae* | [ui:yhl028w] [pn:similarity to mucin and other ser-thr rich |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5699 | 14629382_c1_25 | 6009 | 20112 | 1473 | 491 | YHL028W | 153 | 4.5(10)-8 | Saccharomyces cerevisiae | proteins:hypothetical 63.8 kd protein in gut1-rim1 intergenic region precursor] [gtcfc:11.1:5.3] [keggfc:14.2] [sgdfc:9.1.0] [db:gtc-saccharomyces cerevisiae] [ui:yhl028w] [pn:similarity to mucin and other ser-thr rich proteins:hypothetical 63.8 kd protein in gut1-rim1 intergenic region precursor] [gtcfc:11.1:5.3] [keggfc:14.2] [sgdfc:9.1.0] [db:gtc-saccharomyces cerevisiae] |
| CONTIG1827 | 35797776_f1_1 | 6010 | 20113 | 342 | 114 | YHL019C | 152 | 5.5(10)-10 | Saccharomyces cerevisiae | [ui:yhl019c] [pn:involved in clathrin-dependent transport processes:adaptin medium chain homolog] [gn:apm2] [gtcfc:11.1:12.16] [keggfc:14.2] [sgdfc:8.8.0:9.1.0] [db:gtc-saccharomyces cerevisiae] |
| CONTIG1827 | 23948587_f1_2 | 6011 | 20114 | 714 | 238 | YHL019C | 141 | 8.4(10)-9 | Saccharomyces cerevisiae | [ui:yhl019c] [pn:involved in clathrin-dependent transport processes:adaptin medium chain homolog] [gn:apm2] [gtcfc:11.1:12.16] [keggfc:14.2] [sgdfc:8.8.0:9.1.0] [db:gtc-saccharomyces cerevisiae] |
| CONTIG1827 | 9805182_f2_3 | 6012 | 20115 | 660 | 220 | YHL019C | 130 | 5.5(10)-6 | Saccharomyces cerevisiae | [ui:yhl019c] [pn:involved in clathrin-dependent transport processes:adaptin medium chain homolog] [gn:apm2] [gtcfc:11.1:12.16] [keggfc:14.2] [sgdfc:8.8.0:9.1.0] [db:gtc-saccharomyces cerevisiae] |
| CONTIG1042 | 23863842_f1_1 | 6013 | 20116 | 825 | 275 | YHL016C | 269 | 4.0(10)-30 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG3399 | 2913577_c1_5 | 6014 | 20117 | 819 | 273 | YHL016C | 124 | 7.0(10)-5 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG371 | 6843750_c3_4 | 6015 | 20118 | 1038 | 346 | YHL016C | 432 | 4.4(10)-40 | Saccharomyces cerevisiae | [ui:yhl016c] [pn:urea transport protein:urea active transporter] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5303 | 21492838_c2_15 | 6016 | 20119 | 1152 | 384 | YHL016C | 527 | 8.5(10)-51 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG5355 | 29344811_f2_1 | 6017 | 20120 | 1512 | 504 | YHL016C | 715 | 1.3(10)-107 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG5379 | 10975902_c2_18 | 6018 | 20121 | 2043 | 681 | YHL016C | 921 | 5.9(10)-105 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG5611 | 7070305_f1_3 | 6019 | 20122 | 609 | 203 | YHL016C | 484 | 7.2(10)-46 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG747 | 24297337_c3_9 | 6020 | 20123 | 1203 | 401 | YHL016C | 507 | 1.6(10)-48 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| b9x11469.x | 9855416_f3_1 | 6021 | 20124 | 540 | 180 | YHL016C | 109 | 3.0(10)-5 | Saccharomyces cerevisiae | [ui:yhl016c] [pn:urea transport protein:urea active transporter] [gn:dur3] [gtcfc:12.4.5.16:11.1] [keggfc:14.2] [sgdfc:1.2.3:1.8.2:7.2.2:9.1.0:17.0.0] [db:gtc-saccharomyces cerevisiae] |
| CONTIG4312 | 21673261_f1_1 | 6022 | 20125 | 429 | 143 | YHR096C | 183 | 2.5(10)-13 | Saccharomyces cerevisiae | [ui:yhr096c] [pn:strong similarity to hexose transporters:probable |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4946 | 2157665_c1_4 | 6023 | 20126 | 417 | 139 | YHR096C | 286 | 1.8(10)-24 | Saccharomyces cerevisiae | [ui:yhr096c] [pn:strong similarity to hexose transporters:probable glucose transporter] [gn:hxt5] [gtcfc:12.2:11.1] [keggfc:14.2] [sgdfc:1.5.3:7.3.0:8.7.0:9.1.0:17.0.0] [db:gtc-saccharomyces cerevisiae] |
| CONTIG5319 | 24303912_c1_6 | 6024 | 20127 | 1125 | 375 | YHR096C | 334 | 1.0(10)-29 | Saccharomyces cerevisiae | [ui:yhr096c] [pn:strong similarity to hexose transporters:probable glucose transporter] [gn:hxt5] [gtcfc:12.2:11.1] [keggfc:14.2] [sgdfc:1.5.3:7.3.0:8.7.0:9.1.0:17.0.0] [db:gtc-saccharomyces cerevisiae] |
| b3x16095.y | 33460818_c2_6 | 6025 | 20128 | 228 | 76 | YIL147C | 96 | 0.00129 | Saccharomyces cerevisiae | [ui:yil147c] [pn:two-component signal transducer:osmolarity two-component system protein sln1] [gn:sln1/ypd2] [gtcfc:12.11:11.3:12.13] [ec:2.7.3.-] [keggfc:14.1] [sgdfc:1.5.2:9.1.0:10.3.2:11.1.0] [db:gtc-saccharomyces cerevisiae] |
| CONTIG2824 | 23604063_c2_1 | 6026 | 20129 | 1047 | 349 | YIL140W | 635 | 3.1(10)-62 | Saccharomyces cerevisiae | [ui:yil140w] [pn:required for axial pattern of budding:axl2 protein precursor:sro4 protein] [gn:axl2/sro4] [gtcfc:11.1:12.8] [keggfc:14.2] [sgdfc:3.2.0:9.1.0] [db:gtc-saccharomyces cerevisiae] |
| CONTIG2142 | 16187630_f2_3 | 6027 | 20130 | 228 | 76 | YIL047C | 96 | 0.00093 | Saccharomyces cerevisiae | [ui:yil047c] [pn:member of the major facilitator superfamily:protein] [gn:syg1] [gtcfc:11.1:12.6:12.8:12.9] [keggfc:14.2] [sgdfc:3.3.0:9.1.0:10.1.6:17.0.0] [db:gtc-saccharomyces cerevisiae] |
| CONTIG3415 | 19609375_f3_3 | 6028 | 20131 | 1059 | 353 | YIL047C | 640 | 9.1(10)-63 | Saccharomyces cerevisiae | [ui:yil047c] [pn:member of the major facilitator superfamily:protein] [gn:syg1] [gtcfc:11.1:12.6:12.8:12.9] [keggfc:14.2] [sgdfc:3.3.0:9.1.0:10.1.6:17.0.0] [db:gtc-saccharomyces cerevisiae] |
| CONTIG5360 | 24085326_f3_5 | 6029 | 20132 | 1725 | 575 | YIR028W | 1437 | 3.2(10)-147 | Saccharomyces cerevisiae | [ui:yir028w] [pn:allantoin permease:allantoin transport |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3735 | 13759450_f2_4 | 6030 | 20133 | 633 | 211 | YIL219W | 238 | 2.6(10)-19 | Saccharomyces cerevisiae | protein] [gn:dal4] [gtcfc:12.6:11.1] [keggfc:14.2] [sgdfc:7.7.0:8.7.0:9.1.0:17.0.0] [db:gtc-saccharomyces cerevisiae] [ui:yil219w] [pn:hexose transport protein:hexose transporter hxt9] [gn:hxt9:j0222:hrc567] [gtcfc:12.2:11.1] [keggfc:14.2] [sgdfc:1.5.3:7.3.0:8.7.0:9.1.0:17.0.0] [db:gtc-saccharomyces cerevisiae] |
| CONTIG5448 | 21489688_c1_13 | 6031 | 20134 | 927 | 309 | YIL093C | 366 | 5.7(10)-33 | Saccharomyces cerevisiae | [ui:yjl093c] [pn:outward-rectifier potassium channel:outward-rectifier potassium channel tok1:two-domain outward rectifier k+ channel york] [gn:tok1:duk1:j0911] [gtcfc:11.1:11.3:12.10:12.6] [keggfc:14.2] [sgdfc:1.8.2:7.1.0:8.6.0:9.1. |
| CONTIG5448 | 25813802_c1_12 | 6032 | 20135 | 1287 | 429 | YIL093C | 590 | 1.8(10)-57 | Saccharomyces cerevisiae | [ui:yjl093c] [pn:outward-rectifier potassium channel:outward-rectifier potassium channel tok1:two-domain outward rectifier k+ channel york] [gn:tok1:duk1:j0911] [gtcfc:11.1:11.3:12.10:12.6] [keggfc:14.2] [sgdfc:1.8.2:7.1.0:8.6.0:9.1. |
| CONTIG2735 | 15705057_f2_1 | 6033 | 20136 | 1440 | 480 | YJR040W | 320 | 7.5(10)-28 | Saccharomyces cerevisiae | [ui:yjr040w] [pn:voltage-gated chloride channel protein:gef1 protein:voltage-gated chloride channel:clc-yl:clc-a] [gn:gef1:clcy1:j1616] [gtcfc:11.1:11.3:12.6] [keggfc:14.2] [sgdfc:1.8.2:7.1.0:8.7.0:9.1.0] [db:gtc-saccharomyces cerevis |
| CONTIG3806 | 972933_f2_3 | 6034 | 20137 | 465 | 155 | YJR040W | 376 | 6.9(10)-34 | Saccharomyces cerevisiae | [ui:yjr040w] [pn:voltage-gated chloride channel protein:gef1 protein:voltage-gated chloride channel:clc-yl:clc-a] [gn:gef1:clcy1:j1616] [gtcfc:11.1:11.3:12.6] [keggfc:14.2] [sgdfc:1.8.2:7.1.0:8.7.0:9.1.0] [db:gtc-saccharomyces cerevis |
| CONTIG3806 | 13850627_f1_2 | 6035 | 20138 | 1248 | 416 | YJR040W | 556 | 7.2(10)-54 | Saccharomyces cerevisiae | [ui:yjr040w] [pn:voltage-gated chloride channel protein:gef1 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4484 | 9781912_c3_7 | 6036 | 20139 | 2466 | 822 | YJR040W | 384 | 2.7(10)-41 | Saccharomyces cerevisiae | protein:voltage-gated chloride channel:clc-y1:clc-a] [gn:gcf1:clcy1j1616] [gtcfc:11.1:11.3:12.6] [keggfc:14.2] [sgdfc:1.8.2:7.1.0:8.7.0:9.1.0] [db:gtc-saccharomyces cerevis [ui:yjr040w] [pn:voltage-gated chloride channel protein:gef1 protein:voltage-gated chloride channel:clc-y1:clc-a] [gn:gcf1:clcy1j1616] [gtcfc:11.1:11.3:12.6] [keggfc:14.2] |
| CONTIG5246 | 9777082_f3_6 | 6037 | 20140 | 759 | 253 | YJR040W | 116 | 0.00038 | Saccharomyces cerevisiae | [sgdfc:1.8.2:7.1.0:8.7.0:9.1.0] [db:gtc-saccharomyces cerevis [ui:yjr040w] [pn:voltage-gated chloride channel protein:gef1 protein:voltage-gated chloride channel:clc-y1:clc-a] [gn:gcf1:clcy1j1616] [gtcfc:11.1:11.3:12.6] [keggfc:14.2] |
| CONTIG5649 | 2151425_c1_15 | 6038 | 20141 | 534 | 178 | YJR040W | 135 | 5.2(10)-8 | Saccharomyces cerevisiae | [sgdfc:1.8.2:7.1.0:8.7.0:9.1.0] [db:gtc-saccharomyces cerevis [ui:yjr040w] [pn:voltage-gated chloride channel protein:gef1 protein:voltage-gated chloride channel:clc-y1:clc-a] [gn:gcf1:clcy1j1616] [gtcfc:11.1:11.3:12.6] [keggfc:14.2] |
| CONTIG1183 | 4871053_f3_1 | 6039 | 20142 | 990 | 330 | YJR151C | 148 | 1.5(10)-7 | Saccharomyces cerevisiae | [sgdfc:1.8.2:7.1.0:8.7.0:9.1.0] [db:gtc-saccharomyces cerevis [ui:yjr151c] [pn:similarity to mucin proteins, ykl224c, sta1p:hypothetical 118.4 kd protein in rps7b-da15 intergenic region precursor] [gnj2223] [sgdfc:9.1.0] [dbgtc-saccharomyces cerevisiae] |
| CONTIG1562 | 23641263_c2_4 | 6040 | 20143 | 939 | 313 | YJR151C | 92 | 0.22 | Saccharomyces cerevisiae | [ui:yjr151c] [pn:similarity to mucin proteins, ykl224c, sta1p:hypothetical 118.4 kd protein in rps7b-da15 intergenic region precursor] [gnj2223] [sgdfc:9.1.0] [dbgtc-saccharomyces cerevisiae] |
| CONTIG2128 | 14568812_f2_1 | 6041 | 20144 | 402 | 134 | YJR151C | 91 | 0.03699 | Saccharomyces cerevisiae | [ui:yjr151c] [pn:similarity to mucin |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | proteins, ykl224c, sta1p:hypothetical 118.4 kd protein in rps7b-da15 intergenic region precursor] [gn:j2223] [gtcfc:11.1] [keggfc:14.2] [sgdfc:9.1.0] [db:gtc-saccharomyces cerevisiae] |
| CONTIG2535 | 14884637_f3_3 | 6042 | 20145 | 2490 | 830 | | 94 | 0.71999 | Saccharomyces cerevisiae | [ui:yjr151c] [pn:similarity to mucin proteins, ykl224c, sta1p:hypothetical 118.4 kd protein in rps7b-da15 intergenic region precursor] [gn:j2223] [gtcfc:11.1] [keggfc:14.2] [sgdfc:9.1.0] [db:gtc-saccharomyces cerevisiae] |
| CONTIG5387 | 22667311_f3_11 | 6043 | 20146 | 966 | 322 | YJR151C | 106 | 0.01499 | Saccharomyces cerevisiae | [ui:yjr151c] [pn:similarity to mucin proteins, ykl224c, sta1p:hypothetical 118.4 kd protein in rps7b-da15 intergenic region precursor] [gn:j2223] [gtcfc:11.1] [keggfc:14.2] [sgdfc:9.1.0] [db:gtc-saccharomyces cerevisiae] |
| CONTIG1416 | 13704127_c2_5 | 6044 | 20147 | 1374 | 458 | YJR152W | 1149 | 1.0(10)-116 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |
| CONTIG1150 | 26445192_c3_1 | 6045 | 20148 | 774 | 258 | YJR152W | 560 | 2.7(10)-54 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |
| CONTIG1605 | 3207831_f3_1 | 6046 | 20149 | 705 | 235 | YJR152W | 562 | 1.7(10)-54 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |
| CONTIG3088 | 24651561_c1_3 | 6047 | 20150 | 660 | 220 | YJR152W | 325 | 6.5(10)-29 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |
| CONTIG5778 | 24250927_c1_23 | 6048 | 20151 | 1659 | 553 | YJR152W | 1205 | 1.2(10)-122 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |
| b1x18608.x | 6055325_f3_1 | 6049 | 20152 | 189 | 63 | YJR152W | 95 | 0.00063 | Saccharomyces cerevisiae | [ui:yjr152w] [pn:allantoate permease] [gn:da15:urep1:j2230] [gtcfc:11.1:12.6] [keggfc:14.2] [sgdfc:7.7.0:8.7.0:9.1.0:17.0.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG171 | 31267580_f2_1 | 6050 | 20153 | 756 | 252 | YKL220C | 289 | 1.3(10)-24 | *Saccharomyces cerevisiae* | [db:gtc-*saccharomyces cerevisiae*] [ui:ykl220c] [pn:ferric and cupric reductase:ferric reductase transmembrane component 2 precursor] [gn:frc2] [gtcfc:11.1:12.6] [keggfc:14.2] [sgdfc:1.8.1.9.1.0] [db:gtc-*saccharomyces cerevisiae*] |
| CONTIG4756 | 7040907_c1_12 | 6051 | 20154 | 1722 | 574 | YKL220C | 494 | 3.2(10)-47 | *Saccharomyces cerevisiae* | [ui:ykl220c] [pn:ferric and cupric reductase:ferric reductase transmembrane component 2 precursor] [gn:frc2] [gtcfc:11.1:12.6] [keggfc:14.2] [sgdfc:1.8.1.9.1.0] [db:gtc-*saccharomyces cerevisiae*] |
| CONTIG1914 | 20742167_c1_8 | 6052 | 20155 | 549 | 183 | YKL178C | 338 | 9.0(10)-31 | *Saccharomyces cerevisiae* | [ui:ykl178c] [pn:pheromone a-factor receptor:pheromone a factor receptor] [gn:ste3] [gtcfc:11.1.3:12.8:12.9] [keggfc:13.1] [sgdfc:3.3.0:9.1.0:10.1.1] [db:gtc-*saccharomyces cerevisiae*] |
| CONTIG1879 | 1067693_f1_1 | 6053 | 20156 | 633 | 211 | YKR039W | 559 | 3.5(10)-54 | *Saccharomyces cerevisiae* | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-*saccharomyces cerevisiae*] |
| CONTIG2695 | 2386458_f2_1 | 6054 | 20157 | 771 | 257 | YKR039W | 625 | 3.5(10)-61 | *Saccharomyces cerevisiae* | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-*saccharomyces cerevisiae*] |
| CONTIG2933 | 3908427_f3_1 | 6055 | 20158 | 1038 | 346 | YKR039W | 581 | 1.6(10)-56 | *Saccharomyces cerevisiae* | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-*saccharomyces cerevisiae*] |
| CONTIG4473 | 289027_c3_7 | 6056 | 20159 | 702 | 234 | YKR039W | 700 | 4.0(10)-69 | *Saccharomyces cerevisiae* | [ui:ykr039w] [pn:general amino acid permease:general amino-acid permease] [gn:gap1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG458 | 13062660_f1_1 | 6057 | 20160 | 915 | 305 | YKR039W | 783 | 6.2(10)-78 | Saccharomyces cerevisiae | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4723 | 4879405_f1_1 | 6058 | 20161 | 1527 | 509 | YKR039W | 1023 | 2.2(10)-103 | Saccharomyces cerevisiae | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4899 | 6147812_c2_9 | 6059 | 20162 | 345 | 115 | YKR039W | 108 | 2.8(10)-5 | Saccharomyces cerevisiae | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| b1x18591.y | 391899_c1_1 | 6060 | 20163 | 528 | 176 | YKR039W | 462 | 6.5(10)-44 | Saccharomyces cerevisiae | [ui:ykr039w] [pn:general amino acid permease:general amino-acid permease] [gn:gap1] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4208 | 25986017_f1_1 | 6061 | 20164 | 1734 | 578 | YKR050W | 871 | 3.1(10)-129 | Saccharomyces cerevisiae | [ui:ykr050w] [pn:moderate-affinity potassium transport protein:potassium transport protein, low-affinity] [gn:trk2:rpd2] [gtcfc:12.5:11.1] [keggfc:14.2] [sgdfc:7.2.2:8.7.0:9.1.0:17.0.0] [db:gtc-saccharomyces cerevisiae] |
| CONTIG5487 | 16526511_f2_6 | 6062 | 20165 | 1341 | 447 | YKR050W | 391 | 1.1(10)-39 | Saccharomyces cerevisiae | [ui:ykr050w] [pn:moderate-affinity potassium transport protein:potassium transport protein, low-affinity] [gn:trk2:rpd2] [gtcfc:12.5:11.1] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4679 | 25975752_f1_1 | 6063 | 20166 | 624 | 208 | YKR093W | 651 | 6.2(10)-64 | Saccharomyces cerevisiae | [sgdfc:7.2.2:8.7.0:9.1.0:17.0.0] [db:gtc-saccharomyces cerevisiae] [ui:ykr093w] [pn:peptide transporter:peptide transporter ptr2:peptide permease ptr2] [gn:ptr2:ykr413] [gtcfc:12.1:11.1] [keggfc:14.2] [sgdfc:7.11.0:8.8.0:9.1.0:17.0.0] [db:gtc-saccharomyces cerevisiae] |
| CONTIG4793 | 10976000_c2_11 | 6064 | 20167 | 963 | 321 | YKR093W | 780 | 1.3(10)-77 | Saccharomyces cerevisiae | [ui:ykr093w] [pn:peptide transporter:peptide transporter ptr2:peptide permease ptr2] [gn:ptr2:ykr413] [gtcfc:12.1:11.1] [keggfc:14.2] [sgdfc:7.11.0:8.8.0:9.1.0:17.0.0] [db:gtc-saccharomyces cerevisiae] |
| CONTIG4946 | 15517080_c2_5 | 6065 | 20168 | 816 | 272 | YLR081W | 692 | 2.7(10)-68 | Saccharomyces cerevisiae | [ui:ylr081w] [pn:galactose and glucose permease:galactose transporter:galactose permease] [gn:gal2:imp1] [gtcfc:12.2:11.1:1.6] [keggfc:14.2] [sgdfc:1.5.3:7.3.0:8.7.0:9.1.0:17.0.0] [db:gtc-saccharomyces cerevisiae] |
| CONTIG1005 | 9886332_f1_1 | 6066 | 20169 | 372 | 124 | YLR081W | 157 | 1.5(10)-10 | Saccharomyces cerevisiae | [ui:ylr081w] [pn:galactose and glucose permease:galactose transporter:galactose permease] [gn:gal2:imp1] [gtcfc:12.2:11.1:1.6] [keggfc:14.2] [sgdfc:1.5.3:7.3.0:8.7.0:9.1.0:17.0.0] [db:gtc-saccharomyces cerevisiae] |
| CONTIG2624 | 24225907_f2_2 | 6067 | 20170 | 534 | 178 | YLR110C | 138 | 1.3(10)-9 | Saccharomyces cerevisiae | [ui:ylr110c] [pn:putative pseudogene] [gtcfc:11.1] [keggfc:14.2] [sgdfc:9.1.0] [db:gtc-saccharomyces cerevisiae] |
| CONTIG2890 | 1291390_c1_3 | 6068 | 20171 | 1323 | 441 | YLR110C | 108 | 9.3(10)-6 | Saccharomyces cerevisiae | [ui:ylr110c] [pn:putative pseudogene] [gtcfc:11.1] [keggfc:14.2] [sgdfc:9.1.0] [db:gtc-saccharomyces cerevisiae] |
| CONTIG4658 | 6503752_f3_3 | 6069 | 20172 | 492 | 164 | YLR229C | 645 | 2.7(10)-63 | Saccharomyces cerevisiae | [ui:ylr229c] [pn:gtp-binding protein of ras superfamily:cell division control protein 42] [gn:cdc42:sno2:18083] [gtcfc:11.1:11.3:12.13:12.8:12.9] [keggfc:13.1.13.3] [sgdfc:3.2.0:3.3.0:3.8.0:9.1.0:10.1.2: 10.2.3] [db:gtc-saccharomyces c |
| CONTIG4763 | 11881550_f3_5 | 6070 | 20173 | 198 | 66 | YLR229C | 247 | 4.0(10)-21 | Saccharomyces cerevisiae | [ui:ylr229c] [pn:gtp-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | protein of ras superfamily:cell division control protein 42] [gn:cdc42:sro2:18083] [gtcfc:11.1:11.3:12.13:12.8:12.9] [keggfc:13.1:13.3] [sgdfc:3.2.0:3.3.0:3.8.0:9.1.0:10.1.2: 10.2.3] [dbgtc-*saccharomyces c* |
| CONTIG1985 | 14878405_f2_2 | 6071 | 20174 | 762 | 254 | YLR343W | 627 | 2.2(10)-61 | *Saccharomyces cerevisiae* | [ui:ylr343w] [pn:strong similarity to gas1p and c. *albicans* ph responsive protein] [gtcfc:11.1] [keggfc:14.2] [sgdfc:9.1.0] [dbgtc-*saccharomyces cerevisiae* |
| CONTIG3168 | 20600817_f1_1 | 6072 | 20175 | 1074 | 358 | YLR343W | 415 | 6.2(10)-39 | *Saccharomyces cerevisiae* | [ui:ylr343w] [pn:strong similarity to gas1p and c. *albicans* ph responsive protein] [gtcfc:11.1] [keggfc:14.2] [sgdfc:9.1.0] [dbgtc-*saccharomyces cerevisiae* |
| CONTIG2344 | 12129432_c1_4 | 6073 | 20176 | 1755 | 585 | YML123C | 1014 | 1.5(10)-194 | *Saccharomyces cerevisiae* | [ui:yml123c] [pn:high-affinity inorganic phosphate/h+ symporter:inorganic phosphate transporter pho84] [gn:pho84:ym7056] [gtcfc:12.4:11.1:13.10] [keggfc:14.2] [sgdfc:1.4.3:1.8.2:7.2.3:7.3.0:8.7.0: 9.1.0:17.0.0] [dbgtc-*saccharomyces ce* |
| CONTIG276 | 14886718_f3_1 | 6074 | 20177 | 573 | 191 | YMR058W | 577 | 4.2(10)-56 | *Saccharomyces cerevisiae* | [ui:ymr058w] [pn:cell surface ferroxidase:iron transport multicopper oxidase] [gtcfc:12.6:11.3] [gn:fet3:ym9796] [sgdfc:1.8.1:8.7.0:9.1.0] [db:gtc-*saccharomyces cerevisiae* |
| CONTIG4427 | 4688293_c2_2 | 6075 | 20178 | 1827 | 609 | YMR058W | 1480 | 8.8(10)-152 | *Saccharomyces cerevisiae* | [ui:ymr058w] [pn:cell surface ferroxidase:iron transport multicopper oxidase] [gn:fet3:ym9796] [gtcfc:12.6:11.3] [keggfc:14.2] |
| CONTIG4629 | 5351452_c3_9 | 6076 | 20179 | 963 | 321 | YMR058W | 910 | 2.2(10)-91 | *Saccharomyces cerevisiae* | [ui:ymr058w] [pn:cell surface ferroxidase:iron transport multicopper oxidase] [gn:fet3:ym9796] [gtcfc:12.6:11.3] [keggfc:14.2] [sgdfc:1.8.1:8.7.0:9.1.0] [db:gtc-*saccharomyces cerevisiae* |
| CONTIG5726 | 25672061_c2_27 | 6077 | 20180 | 1728 | 576 | YMR058W | 1658 | 1.2(10)-170 | *Saccharomyces* | [ui:ymr058w] [pn:cell surface |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG806 | 15041078_f1_1 | 6078 | 20181 | 1179 | 393 | YMR058W | 1093 | 9.0(10)-111 | Saccharomyces cerevisiae | ferroxidase:iron transport multicopper oxidase [gn:fet3;ym9796] [gtcfc:12.6:11.3] [keggfc:14.2] [sgdfc:1.8.1:8.7:0:9.1.0] [db:gtc-saccharomyces cerevisiae] [ui:ymr058w] [pn:cell surface ferroxidase:iron transport multicopper oxidase [gn:fet3;ym9796] [gtcfc:12.6:11.3] [keggfc:14.2] [sgdfc:1.8.1:8.7:0:9.1.0] [db:gtc-saccharomyces cerevisiae] |
| CONTIG4895 | 14570426_f2_2 | 6079 | 20182 | 561 | 187 | YMR183C | 331 | 5.0(10)-30 | Saccharomyces cerevisiae | [ui:ymr183c] [pn:involved in vesicle transport from golgi to plasma membrane:sso2 protein] [gn:sso2;ym8010] [gtcfc:12.6:11.1:12.10:12.16] [keggfc:14.2] [sgdfc:8.3.0:9.1.0] [db:gtc-saccharomyces cerevisiae] |
| CONTIG1375 | 206887_c1_3 | 6080 | 20183 | 750 | 250 | YMR243C | 494 | 2.7(10)-47 | Saccharomyces cerevisiae | [ui:ymr243c] [pn:zinc- and cadmium resistance protein:zinc/cadmium resistance protein] [gn:zrc1;ym9408] [gtcfc:11.1:12.12:12.6] [keggfc:14.2] [sgdfc:1.8.1:7.2.1:8.7:0:9.1.0:11.3.0:17.0.0] [db:gtc-saccharomyces cerevisiae] |
| CONTIG5794 | 24610312_f3_15 | 6081 | 20184 | 771 | 257 | YMR243C | 173 | 2.0(10)-21 | Saccharomyces cerevisiae | [ui:ymr243c] [pn:zinc- and cadmium resistance protein:zinc/cadmium resistance protein] [gn:zrc1;ym9408] [gtcfc:11.1:12.12:12.6] [keggfc:14.2] [sgdfc:1.8.1:7.2.1:8.7:0:9.1.0:11.3.0:17.0.0] [db:gtc-saccharomyces cerevisiae] |
| CONTIG2873 | 7291678_c1_6 | 6082 | 20185 | 735 | 245 | YMR307W | 776 | 3.5(10)-77 | Saccharomyces cerevisiae | [ui:ymr307w] [pn:glycophospholipid-anchored surface glycoprotein:glycolipid anchored surface protein precursor:glycoprotein gp115] [gn:gas1;ggp1;ym9952] [gtcfc:11.1] [keggfc:14.2] [sgdfc:9.1.0] [db:gtc-saccharomyces cerevisiae] |
| CONTIG2446 | 29320327_c3_9 | 6083 | 20186 | 1590 | 530 | YMR317W | 133 | 2.8(10)-5 | Saccharomyces cerevisiae | [ui:ymr317w] [pn:similarity to mucins, glucan 1,4-alpha- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3169 | 10547807_c3_2 | 6084 | 20187 | 1065 | 355 | YMR317W | 120 | 0.00036 | Saccharomyces cerevisiae | glucosidase and exo-alpha-sialidase:hypothetical 113.1 kd protein in pre5-fet4 intergenic region] [gn:ymr316w:ym9924] [gtcfc:11.1] [keggfc:14.2] [sgdfc:9.1.0] [db:gtc-saccharomyces [ui:ymr317w] [pn:similarity to mucins, glucan 1,4-alpha-glucosidase and exo-alpha-sialidase:hypothetical 113.1 kd protein in pre5-fet4 intergenic region] [gn:ymr316w:ym9924] [gtcfc:11.1] [keggfc:14.2] |
| CONTIG2446 | 9821013_f3_4 | 6085 | 20188 | 597 | 199 | YMR317W | 104 | 0.00979 | Saccharomyces cerevisiae | [sgdfc:9.1.0] [db:gtc-saccharomyces [ui:ymr317w] [pn:similarity to mucins, glucan 1,4-alpha-glucosidase and exo-alpha-sialidase:hypothetical 113.1 kd protein in pre5-fet4 intergenic region] [gn:ymr316w:ym9924] [gtcfc:11.1] [keggfc:14.2] |
| CONTIG4341 | 131306_f3_3 | 6086 | 20189 | 999 | 333 | YNL291C | 374 | 1.7(10)-34 | Saccharomyces cerevisiae | [sgdfc:9.1.0] [db:gtc-saccharomyces [ui:ynl291c] [pn:involved in ca2+ influx during mating:mid1 protein] [gn:mid1:n0530] [gtcfc:11.1:12.9] [keggfc:14.2] [sgdfc:3.3.0:9.1.0] [db:gtc-saccharomyces cerevisiae] |
| CONTIG4341 | 22318952_f1_1 | 6087 | 20190 | 738 | 246 | YNL291C | 448 | 2.0(10)-42 | Saccharomyces cerevisiae | [ui:ynl291c] [pn:involved in ca2+ influx during mating:mid1 protein] [gn:mid1:n0530] [gtcfc:11.1:12.9] [keggfc:14.2] [sgdfc:3.3.0:9.1.0] [db:gtc-saccharomyces cerevisiae] |
| CONTIG4258 | 35422500_c2_4 | 6088 | 20191 | 702 | 234 | YNL268W | 203 | 1.8(10)-15 | Saccharomyces cerevisiae | [ui:ynl268w] [pn:lysine-specific high-affinity permease:lysine-specific permease] [gn:lyp1:n0790] [gtcfc:11.1:12.1:12.6] [sgdfc:1.1.3:7.4.0:8.7.0:9.1.0:17.0.0] [keggfc:14.2] [db:gtc-saccharomyces cerevisiae] |
| CONTIG5516 | 9787553_c3_17 | 6089 | 20192 | 432 | 144 | YNL268W | 150 | 9.3(10)-10 | Saccharomyces cerevisiae | [ui:ynl268w] [pn:lysine-specific high-affinity permease:lysine-specific permease] [gn:lyp1:n0790] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG4856 | 35425753_c2_11 | 6090 | 20193 | 723 | 241 | YNL142W | 555 | 9.1(10)-54 | Saccharomyces | [ui:ynl142w] [pn:high affinity low |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | capacity ammonia permease:ammonium transporter mep2] [gn:mep2:n1207:n1820] [gtcfc:12.5:11.1] [keggfc:14.2] [sgdfc:1.2.3:7.2.2.8.7.0:9.1.0:17.0.0] [db:gtc-saccharomyces cerevisiae] |
| CONTIG3294 | 23885417_f3_1 | 6091 | 20194 | 231 | 77 | YNL142W | 123 | 5.5(10)-7 | Saccharomyces cerevisiae | [ui:ynl142w] [pn:high affinity low capacity ammonia permease:ammonium transporter mep2] [gn:mep2:n1207:n1820] [gtcfc:12.5:11.1] [keggfc:14.2] [sgdfc:1.2.3:7.2.2.8.7.0:9.1.0:17.0.0] [db:gtc-saccharomyces cerevisiae] |
| CONTIG5673 | 239440050_f3_22 | 6092 | 20195 | 387 | 129 | YNL142W | 297 | 5.7(10)-26 | Saccharomyces cerevisiae | [ui:ynl142w] [pn:high affinity low capacity ammonia permease:ammonium transporter mep2] [gn:mep2:n1207:n1820] [gtcfc:12.5:11.1] [keggfc:14.2] [sgdfc:1.2.3:7.2.2.8.7.0:9.1.0:17.0.0] [db:gtc-saccharomyces cerevisiae] |
| CONTIG2519 | 972775_c2_3 | 6093 | 20196 | 492 | 164 | YNR044W | 92 | 0.0019 | Saccharomyces cerevisiae | [ui:ynr044w] [pn:a-agglutinin anchor subunit:a-agglutinin attachment subunit precursor] [gn:aga1:n3431] [gtcfc:11.1:12.9] [keggfc:14.2] [sgdfc:3.3.0:9.1.0] [db:gtc-saccharomyces cerevisiae] |
| CONTIG3537 | 7119442_f2_1 | 6094 | 20197 | 2055 | 685 | YNR044W | 177 | 4.2(10)-10 | Saccharomyces cerevisiae | [ui:ynr044w] [pn:a-agglutinin anchor subunit:a-agglutinin attachment subunit precursor] [gn:aga1:n3431] [gtcfc:11.1:12.9] [keggfc:14.2] [sgdfc:3.3.0:9.1.0] [db:gtc-saccharomyces cerevisiae] |
| CONTIG3914 | 16438431_f2_1 | 6095 | 20198 | 666 | 222 | YNR044W | 93 | 0.11 | Saccharomyces cerevisiae | [ui:ynr044w] [pn:a-agglutinin anchor subunit:a-agglutinin attachment subunit precursor] [gn:aga1:n3431] [gtcfc:11.1:12.9] [keggfc:14.2] [sgdfc:3.3.0:9.1.0] [db:gtc-saccharomyces cerevisiae] |
| CONTIG4784 | 19707027_f2_5 | 6096 | 20199 | 1305 | 435 | YNR044W | 104 | 0.02199 | Saccharomyces cerevisiae | [ui:ynr044w] [pn:a-agglutinin anchor subunit:a-agglutinin attachment subunit precursor] [gn:aga1:n3431] [gtcfc:11.1:12.9] [keggfc:14.2] [sgdfc:3.3.0:9.1.0] [db:gtc-saccharomyces cerevisiae] |
| CONTIG4984 | 979811_c2_10 | 6097 | 20200 | 666 | 222 | YNR044W | 98 | 0.033 | Saccharomyces cerevisiae | [ui:ynr044w] [pn:a-agglutinin anchor subunit:a-agglutinin |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5771 | 7223407_f2_14 | 6098 | 20201 | 2118 | 706 | YNR044W | 122 | 0.00054 | Saccharomyces cerevisiae | attachment subunit precursor] [gn:aga1:n3431] [gtcfc:11.1:12.9] [keggfc:14.2] [sgdfc:3.3.0:9.1.0] [db:gtc-saccharomyces cerevisiae] [ui:ynr044w] [pn:a-agglutinin anchor subunit precursor |
| b2x16511.y | 19800668_c3_3 | 6099 | 20202 | 645 | 215 | YNR044W | 124 | 1.6(10)-5 | Saccharomyces cerevisiae | [ui:ynr044w] [pn:a-agglutinin anchor subunit precursor attachment subunit precursor] [gn:aga1:n3431] [gtcfc:11.1:12.9] [keggfc:14.2] [sgdfc:3.3.0:9.1.0] [db:gtc-saccharomyces cerevisiae] |
| b1x11922.y | 12225262_f3_2 | 6100 | 20203 | 213 | 71 | YOL103W | 125 | 4.5(10)-7 | Saccharomyces cerevisiae | [ui:yol103w] [pn:myo-inositol permease, minor:myo-inositol transporter 2] [gn:itr2:hrb612] [gtcfc:12.2.1 1.1:8.2] [keggfc:14.2] [sgdfc:1.5.3:7.3.0:8.7.0:9.1.0:17.0.0] [db:gtc-saccharomyces cerevisiae] |
| CONTIG5391 | 22269681_f2_7 | 6101 | 20204 | 1365 | 455 | YOL030W | 727 | 5.5(10)-72 | Saccharomyces cerevisiae | [ui:yol030w] [pn:strong similarity to glycoprotein gas1] [gtcfc:11.1] [keggfc:14.2] [sgdfc:9.1.0] [db-gtc-saccharomyces cerevisiae] |
| CONTIG5798 | 14082032_c1_28 | 6102 | 20205 | 1458 | 486 | YOL030W | 1139 | 1.2(10)-115 | Saccharomyces cerevisiae | [ui:yol030w] [pn:strong similarity to glycoprotein gas1] [gtcfc:11.1] [keggfc:14.2] [sgdfc:9.1.0] [db:gtc-saccharomyces cerevisiae] |
| CONTIG1804 | 2165682_f3_1 | 6103 | 20206 | 357 | 119 | YOR153W | 231 | 7.0(10)-18 | Saccharomyces cerevisiae | [ui:yor153w] [pn:pleiotropic drug resistance protein:suppressor of toxicity of sporidesmin] [gn:pdr5:sts1:ydr1:lem1] [gtcfc:11.1.12.12:12.6] [keggfc:14.2] [sgdfc:7.9.0:9.1.0:11.3.0] [db:gtc-saccharomyces cerevisiae] |
| CONTIG2003 | 19730018_c2_1 | 6104 | 20207 | 1476 | 492 | YOR153W | 1295 | 3.5(10)-132 | Saccharomyces cerevisiae | [ui:yor153w] [pn:pleiotropic drug resistance protein:suppressor of toxicity of sporidesmin] [gn:pdr5:sts1:ydr1:lem1] [gtcfc:11.1.12.12:12.6] [keggfc:14.2] [sgdfc:7.9.0:9.1.0:11.3.0] [db:gtc-saccharomyces cerevisiae] |
| CONTIG3893 | 3912700_c1_4 | 6105 | 20208 | 213 | 71 | YOR153W | 136 | 9.1(10)-8 | Saccharomyces cerevisiae | [ui:yor153w] [pn:pleiotropic drug resistance protein:suppressor of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3893 | 24409837_c3_5 | 6106 | 20209 | 1182 | 394 | YOR153W | 1064 | 2.2(10)-107 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |
| CONTIG4325 | 10944062_c2_4 | 6107 | 20210 | 2085 | 695 | YOR153W | 1839 | 7.9(10)-190 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |
| CONTIG4513 | 9776886_c2_10 | 6108 | 20211 | 1878 | 626 | YOR153W | 1513 | 2.7(10)-155 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |
| CONTIG5733 | 34407687_f3_14 | 6109 | 20212 | 2223 | 741 | YOR153W | 1927 | 3.7(10)-199 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |
| CONTIG3215 | 1056349_c1_4 | 6110 | 20213 | 723 | 241 | YOR153W | 180 | 1.8(10)-12 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |
| CONTIG4724 | 2353769_c1_5 | 6111 | 20214 | 1809 | 603 | YOR153W | 1786 | 3.2(10)-184 | Saccharomyces cerevisiae | toxicity of sporidesmin] [gn:pdr5:sts1:ydr1:lem1] [gtcfc:11.1:12.12:12.6] [keggfc:14.2] [sgdfc:7.9.0:9.1.0:11.3.0] [db-gtc-saccharomyces cerevisiae] [ui:yor153w] [pn:pleiotropic drug resistance protein:suppressor of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5164 | 30548253_f3_4 | 6112 | 20215 | 1215 | 405 | YOR212W | 371 | 1.8(10)-68 | Saccharomyces cerevisiae | [gn:pdr5:sts1:ydr1:lem1] [gtcfc:11.1:12.12:12.6] [keggfc:14.2] [sgdfc:7.9.0:9.10:11.3.0] [db:gtc-saccharomyces cerevisiae] [ui:yor212w] [pn:gtp-binding protein beta subunit of the pheromone pathway:guanine nucleotide-binding protein beta subunit] [gn:stc4:yor50-2] [gtcfc:11.1:11.3:12.13:12.8:12.9] [keggfc:13.1] [sgdfc:3.3.0:9.10:10.1.2] [db:gtc-saccharom |
| CONTIG5164 | 20157626_f1_2 | 6113 | 20216 | 303 | 101 | YOR212W | 212 | 8.3(10)-17 | Saccharomyces cerevisiae | [ui:yor212w] [pn:gtp-binding protein beta subunit of the pheromone pathway:guanine nucleotide-binding protein beta subunit] [gn:stc4:yor50-2] [gtcfc:11.1:11.3:12.13:12.8:12.9] [keggfc:13.1] [sgdfc:3.3.0:9.10:10.1.2] [db:gtc-saccharom |
| CONTIG1479 | 10437713_f1_1 | 6114 | 20217 | 867 | 289 | YOR328W | 627 | 4.5(10)-60 | Saccharomyces cerevisiae | [ui:yor328w] [pn:strong similarity to abc transporter proteins:atp-dependent permease] [gn:pdr10] [gtcfc:12.6:11.1] [keggfc:14.2] [sgdfc:7.9.0:9.10] [db:gtc-saccharomyces cerevisiae] |
| CONTIG5548 | 962511_f3_7 | 6115 | 20218 | 1452 | 484 | YOR348C | 613 | 6.5(10)-60 | Saccharomyces cerevisiae | [ui:yor348c] [pn:proline and gamma-aminobutyrate permease:proline-specific permease] [gn:put4:o6345] [gtcfc:11.1:12.1:12.6] [keggfc:14.2] [sgdfc:1.1.3:7.4.0:8.7.0:9.1.0:17.0.0] [db:gtc-saccharomyces cerevisiae] |
| CONTIG1316 | 20706716_f1_1 | 6116 | 20219 | 1185 | 395 | YPL176C | 520 | 1.1(10)-49 | Saccharomyces cerevisiae | [ui:ypl176c] [pn:similarity to chinese hamster transferrin receptor protein] [gtcfc:11.1:14.3] [keggfc:14.2] [sgdfc:9.1.0:13.0.0] [db:gtc-saccharomyces cerevisiae] |
| CONTIG2272 | 11172192_f2_1 | 6117 | 20220 | 183 | 61 | YPL036W | 207 | 1.3(10)-15 | Saccharomyces cerevisiae | [ui:ypl036w] [pn:h+-transporting p-type atpase 2:plasma membrane atpase 2:proton pump] [gn:pma2] [gtcfc:12.5:11.1] [ec:3.6.1.35] [keggfc:14.1] [sgdfc:1.8.2:7.2.2:7.8.0:9.1.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4917 | 3941881_c3_7 | 6118 | 20221 | 765 | 255 | YPR124W | 155 | 1.3(10)-10 | *Saccharomyces cerevisiae* | [db:gtc-saccharomyces cerevisiae] [ui:ypr124w] [pn:copper transport protein:copper tranport protein ctr1:copper transporter 1] [gn:ctr1:p9642] [gtcfc:12.6:11.1] [keggfc:14.2] [sgdfc:1.8.1:7.2.1.8.7:0.9.1.0:17.0.0] [db:gtc-saccharomyces cerevisiae] |
| CONTIG3571 | 3917188_c2_6 | 6119 | 20222 | 1317 | 439 | YGR217W | 696 | 3.5(10)-67 | *Saccharomyces cerevisiae* | [ui:ygr217w] [pn:calcium channel protein:hypothetical 234.6 kd protein in gpi1-crm1 intergenic region] [gn:cch1:g8501] [gtcfc:11.3:12.6] [keggfc:14.2] [sgdfc:1.8.2:7.1.0] [db:gtc-saccharomyces cerevisiae] |
| CONTIG977 | 3380130_f1_1 | 6120 | 20223 | 1158 | 386 | YGR217W | 769 | 5.7(10)-75 | *Saccharomyces cerevisiae* | [ui:ygr217w] [pn:calcium channel protein:hypothetical 234.6 kd protein in gpi1-crm1 intergenic region] [gn:cch1:g8501] [gtcfc:11.3:12.6] [keggfc:14.2] [sgdfc:1.8.2:7.1.0] [db:gtc-saccharomyces cerevisiae] |
| b1x18140.x | 22447143_f3_2 | 6121 | 20224 | 804 | 268 | YGR217W | 328 | 5.0(10)-28 | *Saccharomyces cerevisiae* | [ui:ygr217w] [pn:calcium channel protein:hypothetical 234.6 kd protein in gpi1-crm1 intergenic region] [gn:cch1:g8501] [gtcfc:11.3:12.6] [keggfc:14.2] [sgdfc:1.8.2:7.1.0] [db:gtc-saccharomyces cerevisiae] |
| b1x18140.y | 26348125_c3_3 | 6122 | 20225 | 699 | 233 | YGR217W | 99 | 0.1 | *Saccharomyces cerevisiae* | [ui:ygr217w] [pn:calcium channel protein:hypothetical 234.6 kd protein in gpi1-crm1 intergenic region] [gn:cch1:g8501] [gtcfc:11.3:12.6] [keggfc:14.2] [sgdfc:1.8.2:7.1.0] [db:gtc-saccharomyces cerevisiae] |
| CONTIG5158 | 13985377_f2_4 | 6123 | 20226 | 375 | 125 | YLL053C | 330 | 6.4(10)-30 | *Saccharomyces cerevisiae* | [ui:yll053c] [pn:similarity to water channel proteins] [gtcfc:11.3:12.6] [keggfc:14.2] [sgdfc:7.1.0] [db:gtc-saccharomyces cerevisiae] |
| CONTIG4438 | 9814667_c3_9 | 6124 | 20227 | 1134 | 378 | YHR146W | 145 | 3.0(10)-7 | *Saccharomyces cerevisiae* | [ui:yhr146w] [pn:similarity to pheromone-response g-protein mdg1p:hypothetical 51.1 kd protein in dcd1-mrpl6 intergenic region] [gtcfc:11.3:12.13:12.9] [keggfc:14.2] [sgdfc:3.3.0:10.1.2] [db:gtc-saccharomyces cerevisiae] |
| CONTIG4396 | 406591_f3_7 | 6125 | 20228 | 1239 | 413 | YNL173C | 220 | 2.0(10)-16 | *Saccharomyces cerevisiae* | [ui:ynl173c] [pn:gtp-binding |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | protein of the pheromone-response pathway:hypothetical 40.3 kd protein in rps3-psd1 intergenic region] [gn:mdg1:nl673] [gtcfc:11.3:12.13:12.9] [keggfc:14.2] [sgdfc:3.3.0:10.1.2] [db:gtc-saccharomyces cerev |
| CONTIG3561 | 5994582_f3_2 | 6126 | 20229 | 1671 | 557 | YCR032W | 791 | 3.0(10)-77 | Saccharomyces cerevisiae | [ui:ycr032w] [pn:similarity to human cdc4l protein:hypothetical 251.0 kd protein in cry1-gns1 intergenic region] [gn:ycr32w;ycr591:ycr601] [gtcfc:12.10] [keggfc:14.2] [sgdfc:8.6.0] [db:gtc-saccharomyces cerevisiae] |
| CONTIG4746 | 892153_c3_14 | 6127 | 20230 | 2970 | 990 | YCR032W | 131 | 0.00032 | Saccharomyces cerevisiae | [ui:ycr032w] [pn:similarity to human cdc4l protein:hypothetical 251.0 kd protein in cry1-gns1 intergenic region] [gn:ycr32w;ycr591:ycr601] [gtcfc:12.10] [keggfc:14.2] [sgdfc:8.6.0] [db:gtc-saccharomyces cerevisiae] |
| CONTIG3820 | 22039002_f1_1 | 6128 | 20231 | 1134 | 378 | YDR129C | 1396 | 7.0(10)-143 | Saccharomyces cerevisiae | [ui:ydr129c] [pn:actin filament bundling protein, fimbrin:fimbrin:abp67] [gn:sac6:yd9302] [gtcfc:12.10:12.16:12.6:12.8] [keggfc:14.2] [sgdfc:3.2.0:8.6.0:8.7.0:9.3.0] [db:gtc-saccharomyces cerevisiae] |
| b9x12817.x | 12206280_f3_2 | 6129 | 20232 | 552 | 184 | YDR129C | 511 | 4.2(10)-49 | Saccharomyces cerevisiae | [ui:ydr129c] [pn:actin filament bundling protein, fimbrin:fimbrin:abp67] [gn:sac6:yd9302] [gtcfc:12.10:12.16:12.6:12.8] [keggfc:14.2] [sgdfc:3.2.0:8.6.0:8.7.0:9.3.0] [db:gtc-saccharomyces cerevisiae] |
| CONTIG4074 | 5939791_f3_2 | 6130 | 20233 | 1323 | 441 | YDR164C | 404 | 5.7(10)-50 | Saccharomyces cerevisiae | [ui:ydr164c] [pn:protein transport protein:protein transport protein sec1] [gn:sec1:yd8358] [gtcfc:12.6.10] [keggfc:14.2] [sgdfc:8.6.0:9.3.0] [db:gtc-saccharomyces cerevisiae] |
| CONTIG5623 | 21675306_f2_3 | 6131 | 20234 | 2919 | 973 | YDR166C | 167 | 4.4(10)-13 | Saccharomyces cerevisiae | [ui:ydr166c] [pn:required for exocytosis] [gn:sec5] [gtcfc:12.10] [keggfc:14.2] [sgdfc:8.6.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5659 | 12897311_f1_5 | 6132 | 20235 | 1596 | 532 | YER006W | 1169 | 7.0(10)-132 | Saccharomyces cerevisiae | [ui:yer006w] [pn:similarity to p. polycephalum myosin-related protein mlpa:hypothetical gtp-binding protein in pmi40-pac2 intergenic region] [gtcfc:12.10] [sgdfc:8.6.0] [db:gtc-saccharomyces cerevisiae] |
| CONTIG4180 | 22475013_f1_1 | 6133 | 20236 | 1008 | 336 | YER008C | 110 | 0.0082 | Saccharomyces cerevisiae | [ui:yer008c] [pn:secretory pathway protein:sec3 protein:psl1 protein] [gn:sec3:psl1] [gtcfc:12.10] [keggfc:14.2] [sgdfc:8.6.0] [db:gtc-saccharomyces cerevisiae] |
| CONTIG4682 | 4085302_c2_9 | 6134 | 20237 | 1971 | 657 | YER008C | 195 | 8.9(10)-14 | Saccharomyces cerevisiae | [ui:yer008c] [pn:secretory pathway protein:sec3 protein:psl1 protein] [gn:sec3:psl1] [gtcfc:12.10] [keggfc:14.2] [sgdfc:8.6.0] [db:gtc-saccharomyces cerevisiae] |
| CONTIG2338 | 10156251_f1_2 | 6135 | 20238 | 1269 | 423 | YER136W | 1450 | 1.3(10)-148 | Saccharomyces cerevisiae | [ui:yer136w] [pn:gdp dissociation inhibitor:secretory pathway gdp dissociation inhibitor] [gn:gdi1:sec19] [gtcfc:12.10] [keggfc:14.2] [sgdfc:8.6.0:9.2.0] [db:gtc-saccharomyces cerevisiae] |
| CONTIG3542 | 23835456_f3_5 | 6136 | 20239 | 240 | 80 | YER136W | 243 | 3.7(10)-20 | Saccharomyces cerevisiae | [ui:yer136w] [pn:gdp dissociation inhibitor:secretory pathway gdp dissociation inhibitor] [gn:gdi1:sec19] [gtcfc:12.10] [keggfc:14.2] [sgdfc:8.6.0:9.2.0] [db:gtc-saccharomyces cerevisiae] |
| CONTIG1785 | 14219066_f2_4 | 6137 | 20240 | 513 | 171 | YIL068C | 134 | 7.0(10)-8 | Saccharomyces cerevisiae | [ui:yil068c] [pn:protein transport protein] [gn:sec6] [gtcfc:12.6:12.10] [keggfc:14.2] [sgdfc:8.6.0:9.2.0] [db:gtc-saccharomyces cerevisiae] |
| CONTIG910 | 19697067_f2_1 | 6138 | 20241 | 1152 | 384 | YIL068C | 154 | 8.9(10)-8 | Saccharomyces cerevisiae | [ui:yil068c] [pn:protein transport protein] [gn:sec6] [gtcfc:12.6:12.10] [keggfc:14.2] [sgdfc:8.6.0:9.2.0] [db:gtc-saccharomyces cerevisiae] |
| CONTIG5737 | 33707175_f1_1 | 6139 | 20242 | 1839 | 613 | YIL085W | 206 | 1.8(10)-13 | Saccharomyces cerevisiae | [ui:yil085w] [pn:70 kda exocyst component protein:hypothetical 71.3 kd protein in trl1-act3 intergenic region] [gn:exo70:j0932] [gtcfc:14.1] [keggfc:14.2] [sgdfc:8.6.0] [db:gtc-saccharomyces cerevisiae] |
| CONTIG4522 | 29382768_c3_7 | 6140 | 20243 | 1569 | 523 | YJL044C | 96 | 0.13 | Saccharomyces cerevisiae | [ui:yjl044c] [pn:gtpase-activating protein:gtpase-activating protein of ypt6] [gn:gyp6:j1202] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2964 | 7070336_c3_1 | 6141 | 20244 | 1752 | 584 | YKL212W | 1297 | 2.2(10)-132 | Saccharomyces cerevisiae | [ui:ykl212w] [pn:recessive suppressor of secretory defect] [gn:rsd1:sac1] [gtcfc:12.10:12.16] [keggfc:14.2] [sgdfc:8.6.0:9.4.0] [db:gtc-saccharomyces cerevisiae] [gtcfc:12.10] [keggfc:14.2] [sgdfc:8.6.0] [db:gtc-saccharomyces cerevisiae] |
| CONTIG5676 | 12145181_f2_7 | 6142 | 20245 | 2385 | 795 | YLR166C | 580 | 1.6(10)-103 | Saccharomyces cerevisiae | [ui:ylr166c] [pn:required for exocytosis] [gn:sec10] [gtcfc:12.10] [keggfc:14.2] [sgdfc:8.6.0] [db:gtc-saccharomyces cerevisiae] |
| CONTIG2088 | 25657775_c1_4 | 6143 | 20246 | 387 | 129 | YLR250W | 209 | 4.2(10)-17 | Saccharomyces cerevisiae | [ui:ylr250w] [pn:secretory protein:protein ssp120 precursor] [gn:ssp120:19672] [gtcfc:12.10] [keggfc:14.2] [sgdfc:8.6.0] [db:gtc-saccharomyces cerevisiae] |
| CONTIG5628 | 35351442_f3_7 | 6144 | 20247 | 285 | 95 | YLR250W | 171 | 4.5(10)-13 | Saccharomyces cerevisiae | [ui:ylr250w] [pn:secretory protein:protein ssp120 precursor] [gn:ssp120:19672] [gtcfc:12.10] [keggfc:14.2] [sgdfc:8.6.0] [db:gtc-saccharomyces cerevisiae] |
| CONTIG1601 | 26692655_c3_4 | 6145 | 20248 | 576 | 192 | YMR308C | 286 | 6.2(10)-24 | Saccharomyces cerevisiae | [ui:ymr308c] [pn:protein secretion enhancer:protein secretion enhancer 1] [gn:psc1:ym9952] [gtcfc:12.10] [keggfc:14.2] [sgdfc:8.6.0] [db:gtc-saccharomyces cerevisiae] |
| CONTIG4469 | 20523407_c3_9 | 6146 | 20249 | 1710 | 570 | YMR308C | 1423 | 9.5(10)-146 | Saccharomyces cerevisiae | [ui:ymr308c] [pn:protein secretion enhancer:protein secretion enhancer 1] [gn:psce1:ym9952] [gtcfc:12.10] [keggfc:14.2] [sgdfc:8.6.0] [db:gtc-saccharomyces cerevisiae] |
| b1x11465.y | 5948958_f1_1 | 6147 | 20250 | 690 | 230 | YMR308C | 465 | 4.2(10)-43 | Saccharomyces cerevisiae | [ui:ymr308c] [pn:protein secretion enhancer:protein secretion enhancer 1] [gn:psce1:ym9952] [gtcfc:12.10] [keggfc:14.2] [sgdfc:8.6.0] [db:gtc-saccharomyces cerevisiae] |
| CONTIG2985 | 29298752_c2_6 | 6148 | 20251 | 924 | 308 | YNL325C | 112 | 0.00209 | Saccharomyces cerevisiae | [ui:ynl325c] [pn:suppressor of sac1 mutation:hypothetical 101.7 kd protein in egt2-kre1 intergenic region] [gn:n0330] [gtcfc:14.1] [keggfc:14.2] [sgdfc:8.6.0] [db:gtc-saccharomyces cerevisiae] |
| CONTIG2985 | 36114765_c1_5 | 6149 | 20252 | 954 | 318 | YNL325C | 917 | 4.0(10)-92 | Saccharomyces cerevisiae | [ui:ynl325c] [pn:suppressor of sac1 mutation:hypothetical 101.7 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x17759.y | 36586066_c3_1 | 6150 | 20253 | 477 | 159 | YNL325C | 281 | 1.5(10)-23 | Saccharomyces cerevisiae | protein in egt2-kre1 intergenic region] [gn:nn0330] [gtcfc:14.1] [keggfc:14.2] [sgdfc:8.6.0] [db:gtc-saccharomyces cerevisiae] [ui:ynl325c] [pn:suppressor of sac1 mutation:hypothetical 101.7 kd protein in egt2-kre1 intergenic region] [gn:nn0330] [gtcfc:14.1] [keggfc:14.2] [sgdfc:8.6.0] [db:gtc-saccharomyces cerevisiae] |
| CONTIG5643 | 10720437_f1_1 | 6151 | 20254 | 780 | 260 | YNL036W | 344 | 2.1(10)-31 | Saccharomyces cerevisiae | [ui:ynl036w] [pn:involved in non-classical protein export pathway:non-classical export protein nce3] [gn:nce3:n2695] [gtcfc:12.10] [keggfc:14.2] [sgdfc:8.6.0] [db:gtc-saccharomyces cerevisiae] |
| CONTIG5697 | 24097192_c1_16 | 6152 | 20255 | 552 | 184 | YNR049C | 114 | 8.1(10)-7 | Saccharomyces cerevisiae | [u1:ynr049c] [pn:secretion protein, multicopy suppressor of sec1:mso1 protein] [gn:mso1:n3457] [gtcfc:12.10] [keggfc:14.2] [sgdfc:8.6.0:9.2.0] [db:gtc-saccharomyces cerevisiae] |
| CONTIG5397 | 21650312_f1_2 | 6153 | 20256 | 1575 | 525 | YOR307C | 677 | 1.1(10)-66 | Saccharomyces cerevisiae | [ui:yor307c] [pn:secretory pathway protein:sly41 protein] [gn:sly41:o55663] [gtcfc:12.10] [keggfc:14.2] [sgdfc:8.6.0] [db:gtc-saccharomyces cerevisiae] |
| CONTIG4631 | 10603402_c2_9 | 6154 | 20257 | 567 | 189 | YOR326W | 654 | 6.0(10)-63 | Saccharomyces cerevisiae | [ui:yor326w] [pn:myosin heavy chain:myosin-2 isoform] [gn:myo2:cdc66:o6167] [gtcfc:12.10.12.16.12.8] [keggfc:14.2] [sgdfc:3.2.0:8.3.0:8.6.0:9.3.0] [db:gtc-saccharomyces cerevisiae] |
| CONTIG4823 | 23938942_c3_11 | 6155 | 20258 | 3783 | 1261 | YOR326W | 2317 | 1.8(10)-240 | Saccharomyces cerevisiae | [ui:yor326w] [pn:myosin heavy chain:myosin-2 isoform] [gn:myo2:cdc66:o6167] [gtcfc:12.10.12.16.12.8] [keggfc:14.2] [sgdfc:3.2.0:8.3.0:8.6.0:9.3.0] [db:gtc-saccharomyces cerevisiae] |
| CONTIG4917 | 1064138_f3_2 | 6156 | 20259 | 2439 | 813 | YPR055W | 180 | 9.5(10)-35 | Saccharomyces cerevisiae | [ui:ypr055w] [pn:protein transport protein:protein transport protein sec8] [gn:sec8:yp9499] [gtcfc:12.6.12.10] [keggfc:14.2] [sgdfc:8.6.0:9.2.0] [db:gtc-saccharomyces cerevisiae] |
| CONTIG4917 | 2350017_f3_3 | 6157 | 20260 | 378 | 126 | YPR055W | 143 | 1.1(10)-8 | Saccharomyces cerevisiae | [ui:ypr055w] [pn:protein transport |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3891 | 29393826_c1_6 | 6158 | 20261 | 444 | 148 | YPR149W | 165 | 2.0(10)-12 | Saccharomyces cerevisiae | [ui:ypr149w][pn:involved in non-classical protein export pathway][gn:nce2][gtcfc:12.10][keggfc:14.2][sgdfc:8.6.0][db:gtc-saccharomyces cerevisiae] |
| CONTIG5307 | 19531308_c2_8 | 6159 | 20262 | 918 | 306 | YBL050W | 582 | 1.3(10)-56 | Saccharomyces cerevisiae | [ui:ybl050w][pn:transport vesicle fusion protein:vesicular-fusion protein sec17][gn:sec17;ybl0517;ybl0505][gtcfc:12.6:12.10:12.16][keggfc:14.2][sgdfc:8.3.0:9.9.0][db:gtc-saccharomyces cerevisiae] |
| b3x13161.x | 11182317_f1_1 | 6160 | 20263 | 489 | 163 | YDL195W | 359 | 1.3(10)-31 | Saccharomyces cerevisiae | [ui:ydl195w][pn:component of the copii coat of er-golgi vesicles:web1 protein:protein transport protein sec31][gn:web1.sec31:d1229][gtcfc:12.6:12.10:12.16][keggfc:14.2][sgdfc:8.3.0:9.4.0][db:gtc-saccharomyces cerevisiae] |
| CONTIG5234 | 6674055_c2_14 | 6161 | 20264 | 558 | 186 | YDL192W | 764 | 6.5(10)-76 | Saccharomyces cerevisiae | [ui:ydl192w][pn:gtp-binding protein of the arf family:adp-ribosylation factor 1][gn:arf1:d1244][gtcfc:12.10:12.16][keggfc:14.2][sgdfc:6.4.0:8.3.0:9.4.0][db:gtc-saccharomyces cerevisiae] |
| CONTIG5563 | 36362925_c3_27 | 6162 | 20265 | 321 | 107 | YDL192W | 410 | 2.1(10)-38 | Saccharomyces cerevisiae | [ui:ydl192w][pn:gtp-binding protein of the arf family:adp-ribosylation factor 1][gn:arf1:d1244][gtcfc:12.10:12.16][keggfc:14.2][sgdfc:6.4.0:8.3.0:9.4.0][db:gtc-saccharomyces cerevisiae] |
| CONTIG2659 | 23439003_c2_2 | 6163 | 20266 | 1350 | 450 | YDL145C | 752 | 1.2(10)-85 | Saccharomyces cerevisiae | [ui:ydl145c][pn:coatomer complex alpha chain of secretory pathway vesicles:coatomer alpha subunit:alpha-coat protein:alpha-cop][gn:ret1:d1578][gtcfc:12.10:12.16][keggfc:14.2][sgdfc:8.3.0:9.9.0][db:gtc-saccharomyces cerevisiae] |
| CONTIG4447 | 4328801_f3_3 | 6164 | 20267 | 2187 | 729 | YDL145C | 2630 | 1.2(10)-273 | Saccharomyces cerevisiae | [ui:ydl145c][pn:coatomer complex alpha chain of secretory pathway vesicles:coatomer alpha |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5563 | 4866425_c3_28 | 6165 | 20268 | 204 | 68 | YDL137W | 250 | 1.8(10)-21 | Saccharomyces cerevisiae | subunit:alpha-coat protein:alpha-cop] [gn:ret1:d1578] [gtcfc:12.10:12.16] [keggfc:14.2] [sgdfc:8.3.0:9.9.0] [dbgtc-saccharomyces cerevisiae] [ui:ydl137w] [pn:gtp-binding protein of the arf family:adp-ribosylation factor 2] [gn:arf2:d2165] |
| CONTIG2554 | 2156312_c1_2 | 6166 | 20269 | 1245 | 415 | YDL058W | 91 | 0.77 | Saccharomyces cerevisiae | [gtcfc:12.10:12.16] [keggfc:14.2] [sgdfc:6.4.0:8.3.0:9.9.0] [db:gtc-saccharomyces cerevisiae] [ui:ydl058w] [pn:intracellular protein transport protein:intracellular protein transport protein uso1] [gn:uso1:int1] |
| CONTIG2678 | 964037_c3_7 | 6167 | 20270 | 1548 | 516 | YDL058W | 132 | 6.5(10)-5 | Saccharomyces cerevisiae | [gtcfc:12.6:12.10:12.16] [keggfc:14.2] [sgdfc:8.3.0:9.4.0] [db:gtc-saccharomyces cerevisiae] [ui:ydl058w] [pn:intracellular protein transport protein:intracellular protein transport protein uso1] [gn:uso1:int1] |
| CONTIG4025 | 3944642_f1_1 | 6168 | 20271 | 1020 | 340 | YDL058W | 160 | 2.7(10)-9 | Saccharomyces cerevisiae | [gtcfc:12.6:12.10:12.16] [keggfc:14.2] [sgdfc:8.3.0:9.4.0] [db:gtc-saccharomyces cerevisiae] [ui:ydl058w] [pn:intracellular protein transport protein:intracellular protein transport protein uso1] [gn:uso1:int1] |
| CONTIG4561 | 19647768_c1_7 | 6169 | 20272 | 2535 | 845 | YDL058W | 157 | 1.3(10)-7 | Saccharomyces cerevisiae | [gtcfc:12.6:12.10:12.16] [keggfc:14.2] [sgdfc:8.3.0:9.4.0] [db:gtc-saccharomyces cerevisiae] [ui:ydl058w] [pn:intracellular protein transport protein:intracellular protein transport protein uso1] [gn:uso1:int1] |
| CONTIG4748 | 34554182_f3_6 | 6170 | 20273 | 480 | 160 | YDL058W | 435 | 1.7(10)-39 | Saccharomyces cerevisiae | [gtcfc:12.6:12.10:12.16] [keggfc:14.2] [sgdfc:8.3.0:9.4.0] [db:gtc-saccharomyces cerevisiae] [ui:ydl058w] [pn:intracellular protein transport protein:intracellular protein transport protein uso1] [gn:uso1:int1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4748 | 2212527_f3_7 | 6171 | 20274 | 723 | 241 | YDL058W | 421 | 5.2(10)-38 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |
| CONTIG4925 | 31463538_f2_2 | 6172 | 20275 | 1893 | 631 | YDL058W | 206 | 8.0(10)-13 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |
| CONTIG5390 | 860677_c3_18 | 6173 | 20276 | 2454 | 818 | YDL058W | 142 | 8.9(10)-6 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |
| CONTIG5559 | 50000_c1_15 | 6174 | 20277 | 1827 | 609 | YDL058W | 117 | 0.00459 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |
| CONTIG5652 | 33994130_f3_12 | 6175 | 20278 | 1977 | 659 | YDL058W | 179 | 1.2(10)-9 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |
| CONTIG5660 | 10425152_c1_17 | 6176 | 20279 | 1347 | 449 | YDL058W | 242 | 6.5(10)-17 | *Saccharomyces cerevisiae* | [gtcfc:12.6.12.10:12.16] [keggfc:14.2] [sgdfc:8.3.0:9.4.0] [db:gtc-*saccharomyces cerevisiae*] [ui:ydl058w] [pn:intracellular protein transport protein:intracellular protein transport protein uso1] [gn:uso1:int1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5700 | 36621337_f2_7 | 6177 | 20280 | 2241 | 747 | YDL058W | 110 | 0.024 | Saccharomyces cerevisiae | [keggfc:14.2] [sgdfc:8.3.0.9.4.0] [db:gtc-saccharomyces cerevisiae] [ui:ydl058w] [pn:intracellular protein transport protein:intracellular protein transport protein uso1] [gn:uso1:int1] [gtcfc:12.6.12.10.12.16] |
| CONTIG5758 | 32116327_c2_18 | 6178 | 20281 | 2433 | 811 | YDL058W | 298 | 2.1(10)-22 | Saccharomyces cerevisiae | [keggfc:14.2] [sgdfc:8.3.0.9.4.0] [db:gtc-saccharomyces cerevisiae] [ui:ydl058w] [pn:intracellular protein transport protein:intracellular protein transport protein uso1] [gn:uso1:int1] [gtcfc:12.6.12.10.12.16] |
| b3x1923l.y | 22878150_f1_1 | 6179 | 20282 | 477 | 159 | YDL058W | 90 | 0.17 | Saccharomyces cerevisiae | [keggfc:14.2] [sgdfc:8.3.0.9.4.0] [db:gtc-saccharomyces cerevisiae] [ui:ydl058w] [pn:intracellular protein transport protein:intracellular protein transport protein uso1] [gn:uso1:int1] [gtcfc:12.6.12.10.12.16] |
| CONTIG1488 | 860799_c1_2 | 6180 | 20283 | 1152 | 384 | YDL058W | 93 | 0.60999 | Saccharomyces cerevisiae | [keggfc:14.2] [sgdfc:8.3.0.9.4.0] [db:gtc-saccharomyces cerevisiae] [ui:ydl058w] [pn:intracellular protein transport protein:intracellular protein transport protein uso1] [gn:uso1:int1] [gtcfc:12.6.12.10.12.16] |
| CONTIG5228 | 4385144_c2_8 | 6181 | 20284 | 3237 | 1079 | YDL058W | 766 | 1.8(10)-96 | Saccharomyces cerevisiae | [keggfc:14.2] [sgdfc:8.3.0.9.4.0] [db:gtc-saccharomyces cerevisiae] [ui:ydl058w] [pn:intracellular protein transport protein:intracellular protein transport protein uso1] [gn:uso1:int1] [gtcfc:12.6.12.10.12.16] |
| b2x13809.x | 26571937_c1_1 | 6182 | 20285 | 516 | 172 | YDR107C | 288 | 1.5(10)-24 | Saccharomyces cerevisiae | [keggfc:14.2] [sgdfc:8.3.0.9.4.0] [db:gtc-saccharomyces cerevisiae] [ui:ydr107c] [pn:strong similarity to emp70 protein] [gtcfc:12.10.12.16] |
| CONTIG4535 | 16048313_c1_5 | 6183 | 20286 | 1215 | 405 | YDR170C | 95 | 0.14 | Saccharomyces cerevisiae | [ui:ydr170c] [pn:component of non-clathrin vesicle coat:protein |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x18043.x | 23495188_c2_2 | 6184 | 20287 | 540 | 180 | YDR170C | 326 | 5.0(10)-29 | Saccharomyces cerevisiae | [ui:ydr170c][pn:component of non clathrin vesicle coat:protein transport protein][gn:sec7][gtcfc:12.6:12.10:12.16][keggfc:14.2][sgdfc:8.3.0:9.9.0][db:gtc-saccharomyces cerevisiae] |
| CONTIG5794 | 10552186_c3_37 | 6185 | 20288 | 1938 | 646 | YDR189W | 1523 | 2.3(10)-156 | Saccharomyces cerevisiae | [ui:ydr189w][pn:hydrophilic suppressor of ypt1 and member of the sec1p family:sly1 protein][gn:sly1:yd9395][gtcfc:12.10:12.16][keggfc:14.2][sgdfc:8.3.0:9.4.0][db:gtc-saccharomyces cerevisiae] |
| CONTIG5526 | 23864032_f1_2 | 6186 | 20289 | 2889 | 963 | YDR238C | 2373 | 2.1(10)-246 | Saccharomyces cerevisiae | [ui:ydr238c][pn:coatomer complex beta chain of secretory pathway vesicles:coatomer beta subunit:beta-coat protein:beta-cop][gn:sec26:yd8419][gtcfc:12.10:12.16][keggfc:14.2][sgdfc:8.3.0:9.9.0][db:gtc-saccharomyces cerevisiae] |
| CONTIG5591 | 26250462_c1_9 | 6187 | 20290 | 1956 | 652 | YEL022W | 412 | 8.8(10)-43 | Saccharomyces cerevisiae | [ui:yel022w][pn:gdp/gtp exchange factor for arfhypothetical 165.7 kd protein in rip1-ura3 intergenic region][gn:gea2][gtcfc:12.13][keggfc:14.2][sgdfc:8.3.0:9.4.0][db:gtc-saccharomyces cerevisiae] |
| CONTIG4337 | 20906375_f2_2 | 6188 | 20291 | 684 | 228 | YFL038C | 807 | 1.8(10)-80 | Saccharomyces cerevisiae | [ui:yfl038c][pn:gtp-binding protein of the rab family:gtp-binding protein ypt1:protein yp2][gn:ypt1:yp2][gtcfc:12.10:12.16][keggfc:14.2][sgdfc:8.3.0:9.4.0][db:gtc-saccharomyces cerevisiae] |
| b3x12764.y | 33363252_c3_2 | 6189 | 20292 | 504 | 168 | YFL025C | 243 | 2.2(10)-19 | Saccharomyces cerevisiae | [ui:yfl025c][pn:negative regulator of copii vesicle formation:hypothetical 117.8 kd protein in ste2-frs2 intergenic region][gn:bst1][gtcfc:12.13][keggfc:14.2][sgdfc:8.3.0:9.4.0][db:gtc-saccharomyces cerevisiae] |
| CONTIG4023 | 4331311_c1_5 | 6190 | 20293 | 642 | 214 | YFL005W | 661 | 5.1(10)-65 | Saccharomyces cerevisiae | [ui:yfl005w][pn:gtp-binding protein of the ras superfamily:ras-related protein][gn:sec4][gtcfc:12.10:12.16][keggfc:14.2][sgdfc:8.3.0:9.9.0][db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5218 | 6454378_c2_11 | 6191 | 20294 | 423 | 141 | YFL005W | 93 | 0.0015 | *Saccharomyces cerevisiae* | *saccharomyces cerevisiae* [ui:yfl005w] [pn:gtp-binding protein of the ras superfamily:ras-related protein] [gn:sec4] [gtcfc:12.10:12.16] [keggfc:14.2] [sgdfc:8.3.0:9.9.0] [db:gtc-*saccharomyces cerevisiae*] |
| CONTIG5633 | 19553200_c3_20 | 6192 | 20295 | 1767 | 589 | YFR051C | 451 | 4.7(10)-82 | *Saccharomyces cerevisiae* | [ui:yfr051c] [pn:coatomer complex delta chain:coatomer delta subunit:delta-coat protein:delta-cop] [gn:ret2] [gtcfc:12.10:12.16] [keggfc:14.2] [sgdfc:8.3.0:9.9.0] [db:gtc-*saccharomyces cerevisiae*] |
| CONTIG4965 | 11975878_c3_8 | 6193 | 20296 | 1359 | 453 | YGL225W | 861 | 3.3(10)-86 | *Saccharomyces cerevisiae* | [ui:ygl225w] [pn:vanadate-resistance protein:vanadate resistance protein gog5/vrg4/van2] [gn:gog5:vrg4:van2] [gtcfc:12.10:12.16] [keggfc:14.2] [sgdfc:8.3.0:9.4.0] [db:gtc-*saccharomyces cerevisiae*] |
| CONTIG1396 | 33360718_f2_1 | 6194 | 20297 | 414 | 138 | YGL210W | 411 | 1.7(10)-38 | *Saccharomyces cerevisiae* | [ui:ygl210w] [pn:small gtp-binding protein essential for golgi function:gtp-binding protein ypt32/ypt11] [gn:ypt32:ypt11] [gtcfc:12.10] [keggfc:14.2] [sgdfc:8.3.0] [db:gtc-*saccharomyces cerevisiae*] |
| CONTIG1276 | 4382688_f1_1 | 6195 | 20298 | 639 | 213 | YGL200C | 598 | 2.5(10)-58 | *Saccharomyces cerevisiae* | [ui:ygl200c] [pn:component of the copii-coated vesicles, 24 kda:endosomal p24b protein precursor:24 kd late endocytic protein:basic 24 kd late endocytic intermediate component] [gn:emp24:g1271] [gtcfc:12.10:12.16] [keggfc:14.2] [sgdfc:8] |
| CONTIG379 | 33234688_f2_1 | 6196 | 20299 | 492 | 164 | YGL167C | 169 | 1.6(10)-11 | *Saccharomyces cerevisiae* | [ui:ygl167c] [pn:ca2+-transporting p-type atpase:calcium-transporting atpase1:golgi ca2+-atpase] [gn:pmr1:sec1:bsd1:g1666] [gtcfc:12.5:12.10:12.16] [ec:3.6.1.38] [keggfc:14.1] [sgdfc:1.8.2:7.2.2:7.8.0:8.3.0:9.4.0] [db:gtc-saccharomyc |
| CONTIG3803 | 26609812_c3_7 | 6197 | 20300 | 1005 | 335 | YGL167C | 930 | 1.7(10)-93 | *Saccharomyces cerevisiae* | [ui:ygl167c] [pn:ca2+-transporting p-type atpase:calcium-transporting atpase1:golgi ca2+-atpase] [gn:pmr1:sec1:bsd1:g1666] [gtcfc:12.5:12.10:12.16] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4780 | 14167037_c2_9 | 6198 | 20301 | 225 | 75 | YGL167C | 110 | 3.2(10)-5 | *Saccharomyces cerevisiae* | [ec:3.6.1.38] [keggfc:14.1] [sgdfc:1.8.2:7.2.2:7.8.0:8.3.0:9.4.0] [db:gtc-saccharomyc [ui:ygl167c] [pn:ca2+-transporting p-type atpase:calcium-transporting atpase 1:golgi ca2+-atpase] [gn:pmr1:ssc1:bsd1:gl666] [gcfc:12.5:12.10:12.16] [ec:3.6.1.38] [keggfc:14.1] [sgdfc:1.8.2:7.2.2:7.8.0:8.3.0:9.4.0] [db:gtc-saccharomy |
| CONTIG5017 | 32132212_c3_8 | 6199 | 20302 | 1158 | 386 | YGL167C | 836 | 1.5(10)-83 | *Saccharomyces cerevisiae* | [ui:ygl167c] [pn:ca2+-transporting p-type atpase:calcium-transporting atpase 1:golgi ca2+-atpase] [gn:pmr1:ssc1:bsd1:gl666] [gcfc:12.5:12.10:12.16] [ec:3.6.1.38] [keggfc:14.1] [sgdfc:1.8.2:7.2.2:7.8.0:8.3.0:9.4.0] [db:gtc-saccharomy |
| CONTIG4235 | 20524127_c3_6 | 6200 | 20303 | 1443 | 481 | YGL145W | 121 | 0.00042 | *Saccharomyces cerevisiae* | [ui:ygl145w] [pn:required for er to golgi transport:protein transport protein tip20] [gn:tip20:tip1] [keggfc:14.2] [sgdfc:8.3.0:9.4.0] [gcfc:12.6:12.10:12.16] [db:gtc-saccharomyces cerevisiae] |
| CONTIG3846 | 4884437_c3_2 | 6201 | 20304 | 1728 | 576 | YGL137W | 1848 | 8.8(10)-191 | *Saccharomyces cerevisiae* | [ui:ygl137w] [pn:coatomer complex beta" chain:beta"-cop of secretory pathway vesicles:coatomer beta" subunit:beta"-coat protein:beta"chain:beta"-cop] [gn:sec27:g2827] [gcfc:12.10:12.16] [keggfc:14.2] [sgdfc:8.3.0:9.9.0] [db:gtc-saccharomyces c |
| CONTIG4593 | 7083401_c2_4 | 6202 | 20305 | 834 | 278 | YGL137W | 340 | 7.2(10)-30 | *Saccharomyces cerevisiae* | [ui:ygl137w] [pn:coatomer complex beta"-cop of secretory pathway vesicles:coatomer beta" subunit:beta"-coat protein:beta"-cop] [gn:sec27:g2827] [gcfc:12.10:12.16] [keggfc:14.2] [sgdfc:8.3.0:9.9.0] [db:gtc-saccharomyces c |
| CONTIG4500 | 21722675_f1_1 | 6203 | 20306 | 732 | 244 | YGR167W | 295 | 3.2(10)-26 | *Saccharomyces cerevisiae* | [ui:ygr167w] [pn:clathrin light chain:clc] [gn:clc] [gcfc:12.10:12.612.8] [keggfc:14.2] [sgdfc:3.1.0:8.3.0:8.7.0:9.2.0] [db:gtc-saccharomyces cerevisiae] |
| CONTIG4504 | 4862510_f2_1 | 6204 | 20307 | 483 | 161 | YIL004C | 129 | 1.3(10)-8 | *Saccharomyces cerevisiae* | [ui:yil004c] [pn:protein transport |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4702 | 25431318_c2_6 | 6205 | 20308 | 402 | 134 | YKR068C | 419 | 2.3(10)-39 | Saccharomyces cerevisiae | protein:protein transport protein bet1:protein sly12] [gn:bet1:sly12:yia4c] [gcfc:12.6.12.10:12.16] [keggfc:14.2] [sgdfc:8.3.0:9.4.0] [db:gtc-saccharomyces cerevisiae] [ui:ykr068c] [pn:involved in targeting and fusion of er to golgi transport vesicles:hypothetical 22.1 kd protein in ccp1-sis2 intergenic region] [gn:bet3] [gtcfc:12.6.12.10:12.16] [keggfc:14.2] [sgdfc:8.3.0] [db:gtc-saccharomyces cere |
| CONTIG3236 | 4151525_f1_1 | 6206 | 20309 | 570 | 190 | YLR026C | 280 | 1.3(10)-24 | Saccharomyces cerevisiae | [ui:ylr026c] [pn:syntaxin:t-snare:integral membrane protein] [gn:sed5] [gtcfc:12.6.12.10:12.16] [keggfc:14.2] [sgdfc:8.3.0:9.4.0] [db:gtc-saccharomyces cerevisiae] |
| CONTIG4698 | 10210151_c2_5 | 6207 | 20310 | 750 | 250 | YLR078C | 377 | 6.7(10)-35 | Saccharomyces cerevisiae | [ui:ylr078c] [pn:weak similarity to synaptobrevin:v-snare:vesicular transport protein bos1] [gn:bos1:i9449] [gtcfc:12.6.12.10:12.16] [keggfc:14.2] [sgdfc:8.3.0:9.9.0] [db:gtc-saccharomyces cerevisiae] |
| CONTIG2154 | 398885_f2_3 | 6208 | 20311 | 726 | 242 | YLR083C | 656 | 1.8(10)-64 | Saccharomyces cerevisiae | [ui:ylr083c] [pn:endosomal protein:endosomal p24a protein precursor:70 kd endomembrane protein:pheromone alpha-factor transporter:acidic 24 kd late endocytic intermediate component] [gn:emp70] [gtcfc:12.6.12.9:12.10:12.16] [keggfc:14.] |
| b2x13809.x | 15674131_c3_3 | 6209 | 20312 | 213 | 71 | YLR083C | 159 | 1.1(10)-10 | Saccharomyces cerevisiae | [ui:ylr083c] [pn:endosomal protein:endosomal p24a protein precursor:70 kd endomembrane protein:pheromone alpha-factor transporter:acidic 24 kd late endocytic intermediate component] [gn:emp70] [gtcfc:12.6.12.9:12.10:12.16] [keggfc:14.] |
| CONTIG5814 | 4412642_c3_63 | 6210 | 20313 | 843 | 281 | YLR093C | 149 | 9.1(10)-9 | Saccharomyces cerevisiae | [ui:ylr093c] [pn:weak similarity to synaptobrevin] [gtcfc:12.10] [keggfc:14.2] [sgdfc:8.3.0] [db:gtc-saccharomyces cerevisiae] |
| CONTIG5059 | 29345400_f2_2 | 6211 | 20314 | 912 | 304 | YLR208W | 798 | 1.6(10)-79 | Saccharomyces cerevisiae | [ui:ylr208w] [pn:protein transport |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | protein:protein transport protein sec13] [gn:sec13:l8167] [gtcfc:12.6:12.10:12.16] [keggfc:14.2] [sgdfc:8.3.0:9.9.0] [db:gtc-saccharomyces cerevisiae] |
| CONTIG5059 | 15735377_f2_3 | 6212 | 20315 | 228 | 76 | YLR208W | 291 | 8.6(10)-26 | Saccharomyces cerevisiae | [ui:ylr208w] [pn:protein transport protein:protein transport protein sec13] [gn:sec13:l8167] [gtcfc:12.6:12.10:12.16] [keggfc:14.2] [sgdfc:8.3.0:9.9.0] [db:gtc-saccharomyces cerevisiae] |
| b2x14395.y | 12672062_f2_1 | 6213 | 20316 | 414 | 138 | YLR262C | 454 | 4.5(10)-43 | Saccharomyces cerevisiae | [ui:ylr262c] [pn:gtp-binding protein of the rab family] [gn:ypt6] [gtcfc:12.10:12.16] [keggfc:14.2] [sgdfc:8.3.0:9.4.0] [db:gtc-saccharomyces cerevisiae] |
| CONTIG5294 | 13084678_c1_9 | 6214 | 20317 | 345 | 115 | YLR268W | 198 | 6.2(10)-16 | Saccharomyces cerevisiae | [ui:ylr268w] [pn:high copy suppressor of ypt1 null mutation:protein transport protein sec22:protein sly2] [gn:sec22:sly2:l8479] [gtcfc:12.6:12.10:12.13] [keggfc:14.2] [sgdfc:8.3.0:9.9.0] [db:gtc-saccharomyces cerevisiae] |
| CONTIG5294 | 13865676_c3_13 | 6215 | 20318 | 378 | 126 | YLR268W | 280 | 1.3(10)-24 | Saccharomyces cerevisiae | [ui:ylr268w] [pn:high copy suppressor of ypt1 null mutation:protein transport protein sec22:protein sly2] [gn:sec22:sly2:l8479] [gtcfc:12.6:12.10:12.13] [keggfc:14.2] [sgdfc:8.3.0:9.9.0] [db:gtc-saccharomyces cerevisiae] |
| CONTIG1382 | 9925053_c3_6 | 6216 | 20319 | 723 | 241 | YML012W | 539 | 4.5(10)-52 | Saccharomyces cerevisiae | [ui:yml012w] [pn:component of the copii-coated vesicles, 25 kda:hypothetical 24.1 kd protein in pp21-spt5 intergenic region precursor] [gn:erv25:ym9571] [gtcfc:12.10:12.16] [keggfc:14.2] [sgdfc:8.3.0:9.4.0] [db:gtc-saccharomyces cerev |
| CONTIG5218 | 4765925_c2_10 | 6217 | 20320 | 459 | 153 | YML001W | 123 | 6.7(10)-8 | Saccharomyces cerevisiae | [ui:yml001w] [pn:gtp-binding protein of the rab family:gtp-binding protein ypt7] [gn:ypt7:vam4:ym8270] [gtcfc:12.10:12.16:12.6] [keggfc:14.2] [sgdfc:8.3.0:8.7.0:9.9.0] [db:gtc-saccharomyces cerevisiae] |
| CONTIG5771 | 24414062_f1_4 | 6218 | 20321 | 1425 | 475 | YNL287W | 991 | 5.7(10)-100 | Saccharomyces | [ui:ynl287w] [pn:coatomer |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | complex gamma chain:gamma-cop of secretory pathway vesicles:coatomer gamma subunit:gamma-coat protein:gamma-cop) [gn:sec21:n0543] [gtcfc:12.10:12.16] [keggfc:14.2] [sgdfc:8.3.0:9.9.0] [db:gtc-saccharomyces c] |
| CONTIG5771 | 34183137_f2_17 | 6219 | 20322 | 1209 | 403 | YNL287W | 765 | 5.9(10)-76 | Saccharomyces cerevisiae | [ui:ynl287w] [pn:coatomer complex gamma chain:gamma-cop of secretory pathway vesicles:coatomer gamma subunit:gamma-coat protein:gamma-cop) [gn:sec21:n0543] [gtcfc:12.10:12.16] [keggfc:14.2] [sgdfc:8.3.0:9.9.0] [db:gtc-saccharomyces c] |
| CONTIG4146 | 22837890_f2_3 | 6220 | 20323 | 561 | 187 | YOR075W | 152 | 1.8(10)-10 | Saccharomyces cerevisiae | [ui:yor075w] [pn:syntaxin:t-snare of the er:protein] [gn:ufe1] [gtcfc:12.10:12.15:12.16:12.8] [keggfc:14.2] [sgdfc:3.1.0:3.4.0:8.3.0:9.4.0] [db:gtc-saccharomyces cerevisiae] |
| CONTIG3096 | 789055_c2_3 | 6221 | 20324 | 513 | 171 | YOR094W | 502 | 3.7(10)-48 | Saccharomyces cerevisiae | [ui:yor094w] [pn:adp-ribosylation factor 3] [gn:arf3:yor3172w] [gtcfc:12.10:12.16] [keggfc:14.2] [sgdfc:6.4.0:8.3.0] [db:gtc-saccharomyces cerevisiae] |
| CONTIG4244 | 6750050_f3_5 | 6222 | 20325 | 564 | 188 | YPL218W | 682 | 3.2(10)-67 | Saccharomyces cerevisiae | [ui:ypl218w] [pn:gtp-binding protein of the arf family:gtp-binding protein] [gn:sar1] [gtcfc:12.10:12.16] [keggfc:14.2] [sgdfc:8.3.0:9.4.0] [db:gtc-saccharomyces cerevisiae] |
| CONTIG2371 | 20492010_f3_3 | 6223 | 20326 | 777 | 259 | YPL085W | 117 | 4.5(10)-8 | Saccharomyces cerevisiae | [ui:ypl085w] [pn:multidomain vesicle coat protein] [gn:sec16] [gtcfc:12.10:12.16] [keggfc:14.2] [sgdfc:6.4.0:8.3.0:9.4.0:9.9.0] [db:gtc-saccharomyces cerevisiae] |
| CONTIG5542 | 24637217_c1_14 | 6224 | 20327 | 570 | 190 | YPL085W | 141 | 4.0(10)-8 | Saccharomyces cerevisiae | [ui:ypl085w] [pn:multidomain vesicle coat protein] [gn:sec16] [gtcfc:12.10:12.16] [keggfc:14.2] [sgdfc:6.4.0:8.3.0:9.4.0:9.9.0] [db:gtc-saccharomyces cerevisiae] |
| CONTIG5542 | 203936_c2_18 | 6225 | 20328 | 2640 | 880 | YPL085W | 182 | 2.2(10)-11 | Saccharomyces cerevisiae | [ui:ypl085w] [pn:multidomain vesicle coat protein] [gn:sec16] [gtcfc:12.10:12.16] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3413 | 10585825_f3_3 | 6226 | 20329 | 354 | 118 | YPL010W | 212 | 2.0(10)-17 | Saccharomyces cerevisiae | [sgdfc:6.4.0:8.3.0:9.4.0:9.9.0] [db:gtc-saccharomyces cerevisiae] [ui:ypl010w] [pn:coatomer complex zeta chain:coatomer zeta subunit:zeta-coat protein:zeta-cop] [gn:ret3:lpa7w:yp8132] [gtcfc:12.10:12.16] [keggfc:14.2] [sgdfc:8.3.0:9.9.0] [db:gtc-saccharomyces cerevisiae] |
| CONTIG3413 | 787757_f3_4 | 6227 | 20330 | 264 | 88 | YPL010W | 122 | 7.0(10)-8 | Saccharomyces cerevisiae | [ui:ypl010w] [pn:coatomer complex zeta chain:coatomer zeta subunit:zeta-coat protein:zeta-cop] [gn:ret3:lpa7w:yp8132] [gtcfc:12.10:12.16] [keggfc:14.2] [sgdfc:8.3.0:9.9.0] [db:gtc-saccharomyces cerevisiae] |
| CONTIG4477 | 2368437_f3_2 | 6228 | 20331 | 498 | 166 | YPR017C | 146 | 2.0(10)-10 | Saccharomyces cerevisiae | [ui:ypr017c] [pn:dgp/gtp exchange factor for sec4p:protein] [gn:dss4] [gtcfc:12.10:12.16] [keggfc:14.2] [sgdfc:8.3.0:9.9.0] [db:gtc-saccharomyces cerevisiae] |
| CONTIG3742 | 4766936_c1_8 | 6229 | 20332 | 864 | 288 | YPR181C | 759 | 2.2(10)-75 | Saccharomyces cerevisiae | [ui:ypr181c] [pn:component of copii coat of er-golgi vesicles:protein transport protein sec23] [gn:sec23:p9705] [gtcfc:12.6:12.10:12.16] [keggfc:14.2] [sgdfc:8.3.0:9.9.0] [db:gtc-saccharomyces cerevisiae] |
| CONTIG5369 | 14552287_f3_5 | 6230 | 20333 | 1956 | 652 | YPR181C | 407 | 7.2(10)-98 | Saccharomyces cerevisiae | [ui:ypr181c] [pn:component of copii coat of er-golgi vesicles:protein transport protein sec23] [gn:sec23:p9705] [gtcfc:12.6:12.10:12.16] [keggfc:14.2] [sgdfc:8.3.0:9.9.0] [db:gtc-saccharomyces cerevisiae] |
| CONTIG5369 | 20485688_f3_6 | 6231 | 20334 | 273 | 91 | YPR181C | 220 | 4.0(10)-17 | Saccharomyces cerevisiae | [ui:ypr181c] [pn:component of copii coat of er-golgi vesicles:protein transport protein sec23] [gn:sec23:p9705] [gtcfc:12.6:12.10:12.16] [keggfc:14.2] [sgdfc:8.3.0:9.9.0] [db:gtc-saccharomyces cerevisiae] |
| CONTIG5745 | 15835192_f3_7 | 6232 | 20335 | 1176 | 392 | YPR181C | 1256 | 4.7(10)-128 | Saccharomyces cerevisiae | [ui:ypr181c] [pn:component of copii coat of er-golgi vesicles:protein transport protein sec23] [gn:sec23:p9705] [gtcfc:12.6:12.10:12.16] [keggfc:14.2] [sgdfc:8.3.0:9.9.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5811 | 16658452_f2_10 | 6233 | 20336 | 2586 | 862 | YPR181C | 395 | 2.7(10)-51 | Saccharomyces cerevisiae | [ui:ypr181c] [pn:component of copii coat of er-golgi vesicles:protein transport protein sec23] [gn:sec23:rp9705] [gtcfc:12.6:12.10:12.16] [keggfc:14.2] [sgdfc:8.3.0:9.9.0] [db:gtc-saccharomyces cerevisiae] |
| CONTIG4077 | 16798577_c1_5 | 6234 | 20337 | 933 | 311 | YJR005W | 203 | 2.2(10)-15 | Saccharomyces cerevisiae | [ui:yjr005w] [pn:clathrin-associated protein complex, beta chain:probable beta-adaptin:clathrin assembly protein large beta chain:clathrin assembly protein complex 2 beta large chain] [gn:apl1:yap80:j1422] [gtcfc:12.10:12.16:12.6] [ke] |
| CONTIG3679 | 4066317_c3_5 | 6235 | 20338 | 864 | 288 | YJR005W | 416 | 2.0(10)-38 | Saccharomyces cerevisiae | [ui:yjr005w] [pn:clathrin-associated protein complex, beta chain:probable beta-adaptin:clathrin assembly protein large beta chain:clathrin assembly protein complex 2 beta large chain] [gn:apl1:yap80:j1422] [gtcfc:12.10:12.16:12.6] [ke] |
| CONTIG5482 | 957500_c2_20 | 6236 | 20339 | 507 | 169 | YJR058C | 469 | 1.2(10)-44 | Saccharomyces cerevisiae | [ui:yjr058c] [pn:clathrin-associated protein 17, small subunit:clathrin coat assembly protein ap17:clathrin coat associated protein ap17:plasma membrane adaptor ap-2 17 kd protein:ha2 17 kd subunit:clathrin assembly protein 2 small cha] |
| CONTIG1425 | 11739205_f1_1 | 6237 | 20340 | 807 | 269 | YKL135C | 144 | 5.2(10)-9 | Saccharomyces cerevisiae | [ui:ykl135c] [pn:beta-adaptin:probable beta-adaptin:clathrin assembly protein large beta chain:clathrin assembly protein complex 2 beta large chain] [gn:apl2] [gtcfc:12.10:12.16:12.6] [keggfc:14.2] |
| CONTIG2023 | 23455050_f2_1 | 6238 | 20341 | 903 | 301 | YKL135C | 579 | 2.6(10)-56 | Saccharomyces cerevisiae | [ui:ykl135c] [pn:beta-adaptin:probable beta-adaptin:clathrin assembly protein large beta chain:clathrin assembly protein complex 2 beta large chain] [gn:apl2] [gtcfc:12.10:12.16:12.6] [keggfc:14.2] |
| CONTIG2771 | 10972806_f1_3 | 6239 | 20342 | 372 | 124 | YKL135C | 345 | 1.3(10)-30 | Saccharomyces cerevisiae | [ui:ykl135c] [pn:beta-adaptin:probable beta- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5783 | 14728343_f2_12 | 6240 | 20343 | 552 | 184 | YLR080W | 162 | 2.7(10)-11 | Saccharomyces cerevisiae | adaptin:clathrin assembly protein large beta chain:clathrin assembly protein complex 2 beta large chain [gn:apl2] [gtcfc:12.10:12.16:12.6] [keggfc:14.2] [sgdfc:6.4.0:8.7.0:9.9.0] [db:gtc-sa] [ui:ylr080w] [pn:strong similarity to emp47p] [gtcfc:12.10:12.16] [keggfc:14.2] [sgdfc:9.9.0] [db:gtc-saccharomyces cerevisiae] |
| CONTIG3030 | 6756938_f1_1 | 6241 | 20344 | 390 | 130 | YLR170C | 390 | 2.7(10)-36 | Saccharomyces cerevisiae | [ui:ylr170c] [pn:clathrin-associated protein:ap complex, small subunit ap19:clathrin coat assembly protein ap19:clathrin coat associated protein ap19:golgi adaptor ap-1 19 kd adaptin:ha1 19 kd subunit:clathrin assembly protein complex |
| CONTIG5548 | 33767162_f2_53 | 6242 | 20345 | 324 | 108 | YBR132C | 125 | 4.2(10)-7 | Saccharomyces cerevisiae | [ui:ybr132c] [pn:strong similarity to amino-acid permeases:hypothetical amino-acid permease in vma2-cks1 intergenic region] [gn:ybr1007] [gtcfc:12.1:12.6] [keggfc:14.2] [sgdfc:1.1.3:7.4.0:17.0.0] [db:gtc-saccharomyces cerevisiae] |
| CONTIG5765 | 20320930_f2_12 | 6243 | 20346 | 855 | 285 | YBR132C | 397 | 1.1(10)-41 | Saccharomyces cerevisiae | [ui:ybr132c] [pn:strong similarity to amino-acid permeases:hypothetical amino-acid permease in vma2-cks1 intergenic region] [gn:ybr1007] [gtcfc:12.1:12.6] [keggfc:14.2] [sgdfc:1.1.3:7.4.0:17.0.0] [db:gtc-saccharomyces cerevisiae] |
| CONTIG5765 | 12588156_f2_13 | 6244 | 20347 | 873 | 291 | YBR132C | 457 | 2.2(10)-43 | Saccharomyces cerevisiae | [ui:ybr132c] [pn:strong similarity to amino-acid permeases:hypothetical amino-acid permease in vma2-cks1 intergenic region] [gn:ybr1007] [gtcfc:12.1:12.6] [keggfc:14.2] [sgdfc:1.1.3:7.4.0:17.0.0] [db:gtc-saccharomyces cerevisiae] |
| CONTIG3979 | 4801715_c1_8 | 6245 | 20348 | 225 | 75 | YDR160W | 151 | 1.2(10)-9 | Saccharomyces cerevisiae | [ui:ydr160w] [pn:similarity to amino acid permeases lyp1p and dip5p] [gtcfc:12.1:12.6] [keggfc:14.2] [sgdfc:1.1.3:7.4.0:17.0.0] [db:gtc-saccharomyces cerevisiae] |
| CONTIG3979 | 4018766_c2_10 | 6246 | 20349 | 1341 | 447 | YDR160W | 734 | 9.9(10)-73 | Saccharomyces cerevisiae | [ui:ydr160w] [pn:similarity to |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | amino acid permeases lyp1p and dip5p] [gtcfc:12.1:12.6] [keggfc:14.2] [sdgfc:1.1.3:7.4.0:17.0.0] [db-gtc-saccharomyces cerevisiae] |
| CONTIG3979 | 23921887_c3_11 | 6247 | 20350 | 384 | 128 | YDR160W | 127 | 4.2(10)-7 | Saccharomyces cerevisiae | [ui:ydr160w] [pn:similarity to amino acid permeases lyp1p and dip5p] [gtcfc:12.1:12.6] [keggfc:14.2] [sdgfc:1.1.3:7.4.0:17.0.0] [db-gtc-saccharomyces cerevisiae] |
| CONTIG5410 | 234380_c1_12 | 6248 | 20351 | 1191 | 397 | YDR508C | 651 | 6.2(10)-64 | Saccharomyces cerevisiae | [ui:ydr508c] [pn:high-affinity glutamine permease] [gn:gnp1:d9719] [gtcfc:12.1:12.6] [keggfc:14.2] [sdgfc:1.1.3:7.4.0:17.0.0] [db-gtc-saccharomyces cerevisiae] |
| CONTIG5787 | 10265628_c3_35 | 6249 | 20352 | 1731 | 577 | YDR508C | 1233 | 1.3(10)-125 | Saccharomyces cerevisiae | [ui:ydr508c] [pn:high-affinity glutamine permease] [gn:gnp1:d9719] [gtcfc:12.1:12.6] [keggfc:14.2] [sdgfc:1.1.3:7.4.0:17.0.0] [db-gtc-saccharomyces cerevisiae] |
| CONTIG5787 | 24788890_c3_33 | 6250 | 20353 | 1728 | 576 | YDR508C | 966 | 2.6(10)-97 | Saccharomyces cerevisiae | [ui:ydr508c] [pn:high-affinity glutamine permease] [gn:gnp1:d9719] [gtcfc:12.1:12.6] [keggfc:14.2] [sdgfc:1.1.3:7.4.0:17.0.0] [db-gtc-saccharomyces cerevisiae] |
| CONTIG2473 | 3938462_f2_2 | 6251 | 20354 | 639 | 213 | YFL055W | 306 | 2.2(10)-31 | Saccharomyces cerevisiae | [ui:yfl055w] [pn:similarity to gap1p and other amino acid permeases:hypothetical amino-acid permease in thi5-emp47 intergenic region] [gtcfc:12.1:12.6] [keggfc:14.2] [sdgfc:1.1.3:7.4.0:17.0.0] [db-gtc-saccharomyces cerevisiae] |
| b9x13d75.x | 12353513_c3_2 | 6252 | 20355 | 615 | 205 | YFL055W | 571 | 1.8(10)-55 | Saccharomyces cerevisiae | [ui:yfl055w] [pn:similarity to gap1p and other amino acid permeases:hypothetical amino-acid permease in thi5-emp47 intergenic region] [gtcfc:12.1:12.6] [keggfc:14.2] [sdgfc:1.1.3:7.4.0:17.0.0] [db-gtc-saccharomyces cerevisiae] |
| CONTIG3223 | 22385953_f1_1 | 6253 | 20356 | 1311 | 437 | YHL036W | 860 | 4.4(10)-86 | Saccharomyces cerevisiae | [ui:yhl036w] [pn:methionine permease:hypothetical 60.6 kd protein in cbp2-ssbr1 intergenic region] [gn:mup3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3098 | 34494828_c3_4 | 6254 | 20357 | 1455 | 485 | YKL174C | 678 | 8.5(10)-67 | Saccharomyces cerevisiae | [gtcfc:12.1:12.6] [keggfc:14.2] [sgdfc:1.1.3:7.4.0:17.0.0] [db:gtc-saccharomyces cerevisiae] [ui:ykl174c] [pn:similarity to choline transport protein hnm1;hypothetical amino-acid permease in ste3-gln10 intergenic region] [gn:ykl639] [gtcfc:12.2:11.1] [keggfc:14.2] [sgdfc:1.6.5:7.4.0:7.5.0:17.0.0] db:gtc-saccharomyces cerevi |
| CONTIG411 | 4691002_c3_2 | 6255 | 20358 | 525 | 175 | YPL274W | 164 | 2.7(10)-11 | Saccharomyces cerevisiae | [ui:ypl274w] [pn:strong similarity to amino-acid transport proteins] [gtcfc:12.1] [keggfc:14.2] [sgdfc:1.1.3:7.4.0] [db:gtc-saccharomyces cerevisiae] |
| CONTIG1576 | 9782688_f1_1 | 6256 | 20359 | 765 | 255 | YPL265W | 376 | 2.5(10)-34 | Saccharomyces cerevisiae | [ui:ypl265w] [pn:dicarboxylic amino acid permease] [gn:dip5] [gtcfc:12.1:12.6] [keggfc:14.2] [sgdfc:1.1.3:7.4.0:17.0.0] [db:gtc-saccharomyces cerevisiae] |
| CONTIG2689 | 13690811_c2_4 | 6257 | 20360 | 381 | 127 | YPL265W | 146 | 2.5(10)-9 | Saccharomyces cerevisiae | [ui:ypl265w] [pn:dicarboxylic amino acid permease] [gn:dip5] [gtcfc:12.1:12.6] [keggfc:14.2] [sgdfc:1.1.3:7.4.0:17.0.0] [db:gtc-saccharomyces cerevisiae] |
| CONTIG3496 | 17205_f3_3 | 6258 | 20361 | 402 | 134 | YPL265W | 105 | 6.2(10)-5 | Saccharomyces cerevisiae | [ui:ypl265w] [pn:dicarboxylic amino acid permease] [gn:dip5] [gtcfc:12.1:12.6] [keggfc:14.2] [sgdfc:1.1.3:7.4.0:17.0.0] [db:gtc-saccharomyces cerevisiae] |
| CONTIG5548 | 35162952_f1_4 | 6259 | 20362 | 1044 | 348 | YPL265W | 622 | 7.2(10)-61 | Saccharomyces cerevisiae | [ui:ypl265w] [pn:dicarboxylic amino acid permease] [gn:dip5] [gtcfc:12.1:12.6] [keggfc:14.2] [sgdfc:1.1.3:7.4.0:17.0.0] [db:gtc-saccharomyces cerevisiae] |
| b3x11276.x | 25672876_c3_1 | 6260 | 20363 | 564 | 188 | YPL265W | 358 | 2.5(10)-32 | Saccharomyces cerevisiae | [ui:ypl265w] [pn:dicarboxylic amino acid permease] [gn:dip5] [gtcfc:12.1:12.6] [keggfc:14.2] [sgdfc:1.1.3:7.4.0:17.0.0] [db:gtc-saccharomyces cerevisiae] |
| CONTIG3075 | 32210432_c3_5 | 6261 | 20364 | 1143 | 381 | YNR031C | 1109 | 4.0(10)-112 | Saccharomyces cerevisiae | [ui:ynr031c] [pn:map kinase kinase kinase of the high osmolarity signal transduction pathway;serine/threonine protein kinase ssk2;suppressor of sensor kinase 2] [gn:sssk2:n3276] [gtcfc:12.11:12.13:11.3] [ec:2.7.-.-] [keggfc:14.1] [sgdf |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4286 | 2110885_f3_2 | 6262 | 20365 | 2619 | 873 | YNR031C | 784 | 7.4(10)-85 | *Saccharomyces cerevisiae* | [ui:ynr031c] [pn:map kinase kinase kinase of the high osmolarity signal transduction pathway:serine/threonine protein kinase ssk2:suppressor of sensor kinase 2] [gn:ssk2:n3276] [gtcfc:12.11.12.13:11.3] [ec:2.7.--] [keggfc:14.1] [sgdf |
| CONTIG5729 | 24411529_c2_22 | 6263 | 20366 | 774 | 258 | YBL064C | 644 | 3.3(10)-63 | *Saccharomyces cerevisiae* | [ui:ybl064c] [pn:strong similarity to thiol-specific antioxidant enzyme:hypothetical 29.5 kd protein in ubp13-kip1 intergenic region] [gn:ybl0503:ybl0524] [gtcfc:12.12] [keggfc:14.2] [sgdfc:11.3.0] [db:gtc-*saccharomyces cerevisiae*] |
| CONTIG2099 | 16578517_f2_1 | 6264 | 20367 | 1359 | 453 | YBR043C | 663 | 1.5(10)-85 | *Saccharomyces cerevisiae* | [ui:ybr043c] [pn:similarity to benomyl/methotrexate resistance protein:hypothetical 77.3 kd protein in fig1-grip1 intergenic region] [gn:ybr0413] [gtcfc:12.12.6.13.3] [keggfc:14.2] [sgdfc:7.10.0:11.3.0:17.0.0] [db:gtc-*saccharomyces*] |
| CONTIG5647 | 1990642_c2_14 | 6265 | 20368 | 1560 | 520 | YBR180W | 470 | 2.8(10)-76 | *Saccharomyces cerevisiae* | [ui:ybr180w] [pn:similarity to drug resistance proteins:hypothetical 63.4 kd protein in smy2-rps101 intergenic region] [gn:ybr1242] [gtcfc:12.12.6.13.3] [keggfc:14.2] [sgdfc:7.10.0:11.3.0:17.0.0] [db:gtc-*saccharomyces cerevisiae*] |
| b3x16081.y | 35836703_c3_8 | 6266 | 20369 | 378 | 126 | YCL069W | 91 | 0.0027 | *Saccharomyces cerevisiae* | [ui:ycl069w] [pn:strong similarity to drug resistance protein sgel:hypothetical 50.2 kd protein in hml 5"region] [gn:ycl69w] [gtcfc:12.12.6.13.3] [keggfc:14.2] [sgdfc:7.10.0:11.3.0:17.0.0] [db:gtc-*saccharomyces cerevisiae*] |
| CONTIG3010 | 2131562_f2_3 | 6267 | 20370 | 1464 | 488 | YCR023C | 444 | 1.3(10)-86 | *Saccharomyces cerevisiae* | [ui:ycr023c] [pn:member of major facilitator superfamily multidrug-resistance protein family 2:hypothetical 69.2 kd protein in hsp30-pmp1 intergenic region] [gn:ycr23c:ycr241] [gtcfc:12.12.6] [keggfc:14.2] [sgdfc:7.11.0:11.3.0:17.0 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4693 | 6760956_c3_5 | 6268 | 20371 | 918 | 306 | YCR023C | 546 | 1.7(10)-57 | *Saccharomyces cerevisiae* | [ui:ycr023c] [pn:member of major facilitator superfamily multidrug-resistance protein family 2:hypothetical 69.2 kd protein in hsp30-pmp1 intergenic region] [gn:ycr23c:ycr241] [gtcfc:12.12.12.6] [keggfc:14.2] [sgdfc:7.11.0:11.3.0:17.0] |
| CONTIG5644 | 21984453_f2_4 | 6269 | 20372 | 372 | 124 | YCR023C | 174 | 2.3(10)-12 | *Saccharomyces cerevisiae* | [ui:ycr023c] [pn:member of major facilitator superfamily multidrug-resistance protein family 2:hypothetical 69.2 kd protein in hsp30-pmp1 intergenic region] [gn:ycr23c:ycr241] [gtcfc:12.12.12.6] [keggfc:14.2] [sgdfc:7.11.0:11.3.0:17.0] |
| CONTIG1849 | 29531277_c2_7 | 6270 | 20373 | 942 | 314 | YDL100C | 782 | 8.0(10)-78 | *Saccharomyces cerevisiae* | [ui:ydl100c] [pn:similarity to *e. coli* arsenical pump-driving atpase] [gtcfc:12.12] [keggfc:14.2] [sgdfc:1 3.0] [db:gtc-*saccharomyces cerevisiae*] |
| CONTIG1433 | 666715_f1_1 | 6271 | 20374 | 849 | 283 | YDR135C | 707 | 1.2(10)-68 | *Saccharomyces cerevisiae* | [ui:ydr135c] [pn:glutathione s-conjugate transporter, vacuolar:metal resistance protein:yeast cadmium factor 1] [gn:ycf1] [gtcfc:12.6:12.12.12.13] [keggfc:14.2] [sgdfc:7.9.0:8.5.0:9.10.0:11.3.0] [db:gtc-*saccharomyces cerevisiae*] |
| CONTIG4113 | 22475090_c2_4 | 6272 | 20375 | 1716 | 572 | YDR135C | 1582 | 9.5(10)-202 | *Saccharomyces cerevisiae* | [ui:ydr135c] [pn:glutathione s-conjugate transporter, vacuolar:metal resistance protein:yeast cadmium factor 1] [gn:ycf1] [gtcfc:12.6:12.12.12.13] [keggfc:14.2] [sgdfc:7.9.0:8.5.0:9.10.0:11.3.0] [db:gtc-*saccharomyces cerevisiae*] |
| CONTIG4155 | 12537878_c1_3 | 6273 | 20376 | 2250 | 750 | YDR135C | 1716 | 8.5(10)-177 | *Saccharomyces cerevisiae* | [ui:ydr135c] [pn:glutathione s-conjugate transporter, vacuolar:metal resistance protein:yeast cadmium factor 1] [gn:ycf1] [gtcfc:12.6:12.12.12.13] [keggfc:14.2] [sgdfc:7.9.0:8.5.0:9.10.0:11.3.0] [db:gtc-*saccharomyces cerevisiae*] |
| CONTIG397 | 1995832_c3_3 | 6274 | 20377 | 1191 | 397 | YDR135C | 408 | 1.0(10)-36 | *Saccharomyces cerevisiae* | [ui:ydr135c] [pn:glutathione s-conjugate transporter, vacuolar:metal resistance protein:yeast cadmium factor 1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3463 | 13722300_c3_3 | 6275 | 20378 | 1464 | 488 | YFR022W | 631 | 5.2(10)-81 | Saccharomyces cerevisiae | [gn:ycf1] [gtcfc:12.6:12.12:12.13] [keggfc:14.2] [sgdfc:7.9.0:8.5.0:9.10.0:11.3.0] [db-gtc-saccharomyces cerevisiae] [ui:yfr022w] [pn:similarity to rod1p:hypothetical 79.7 kd protein in fab1-pcs4 intergenic region] [gtcfc:12.12] [keggfc:14.2] [sgdfc:11.3.0] [db-gtc-saccharomyces cerevisiae] |
| CONTIG5613 | 19767203_c1_20 | 6276 | 20379 | 1773 | 591 | YFR022W | 231 | 9.0(10)-30 | Saccharomyces cerevisiae | [ui:yfr022w] [pn:similarity to rod1p:hypothetical 79.7 kd protein in fab1-pcs4 intergenic region] [gtcfc:12.12] [keggfc:14.2] [sgdfc:11.3.0] [db-gtc-saccharomyces cerevisiae] |
| CONTIG5613 | 23628562_c3_24 | 6277 | 20380 | 249 | 83 | YFR022W | 106 | 6.2(10)-5 | Saccharomyces cerevisiae | [ui:yfr022w] [pn:similarity to rod1p:hypothetical 79.7 kd protein in fab1-pcs4 intergenic region] [gtcfc:12.12] [keggfc:14.2] [sgdfc:11.3.0[db-gtc-saccharomyces cerevisiae] |
| CONTIG5814 | 24400437_c3_50 | 6278 | 20381 | 705 | 235 | YGL016W | 257 | 7.5(10)-21 | Saccharomyces cerevisiae | [ui:ygl016w] [pn:pleiotropic drug resistance regulatory protein:pleiotropic drug resistance regulatory protein 6] [gn:pdr6] [gtcfc:12.12] [keggfc:14.2] [sgdfc:11.3.0] [db-gtc-saccharomyces cerevisiae] |
| b2x11126.x | 6833390_c1_4 | 6279 | 20382 | 441 | 147 | YGL016W | 135 | 7.9(10)-8 | Saccharomyces cerevisiae | [ui:ygl016w] [pn:pleiotropic drug resistance regulatory protein:pleiotropic drug resistance regulatory protein 6] [gn:pdr6] [gtcfc:12.12] [keggfc:14.2] [sgdfc:11.3.0] [db-gtc-saccharomyces cerevisiae] |
| CONTIG4203 | 13101687_c1_5 | 6280 | 20383 | 774 | 258 | YGR138C | 782 | 8.0(10)-78 | Saccharomyces cerevisiae | [ui:ygr138c] [pn:similarity to multidrug resistance proteins:hypothetical 67.6 kd protein in pas5-cbf2 intergenic region] [gtcfc:12.12:12.6:12.13.3] [keggfc:14.2] [sgdfc:7.10.0:11.3.0:17.0.0] [db-gtc-saccharomyces cerevisiae] |
| CONTIG4751 | 5961700_c2_10 | 6281 | 20384 | 936 | 312 | YGR138C | 369 | 1.6(10)-33 | Saccharomyces cerevisiae | [ui:ygr138c] [pn:similarity to multidrug resistance proteins:hypothetical 67.6 kd protein in pas5-cbf2 intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3322 | 894762_f1_1 | 6282 | 20385 | 939 | 313 | YGR197C | 362 | 4.4(10)-33 | Saccharomyces cerevisiae | region] [gtcfc:12.12.12.6:13.3] [keggfc:14.2] [sgdfc:7.10.0:11.3.0:17.0.0] [db:gtc-saccharomyces cerevisiae] [ui:ygr197c] [pn:involved in nitroguanidine resistance:nitrosoguanidine resistance protein sng1] [gn:sng1:g7591] [gtcfc:12.12.12.6:13.3] [keggfc:14.2] |
| CONTIG4771 | 11837837_c2_9 | 6283 | 20386 | 525 | 175 | YGR197C | 159 | 8.4(10)-11 | Saccharomyces cerevisiae | [sgdfc:7.10.0:11.3.0:17.0.0] [db:gtc-saccharomyces cerevisiae] [ui:ygr197c] [pn:involved in nitroguanidine resistance:nitrosoguanidine resistance protein sng1] [gn:sng1:g7591] [gtcfc:12.12.12.6:13.3] [keggfc:14.2] |
| CONTIG4771 | 2616401_c1_6 | 6284 | 20387 | 270 | 90 | YGR197C | 107 | 3.2(10)-5 | Saccharomyces cerevisiae | [sgdfc:7.10.0:11.3.0:17.0.0] [db:gtc-saccharomyces cerevisiae] [ui:ygr197c] [pn:involved in nitroguanidine resistance:nitrosoguanidine resistance protein sng1] [gn:sng1:g7591] [gtcfc:12.12.12.6:13.3] [keggfc:14.2] |
| CONTIG635 | 14191067_f1_1 | 6285 | 20388 | 702 | 234 | YGR197C | 348 | 1.8(10)-31 | Saccharomyces cerevisiae | [sgdfc:7.10.0:11.3.0:17.0.0] [db:gtc-saccharomyces cerevisiae] [ui:ygr197c] [pn:involved in nitroguanidine resistance:nitrosoguanidine resistance protein sng1] [gn:sng1:g7591] [gtcfc:12.12.12.6:13.3] [keggfc:14.2] |
| CONTIG1618 | 7837_f1_1 | 6286 | 20389 | 1074 | 358 | YGR224W | 380 | 9.4(10)-35 | Saccharomyces cerevisiae | [sgdfc:7.10.0:11.3.0:17.0.0] [db:gtc-saccharomyces cerevisiae] [ui:ygr224w] [pn:strong similarity to drug resistance protein sge1:hypothetical 67.2 kd protein in pet54-die2 intergenic region] [gn:g8537] [gtcfc:12.12.12.6:13.3] [keggfc:14.2] |
| CONTIG66 | 11113175_f1_1 | 6287 | 20390 | 630 | 210 | YGR224W | 308 | 8.0(10)-27 | Saccharomyces | [sgdfc:7.10.0:11.3.0:17.0.0] [db:gtc-saccharomyces cerev] [ui:ygr224w] [pn:strong similarity |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | to drug resistance protein sge1:hypothetical 67.2 kd protein in pet54-die2 intergenic region] [gn:g8537] [gtcfc:12.12.6.13.3] [keggfc:14.2] [sgdfc:7.10.0:11.3.0:17.0.0] [db-gtc-saccharomyces cerev] |
| CONTIG906 | 901928_f1_1 | 6288 | 20391 | 540 | 180 | YGR224W | 146 | 2.5(10)-9 | Saccharomyces cerevisiae | [ui:ygr224w] [pn:strong similarity to drug resistance protein sge1:hypothetical 67.2 kd protein in pet54-die2 intergenic region] [gn:g8537] [gtcfc:12.12.6.13.3] [keggfc:14.2] [sgdfc:7.10.0:11.3.0:17.0.0] [db-gtc-saccharomyces cerevisiae] |
| CONTIG1647 | 31926000_c2_4 | 6289 | 20392 | 1014 | 338 | YHL040C | 693 | 2.2(10)-68 | Saccharomyces cerevisiae | [ui:yhl040c] [pn:similarity to c. carbonum toxin pump:hypothetical 70.9 kd protein in cbp2 5"region] [gtcfc:12.12.6.13.3] [keggfc:14.2] [sgdfc:7.10.0:11.3.0:17.0.0] [db-gtc-saccharomyces cerevisiae] |
| CONTIG2318 | 165853432_f1_1 | 6290 | 20393 | 426 | 142 | YHL040C | 92 | 0.027 | Saccharomyces cerevisiae | [ui:yhl040c] [pn:similarity to c. carbonum toxin pump:hypothetical 70.9 kd protein in cbp2 5"region] [gtcfc:12.12.6.13.3] [keggfc:14.2] [sgdfc:7.10.0:11.3.0:17.0.0] [db-gtc-saccharomyces cerevisiae] |
| CONTIG3837 | 4954407_c2_7 | 6291 | 20394 | 378 | 126 | YHL040C | 223 | 1.3(10)-17 | Saccharomyces cerevisiae | [ui:yhl040c] [pn:similarity to c. carbonum toxin pump:hypothetical 70.9 kd protein in cbp2 5"region] [gtcfc:12.12.6.13.3] [keggfc:14.2] [sgdfc:7.10.0:11.3.0:17.0.0] [db-gtc-saccharomyces cerevisiae] |
| CONTIG3105 | 25658443_c3_9 | 6292 | 20395 | 1494 | 498 | YHR032W | 855 | 1.5(10)-85 | Saccharomyces cerevisiae | [ui:yhr032w] [pn:ethionine resistance protein:hypothetical 64.2 kd protein in slt2-put2 intergenic region] [gn:erc1] [gtcfc:12.12.6.13.3] [keggfc:14.2] [sgdfc:7.10.0:11.3.0:17.0.0] [db-gtc-saccharomyces cerevisiae] |
| CONTIG3187 | 578126_f2_3 | 6293 | 20396 | 1074 | 358 | YHR032W | 497 | 3.0(10)-56 | Saccharomyces cerevisiae | [ui:yhr032w] [pn:ethionine resistance protein:hypothetical 64.2 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | kd protein in slt2-put2 intergenic region] [gn:erc1] [gtcfc:12.12.6.13.3] [keggfc:14.2] [sgdfc:7.10.0:11.3.0:170.0] [db:gtc-saccharomyces cerevisiae] |
| CONTIG3200 | 4175067_f1_1 | 6294 | 20397 | 720 | 240 | YHR032W | 419 | 2.3(10)-39 | Saccharomyces cerevisiae | [ui:yhr032w] [pn:ethionine resistance protein:hypothetical 64.2 kd protein in slt2-put2 intergenic region] [gn:erc1] [gtcfc:12.12.6.13.3] [keggfc:14.2] [sgdfc:7.10.0:11.3.0:17.0.0] [db:gtc-saccharomyces cerevisiae] |
| CONTIG3246 | 4379637_c3_2 | 6295 | 20398 | 1023 | 341 | YHR032W | 600 | 1.6(10)-58 | Saccharomyces cerevisiae | [ui:yhr032w] [pn:ethionine resistance protein:hypothetical 64.2 kd protein in slt2-put2 intergenic region] [gn:erc1] [gtcfc:12.12.6.13.3] [keggfc:14.2] [sgdfc:7.10.0:11.3.0:17.0.0] [db:gtc-saccharomyces cerevisiae] |
| CONTIG5342 | 2347062_c3_23 | 6296 | 20399 | 1452 | 484 | YHR032W | 750 | 2.0(10)-74 | Saccharomyces cerevisiae | [ui:yhr032w] [pn:ethionine resistance protein:hypothetical 64.2 kd protein in slt2-put2 intergenic region] [gn:erc1] [gtcfc:12.12.6.13.3] [keggfc:14.2] [sgdfc:7.10.0:11.3.0:17.0.0] [db:gtc-saccharomyces cerevisiae] |
| CONTIG5707 | 21601512_f3_13 | 6297 | 20400 | 1593 | 531 | YHR048W | 1073 | 1.2(10)-108 | Saccharomyces cerevisiae | [ui:yhr048w] [pn:similarity to multidrug resistance proteins:hypothetical 57.8 kd protein in aap1-smf2 intergenic region] [gtcfc:12.12.6:13.3] [keggfc:14.2] [sgdfc:7.10.0:11.3.0:17.0.0] [db:gtc-saccharomyces cerevisiae] |
| CONTIG4670 | 1464556_c3_10 | 6298 | 20401 | 372 | 124 | YJR015W | 186 | 9.0(10)-14 | Saccharomyces cerevisiae | [ui:yjr015w] [pn:strong similarity to sng1p:hypothetical 58.1 kd protein in spc1-ilv3 intergenic region] [gnj1448] [gtcfc:12.12] [keggfc:14.2] [sgdfc:11.3.0] [db:gtc-saccharomyces cerevisiae] |
| CONTIG4865 | 12526586_f3_7 | 6299 | 20402 | 1188 | 396 | YJR015W | 224 | 5.9(10)-16 | Saccharomyces cerevisiae | [ui:yjr015w] [pn:strong similarity to sng1p:hypothetical 58.1 kd protein in spc1-ilv3 intergenic region] [gnj1448] [gtcfc:12.12] [keggfc:11.3.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2879 | 5985002_f2_1 | 6300 | 20403 | 291 | 97 | YJR104C | 315 | 2.5(10)-28 | Saccharomyces cerevisiae | [db:gtc-saccharomyces cerevisiae] [ui:yjr104c] [pn:copper-zinc superoxide dismutase:superoxide dismutase:cu-zn] [gn:sod1;j1968] [gtcfc:12.12.14.1] [ec:1.15.1.1] [keggfc:14.1] [sgdfc:9.2.0:11.3.0] |
| CONTIG3171 | 12687761_f2_1 | 6301 | 20404 | 480 | 160 | YJR104C | 554 | 1.2(10)-53 | Saccharomyces cerevisiae | [db:gtc-saccharomyces cerevisiae] [ui:yjr104c] [pn:copper-zinc superoxide dismutase:superoxide dismutase:cu-zn] [gn:sod1;j1968] [gtcfc:12.12.14.1] [ec:1.15.1.1] [keggfc:14.1] [sgdfc:9.2.0:11.3.0] |
| CONTIG5673 | 25015_f3_17 | 6302 | 20405 | 2445 | 815 | YKL064W | 964 | 2.2(10)-135 | Saccharomyces cerevisiae | [db:gtc-saccharomyces cerevisiae] [ui:ykl064w] [pn:overexpression overcomes manganese toxicity:hypothetical 109.7 kd protein in nup100-msn4 intergenic region] [gn:mnr2] [gtcfc:12.12.126] [keggfc:14.2] [sgdfc:1.8.1:11.3.0] |
| CONTIG2972 | 5906632_c3_1 | 6303 | 20406 | 1455 | 485 | YKL004W | 314 | 1.7(10)-32 | Saccharomyces cerevisiae | [db:gtc-saccharomyces cerevisiae] [ui:ykl004w] [pn:aureobasidin-resistance protein:hypothetical 45.2 kd protein rpl14a-mrp17 intergenic region] [gn:aur1] [gtcfc:12.12] [keggfc:14.2] [sgdfc:11.3.0] |
| CONTIG5664 | 5947586_c3_23 | 6304 | 20407 | 1902 | 634 | YKR105C | 361 | 2.8(10)-61 | Saccharomyces cerevisiae | [db:gtc-saccharomyces cerevisiae] [ui:ykr105c] [pn:strong similarity to sge1p and hypothetical protein ycl069w:hypothetical 63.4 kd protein in sir1 3"region] [gtcfc:12.2.2.6.13.3] [keggfc:14.2] |
| CONTIG2718 | 13929502_f2_2 | 6305 | 20408 | 1323 | 441 | YLL028W | 486 | 1.8(10)-46 | Saccharomyces cerevisiae | [sgdfc:7.10.0:11.3.0:17.0.0] [db:gtc-saccharomyces cerevisiae] [ui:yll028w] [pn:similarity to multidrug resistance proteins] [gtcfc:12.12.6:13.3] [keggfc:14.2] |
| CONTIG4898 | 5111008_c3_7 | 6306 | 20409 | 1266 | 422 | YLL028W | 988 | 1.2(10)-99 | Saccharomyces cerevisiae | [sgdfc:7.10.0:11.3.0:17.0.0] [db:gtc-saccharomyces cerevisiae] [ui:yll028w] [pn:similarity to multidrug resistance proteins] [gtcfc:12.12.6:13.3] [keggfc:14.2] |
| CONTIG4844 | 14720377_f2_3 | 6307 | 20410 | 585 | 195 | YLL028W | 122 | 8.0(10)-6 | Saccharomyces cerevisiae | [sgdfc:7.10.0:11.3.0:17.0.0] [db:gtc-saccharomyces cerevisiae] [ui:yll028w] [pn:similarity to multidrug resistance proteins] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5254 | 4413176_c2_19 | 6308 | 20411 | 1701 | 567 | YLL028W | 1116 | 3.2(10)-113 | Saccharomyces cerevisiae | [gtcfc:12.12.6:13.3] [keggfc:14.2] [sgdfc:7.10.0:11.3.0:17.0.0] [db:gtc-saccharomyces cerevisiae] [ui:yll028w] [pn:similarity to multidrug resistance proteins] [gtcfc:12.12.6:13.3] [keggfc:14.2] [sgdfc:7.10.0:11.3.0:17.0.0] [db:gtc-saccharomyces cerevisiae] |
| CONTIG1371 | 26360662_f3_1 | 6309 | 20412 | 909 | 303 | YLL015W | 554 | 1.2(10)-58 | Saccharomyces cerevisiae | [ui:yll015w] [pn:similarity to metal resistance proteins] [gtcfc:12.12.12.6] [keggfc:14.2] [sgdfc:7.9.0:11.3.0] [db:gtc-saccharomyces cerevisiae] |
| CONTIG2696 | 1203503_c2_7 | 6310 | 20413 | 2019 | 673 | YLL015W | 1050 | 1.3(10)-105 | Saccharomyces cerevisiae | [ui:yll015w] [pn:similarity to metal resistance proteins] [gtcfc:12.12.12.6] [keggfc:14.2] [sgdfc:7.9.0:11.3.0] [db:gtc-saccharomyces cerevisiae] |
| CONTIG5211 | 13829562_f3_8 | 6311 | 20414 | 207 | 69 | YLL015W | 211 | 9.9(10)-16 | Saccharomyces cerevisiae | [ui:yll015w] [pn:similarity to metal resistance proteins] [gtcfc:12.12.12.6] [keggfc:14.2] [sgdfc:7.9.0:11.3.0] [db:gtc-saccharomyces cerevisiae] |
| CONTIG5591 | 2068753_f1_2 | 6312 | 20415 | 489 | 163 | YLL015W | 457 | 6.2(10)-42 | Saccharomyces cerevisiae | [ui:yll015w] [pn:similarity to metal resistance proteins] [gtcfc:12.12.12.6] [keggfc:14.2] [sgdfc:7.9.0:11.3.0] [db:gtc-saccharomyces cerevisiae] |
| CONTIG5744 | 21750300_f1_1 | 6313 | 20416 | 627 | 209 | YML028W | 766 | 4.0(10)-76 | Saccharomyces cerevisiae | [ui:yml028w] [pn:thiol-specific antioxidant:thiol-specific antioxidant:prp] [gn:tsa1:tsa] [gtcfc:12.12] [keggfc:14.2] [sgdfc:9.2.0:11.3.0] [db:gtc-saccharomyces cerevisiae] |
| CONTIG763 | 34017686_c1_2 | 6314 | 20417 | 252 | 84 | YNL259C | 147 | 1.6(10)-10 | Saccharomyces cerevisiae | [ui:ynl259c] [pn:antioxidant protein and metal homeostasis factor:metal homeostasis factor atx1] [gn:atx1:n0840] [gtcfc:12.12.12.6] [keggfc:14.2] [sgdfc:1.8.1:11.3.0] [db:gtc-saccharomyces cerevisiae] |
| CONTIG4821 | 14537702_c1_10 | 6315 | 20418 | 1515 | 505 | YNL065W | 750 | 2.0(10)-74 | Saccharomyces cerevisiae | [ui:ynl065w] [pn:similarity to resistance proteins:hypothetical 65.3 kd protein in sun4-mas5 intergenic region] [gn:n2417:ynl2417w] [gtcfc:12.12.6:13.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5691 | 24414132_f1_1 | 6316 | 20419 | 1194 | 398 | YNL065W | 634 | 3.8(10)-62 | *Saccharomyces cerevisiae* | [keggfc:14.2] [sgdfc:7.10.0:11.3.0:17.0.0] [db-gtc-*saccharomyces cerevisiae*] [ui:ynl065w] [pn:similarity to resistance proteins:hypothetical 65.3 kd protein in sun4-mas5 intergenic region] [gn:n2417:ynl2417w] [gtcfc:12.12:12.6:13.3] |
| CONTIG2305 | 12673131_c2_4 | 6317 | 20420 | 360 | 120 | YNR055C | 120 | 1.5(10)-6 | *Saccharomyces cerevisiae* | [keggfc:14.2] [sgdfc:7.10.0:11.3.0:17.0.0] [db-gtc-*saccharomyces cerevisiae*] [ui:ynr055c] [pn:member of major facilitator superfamily multidrug-resistance protein subfamily 1:hol1 protein] [gn:hol1:n3494] [gtcfc:12.12:12.6:13.3] |
| CONTIG2809 | 31400_c1_6 | 6318 | 20421 | 798 | 266 | YNR055C | 161 | 5.9(10)-15 | *Saccharomyces cerevisiae* | [keggfc:14.2] [sgdfc:7.10.0:11.3.0:17.0.0] [db-gtc-*saccharomyces cerevisiae*] [ui:ynr055c] [pn:member of major facilitator superfamily multidrug-resistance protein subfamily 1:hol1 protein] [gn:hol1:n3494] [gtcfc:12.12:12.6:13.3] |
| CONTIG2809 | 23640702_c1_5 | 6319 | 20422 | 615 | 205 | YNR055C | 208 | 4.9(10)-16 | *Saccharomyces cerevisiae* | [keggfc:14.2] [sgdfc:7.10.0:11.3.0:17.0.0] [db-gtc-*saccharomyces cerevisiae*] [ui:ynr055c] [pn:member of major facilitator superfamily multidrug-resistance protein subfamily 1:hol1 protein] [gn:hol1:n3494] [gtcfc:12.12:12.6:13.3] |
| CONTIG5052 | 11726562_c2_4 | 6320 | 20423 | 1788 | 596 | YNR055C | 1514 | 2.2(10)-155 | *Saccharomyces cerevisiae* | [keggfc:14.2] [sgdfc:7.10.0:11.3.0:17.0.0] [db-gtc-*saccharomyces cerevisiae*] [ui:ynr055c] [pn:member of major facilitator superfamily multidrug-resistance protein subfamily 1:hol1 protein] [gn:hol1:n3494] [gtcfc:12.12:12.6:13.3] |
| CONTIG5216 | 502290_f3_8 | 6321 | 20424 | 1353 | 451 | YNR055C | 730 | 2.6(10)-72 | *Saccharomyces cerevisiae* | [keggfc:14.2] [sgdfc:7.10.0:11.3.0:17.0.0] [db-gtc-*saccharomyces cerevisiae*] [ui:ynr055c] [pn:member of major facilitator superfamily multidrug-resistance protein subfamily 1:hol1 protein] [gn:hol1:n3494] [gtcfc:12.12:12.6:13.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5307 | 24254561_f3_6 | 6322 | 20425 | 1329 | 443 | YNR055C | 177 | 1.2(10)-20 | Saccharomyces cerevisiae | [ui:ynr055c] [pn:member of major facilitator superfamily multidrug-resistance protein subfamily 1:hol1 protein] [gn:hol1:n3494] [gtcfc:12.12.12.6:13.3] [keggfc:14.2] [sgdfc:7.10.0:11.3.0:17.0.0] [db:gtc-saccharomyces cerevisiae] |
| CONTIG5307 | 3947553_f2_3 | 6323 | 20426 | 438 | 146 | YNR055C | 143 | 4.9(10)-9 | Saccharomyces cerevisiae | [ui:ynr055c] [pn:member of major facilitator superfamily multidrug-resistance protein subfamily 1:hol1 protein] [gn:hol1:n3494] [gtcfc:12.12.12.6:13.3] [keggfc:14.2] [sgdfc:7.10.0:11.3.0:17.0.0] [db:gtc-saccharomyces cerevisiae] |
| CONTIG5644 | 35369200_c3_20 | 6324 | 20427 | 795 | 265 | YNR055C | 248 | 2.2(10)-20 | Saccharomyces cerevisiae | [ui:ynr055c] [pn:member of major facilitator superfamily multidrug-resistance protein subfamily 1:hol1 protein] [gn:hol1:n3494] [gtcfc:12.12.12.6:13.3] [keggfc:14.2] [sgdfc:7.10.0:11.3.0:17.0.0] [db:gtc-saccharomyces cerevisiae] |
| CONTIG5644 | 1370781_c1_14 | 6325 | 20428 | 1197 | 399 | YNR055C | 222 | 1.2(10)-15 | Saccharomyces cerevisiae | [ui:ynr055c] [pn:member of major facilitator superfamily multidrug-resistance protein subfamily 1:hol1 protein] [gn:hol1:n3494] [gtcfc:12.12.12.6:13.3] [keggfc:14.2] [sgdfc:7.10.0:11.3.0:17.0.0] [db:gtc-saccharomyces cerevisiae] |
| CONTIG8 | 24254561_c1_1 | 6326 | 20429 | 249 | 83 | YNR055C | 94 | 0.00089 | Saccharomyces cerevisiae | [ui:ynr055c] [pn:member of major facilitator superfamily multidrug-resistance protein subfamily 1:hol1 protein] [gn:hol1:n3494] [gtcfc:12.12.12.6:13.3] [keggfc:14.2] [sgdfc:7.10.0:11.3.0:17.0.0] [db:gtc-saccharomyces cerevisiae] |
| CONTIG1524 | 16042580_f2_1 | 6327 | 20430 | 507 | 169 | YOL130W | 312 | 6.7(10)-27 | Saccharomyces cerevisiae | [ui:yol130w] [pn:aluminium resistance protein] [gn:alr1] [gtcfc:12.12] [keggfc:14.2] [sgdfc:11.3.0] [db:gtc-saccharomyces cerevisiae] |
| CONTIG3482 | 4720302_f1_1 | 6328 | 20431 | 2358 | 786 | YOL130W | 1002 | 3.8(10)-101 | Saccharomyces cerevisiae | [ui:yol130w] [pn:aluminium |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4240 | 20337552_c2_2 | 6329 | 20432 | 927 | 309 | YOR273C | 255 | 5.2(10)-21 | Saccharomyces cerevisiae | resistance protein] [gn:alr1] [gtcfc:12.12] [keggfc:14.2] [sgdfc:11.3.0] [db:gtc-saccharomyces cerevisiae [ui:yor273c] [pn:similarity to resistance proteins] [gtcfc:12.12.6.13.3] [keggfc:14.2] [sgdfc:7.10.0:11.3.0:17.0.0] [db:gtc-saccharomyces cerevisiae |
| CONTIG5024 | 34178918_f2_1 | 6330 | 20433 | 1083 | 361 | YOR273C | 719 | 3.7(10)-71 | Saccharomyces cerevisiae | [ui:yor273c] [pn:similarity to resistance proteins] [gtcfc:12.12.6.13.3] [keggfc:14.2] [sgdfc:7.10.0:11.3.0:17.0.0] [db:gtc-saccharomyces cerevisiae |
| CONTIG3194 | 35832152_f1_1 | 6331 | 20434 | 1191 | 397 | YOR378W | 634 | 3.8(10)-62 | Saccharomyces cerevisiae | [ui:yor378w] [pn:strong similarity to aminotriazole resistance protein] [gtcfc:12.12.6.13.3] [keggfc:14.2] [sgdfc:7.10.0:11.3.0:17.0.0] [db:gtc-saccharomyces cerevisiae |
| CONTIG3610 | 3994386_c1_7 | 6332 | 20435 | 426 | 142 | YOR378W | 127 | 2.1(10)-7 | Saccharomyces cerevisiae | [ui:yor378w] [pn:strong similarity to aminotriazole resistance protein] [gtcfc:12.12.6.13.3] [keggfc:14.2] [sgdfc:7.10.0:11.3.0:17.0.0] [db:gtc-saccharomyces cerevisiae |
| CONTIG4609 | 14645400_f1_1 | 6333 | 20436 | 1650 | 550 | YOR378W | 963 | 5.2(10)-97 | Saccharomyces cerevisiae | [ui:yor378w] [pn:strong similarity to aminotriazole resistance protein] [gtcfc:12.12.6.13.3] [keggfc:14.2] [sgdfc:7.10.0:11.3.0:17.0.0] [db:gtc-saccharomyces cerevisiae |
| CONTIG4928 | 2908412_f3_4 | 6334 | 20437 | 1554 | 518 | YPL092W | 285 | 4.5(10)-43 | Saccharomyces cerevisiae | [ui:ypl092w] [pn:sulfite sensitivity protein:sulfite sensitivity protein ssu1] [gn:ssu1:pg16w] [gtcfc:12.12] [keggfc:14.2] [sgdfc:11.3.0] [db:gtc-saccharomyces cerevisiae |
| CONTIG4203 | 5328252_c3_7 | 6335 | 20438 | 948 | 316 | YPR156C | 673 | 1.5(10)-85 | Saccharomyces cerevisiae | [ui:ypr156c] [pn:similarity to multidrug resistance proteins] [gtcfc:12.12.6.13.3] [keggfc:14.2] [sgdfc:7.10.0:11.3.0:17.0.0] [db:gtc-saccharomyces cerevisiae |
| CONTIG5501 | 12111067_f2_8 | 6336 | 20439 | 1788 | 596 | YPR156C | 795 | 3.3(10)-79 | Saccharomyces cerevisiae | [ui:ypr156c] [pn:similarity to multidrug resistance proteins] [gtcfc:12.12.6.13.3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5501 | 4569426_f1_5 | 6337 | 20440 | 1173 | 391 | YPR156C | 355 | 6.0(10)-32 | *Saccharomyces cerevisiae* | [ui:ypr156c] [pn:similarity to multidrug resistance proteins] [gtcfc:12.12.6.13.3] [keggfc:14.2] [sgdfc:7.10.0:11.3.0:17.0.0] [db:gtc-*saccharomyces cerevisiae*] |
| CONTIG4433 | 23728188_f3_4 | 6338 | 20441 | 582 | 194 | YBL061C | 467 | 3.6(10)-44 | *Saccharomyces cerevisiae* | [ui:ybl061c] [pn:protoplast regeneration and killer toxin resistance protein:skt5 protein] [gn:skt5:ybl0506:ybl0519] [gtcfc:12.13] [keggfc:14.2] [sgdfc:1.5.2] [db:gtc-*saccharomyces cerevisiae*] |
| CONTIG1471 | 860932_f3_4 | 6339 | 20442 | 555 | 185 | YCR002C | 95 | 0.00119 | *Saccharomyces cerevisiae* | [ui:ycr002c] [pn:cell division control protein:cell division control protein 10] [gn:cdc10:ycr2c:ycr022] [gtcfc:12.13:12.16:12.8:12.9] [keggfc:14.2] [sgdfc:1.5.2:3.3.0:3.8.0:3.9.0:9.3.0] [db:gtc-*saccharomyces cerevisiae*] |
| CONTIG4404 | 14625325_c2_8 | 6340 | 20443 | 1122 | 374 | YCR002C | 1147 | 1.7(10)-116 | *Saccharomyces cerevisiae* | [ui:ycr002c] [pn:cell division control protein:cell division control protein 10] [gn:cdc10:ycr2c:ycr022] [gtcfc:12.13:12.16:12.8:12.9] [keggfc:14.2] [sgdfc:1.5.2:3.3.0:3.8.0:3.9.0:9.3.0] [db:gtc-*saccharomyces cerevisiae*] |
| CONTIG2588 | 14100915_c3_4 | 6341 | 20444 | 687 | 229 | YCR010C | 262 | 1.0(10)-22 | *Saccharomyces cerevisiae* | [ui:ycr010c] [pn:strong similarity to y. *lipolytica* gpr1 protein and fun34p:hypothetical 30.7 kd protein in rvsl61-adp1 intergenic region] [gn:ycr10c] [gtcfc:12.13] [keggfc:14.2] [sgdfc:1.5.2] [db:gtc-*saccharomyces cerevisiae*] |
| CONTIG2588 | 10603428_c1_3 | 6342 | 20445 | 408 | 136 | YCR010C | 203 | 1.8(10)-16 | *Saccharomyces cerevisiae* | [ui:ycr010c] [pn:strong similarity to y. *lipolytica* gpr1 protein and fun34p:hypothetical 30.7 kd protein in rvsl61-adp1 intergenic region] [gn:ycr10c] [gtcfc:12.13] [keggfc:14.2] [sgdfc:1.5.2] [db:gtc-*saccharomyces cerevisiae*] |
| CONTIG2876 | 20491558_f2_3 | 6343 | 20446 | 330 | 110 | YCR010C | 168 | 1.5(10)-12 | *Saccharomyces cerevisiae* | [ui:ycr010c] [pn:strong similarity to y. *lipolytica* gpr1 protein and fun34p:hypothetical 30.7 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2876 | 4718926_f3_4 | 6344 | 20447 | 192 | 64 | YCR010C | 95 | 0.00024 | Saccharomyces cerevisiae | protein in rvs161-adp1 intergenic region] [gn:ycr10c] [gtcfc:12.13] [keggfc:14.2] [sgdfc:1.5.2] [db:gtc-saccharomyces cerevisiae [ui:ycr010c] [pn:strong similarity to y. lipolytica gpr1 protein and fun34p:hypothetical 30.7 kd |
| CONTIG2876 | 4722625_rn_2 | 6345 | 20448 | 528 | 176 | YCR010C | 207 | 6.9(10)-17 | Saccharomyces cerevisiae | [ui:ycr010c] [pn:strong similarity to y. lipolytica gpr1 protein and fun34p:hypothetical 30.7 kd protein in rvs161-adp1 intergenic region] [gn:ycr10c] [gtcfc:12.13] [keggfc:14.2] [sgdfc:1.5.2] [db:gtc-saccharomyces cerevisiae |
| CONTIG2978 | 4041535_c2_7 | 6346 | 20449 | 927 | 309 | YCR010C | 585 | 6.0(10)-57 | Saccharomyces cerevisiae | [ui:ycr010c] [pn:strong similarity to y. lipolytica gpr1 protein and fun34p:hypothetical 30.7 kd protein in rvs161-adp1 intergenic region] [gn:ycr10c] [gtcfc:12.13] [keggfc:14.2] [sgdfc:1.5.2] [db:gtc-saccharomyces cerevisiae |
| CONTIG3805 | 800962_f2_3 | 6347 | 20450 | 735 | 245 | YCR010C | 477 | t.7(10)-45 | Saccharomyces cerevisiae | [ui:ycr010c] [pn:strong similarity to y. lipolytica gpr1 protein and fun34p:hypothetical 30.7 kd protein in rvs161-adp1 intergenic region] [gn:ycr10c] [gtcfc:12.13] [keggfc:14.2] [sgdfc:1.5.2] [db:gtc-saccharomyces cerevisiae |
| CONTIG450 | 20110302_c2_3 | 6348 | 20451 | 948 | 316 | YCR010C | 682 | 3.2(10)-67 | Saccharomyces cerevisiae | [ui:ycr010c] [pn:strong similarity to y. lipolytica gpr1 protein and fun34p:hypothetical 30.7 kd protein in rvs161-adp1 intergenic region] [gn:ycr10c] [gtcfc:12.13] [keggfc:14.2] [sgdfc:1.5.2] [db:gtc-saccharomyces cerevisiae |
| CONTIG5652 | 33407503_f3_15 | 6349 | 20452 | 963 | 321 | YCR010C | 697 | 8.1(10)-69 | Saccharomyces cerevisiae | [ui:ycr010c] [pn:strong similarity to y. lipolytica gpr1 protein and fun34p:hypothetical 30.7 kd protein in rvs161-adp1 intergenic region] [gn:ycr10c] [gtcfc:12.13] [keggfc:.5.2] [db:gtc-saccharomyces cerevisiae |
| CONTIG1471 | 2362586_f2_3 | 6350 | 20453 | 279 | 93 | YDL225W | 106 | 4.2(10)-5 | Saccharomyces cerevisiae | [ui:ydl225w] [pn:similarity to cdc11p, cdc3p and human cdc10 protein] [gtcfc:12.13;12.8:12.9] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| blx13266.y | 24016950_f1_1 | 6351 | 20454 | 558 | 186 | YDL225W | 283 | 3.1(10)-24 | *Saccharomyces cerevisiae* | [ui:ydl225w] [pn:similarity to cdc11p, cdc3p and human cdc10 protein] [gtcfc:12.13:12.8:12.9] [keggfc:14.2] [sgdfc:1.5.2:3.2.0:3.3.0:3.8.0:3.9.0] [db:gtc-*saccharomyces cerevisiae*] |
| CONTIG4815 | 10833337_f3_4 | 6352 | 20455 | 1611 | 537 | YDL203C | 146 | 6.7(10)-7 | *Saccharomyces cerevisiae* | [ui:ydl203c] [pn:similarity to skt5p] [gtcfc:12.13] [keggfc:14.2] [sgdfc:1.5.2] [db:gtc-*saccharomyces cerevisiae*] |
| CONTIG5450 | 22681442_c3_13 | 6353 | 20456 | 840 | 280 | YDR277C | 142 | 2.2(10)-7 | *Saccharomyces cerevisiae* | [ui:ydr277c] [pn:repressor of hexose transport genes:mth1 protein] [gn:mth1:d9954] [gtcfc:12.13] [keggfc:14.2] [sgdfc:1.5.2] [db:gtc-*saccharomyces cerevisiae*] |
| CONTIG5694 | 24511453_c2_19 | 6354 | 20457 | 2121 | 707 | YGR070W | 136 | 3.2(10)-5 | *Saccharomyces cerevisiae* | [ui:ygr070w] [pn:gdp/gtp exchange protein for rho1p:rho1 gdp-gtp exchange protein 1:protein kinase c suppressor skc1] [gn:rom1:skc1] [gtcfc:12.13:12.8] [keggfc:13.3] [sgdfc:1.5.2:3.2.0:10.2.4] [db:gtc-*saccharomyces cerevisiae*] |
| CONTIG1831 | 6928402_f1_1 | 6355 | 20458 | 336 | 112 | YGR227W | 144 | 9.5(10)-17 | *Saccharomyces cerevisiae* | [ui:ygr227w] [pn:itr1 expression promoting protein:die2 protein] [gn:die2:g8547] [gtcfc:12.13] [keggfc:14.2] [sgdfc:1.5.2] [db:gtc-*saccharomyces cerevisiae*] |
| CONTIG4081 | 14254677_f2_1 | 6356 | 20459 | 786 | 262 | YGR227W | 160 | 2.0(10)-24 | *Saccharomyces cerevisiae* | [ui:ygr227w] [pn:itr1 expression promoting protein:die2 protein] [gn:die2:g8547] [gtcfc:12.13] [keggfc:14.2] [sgdfc:1.5.2] [db:gtc-*saccharomyces cerevisiae*] |
| CONTIG5556 | 29944799_c1_13 | 6357 | 20460 | 945 | 315 | YHR107C | 942 | 9.0(10)-95 | *Saccharomyces cerevisiae* | [ui:yhr107c] [pn:cell division control protein 12:septin] [gn:cdc12:cla10:psl7] [gtcfc:12.13:12.16:12.8:12.9] [keggfc:14.2] [sgdfc:1.5.2:3.2.0:3.3.0:3.8.0:3.9.0: 9.3.0] [db:gtc-*saccharomyces cerevisiae*] |
| CONTIG2842 | 6814032_f3_1 | 6358 | 20461 | 858 | 286 | YHR155W | 102 | 5.0(10)-5 | *Saccharomyces cerevisiae* | [ui:yhr155w] [pn:strong similarity to snf1p-interacting protein sip3p:hypothetical 143.6 kd protein in spo16-rec104 intergenic region] [gtcfc:12.13] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5775 | 9850261_f3_17 | 6359 | 20462 | 1416 | 472 | YIL033C | 711 | 4.5(10)-84 | *Saccharomyces cerevisiae* | [sgdfc:1.5.2] [db:gtc-*saccharomyces cerevisiae*] [ui:yil033c] [pn:camp dependent protein kinase, regulatory subunit:camp-dependent protein kinase regulatory chain] [gn:reg1:bcy1:sra1] [gtcfc:12.13:12.15:13.2] [keggfc:14.2] [sgdfc:1.5.2:3.4.0:9.2.0:11.1.0:15.0.0] [db:gtc-*saccharomyce*] |
| CONTIG2906 | 24022187_f3_3 | 6360 | 20463 | 1263 | 421 | YJR076C | 697 | 8.1(10)-69 | *Saccharomyces cerevisiae* | [ui:yjr076c] [pn:septin:cell division control protein 11] [gn:cdc11:psl19:j1833] [gtcfc:12.13:12.16:12.8:12.9] [keggfc:14.2] [sgdfc:1.5.2:3.2.0:3.3.0:3.8.0:3.9.0: 9.3.0] [db:gtc-*saccharomyces cerevisiae*] |
| CONTIG5020 | 26835776_c3_11 | 6361 | 20464 | 1440 | 480 | YJR076C | 298 | 1.6(10)-26 | *Saccharomyces cerevisiae* | [ui:yjr076c] [pn:septin:cell division control protein 11] [gn:cdc11:psl19:j1833] [gtcfc:12.13:12.16:12.8:12.9] [keggfc:14.2] [sgdfc:1.5.2:3.2.0:3.3.0:3.8.0:3.9.0: 9.3.0] [db:gtc-*saccharomyces cerevisiae*] |
| CONTIG2553 | 4695257_c2_1 | 6362 | 20465 | 780 | 260 | YJR090C | 100 | 0.032 | *Saccharomyces cerevisiae* | [ui:yjr090c] [pn:required for glucose repression and for glucose and cation transport:grr1 protein] [gn:grr1:cot2:cat80:j1885] [gtcfc:12.13:12.2:12.8:13.2] [keggfc:14.2] [sgdfc:1.5.2:3.1.0:3.2.0:8.7.0:11.1.0] [db:gtc-*saccharomyces cer*] |
| CONTIG3400 | 33673152_f3_3 | 6363 | 20466 | 1281 | 427 | YJR090C | 719 | 2.0(10)-70 | *Saccharomyces cerevisiae* | [ui:yjr090c] [pn:required for glucose repression and for glucose and cation transport:grr1 protein] [gn:grr1:cot2:cat80:j1885] [gtcfc:12.13:12.2:12.8:13.2] [keggfc:14.2] [sgdfc:1.5.2:3.1.0:3.2.0:8.7.0:11.1.0] [db:gtc-*saccharomyces cer*] |
| CONTIG3779 | 10631500_c1_6 | 6364 | 20467 | 807 | 269 | YJR090C | 279 | 3.7(10)-23 | *Saccharomyces cerevisiae* | [ui:yjr090c] [pn:required for glucose repression and for glucose and cation transport:grr1 protein] [gn:grr1:cot2:cat80:j1885] [gtcfc:12.13:12.2:12.8:13.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3784 | 159563_c2_4 | 6365 | 20468 | 1458 | 486 | YJR090C | 167 | 6.7(10)-9 | *Saccharomyces cerevisiae* | [keggfc:14.2] [sgdfc:1.5.2:3.1.0:3.2.0:8.7.0:11.1.0] [db:gtc-*saccharomyces cer* [ui:yjr090c] [pn:required for glucose repression and for glucose and cation transport:grr1 protein] [gn:grr1:cot2:cat80;j1885] [gtcfc:12.13:12.2:12.8:13.2] [keggfc:14.2] [sgdfc:1.5.2:3.1.0:3.2.0:8.7.0:11.1.0] [db:gtc-*saccharomyces cer* |
| CONTIG4576 | 14725937_f1_3 | 6366 | 20469 | 444 | 148 | YLR150W | 105 | 1.7(10)-5 | *Saccharomyces cerevisiae* | [ui:ylr150w] [pn:specific affinity for guanine-rich quadruplex nucleic acids:suppressor protein mpt4:stm1 protein:gu4 nucleic-binding protein 2:g4p2 protein] [gn:mpt4:stm1:st01:i9634] [gtcfc:12.13] [keggfc:14.2] [sgdfc:1.5.2] [db:gtc- |
| CONTIG3241 | 14625928_f2_1 | 6367 | 20470 | 1431 | 477 | YLR330W | 517 | 9.8(10)-50 | *Saccharomyces cerevisiae* | [ui:ylr330w] [pn:chitin synthesis protein] [gn:chs5] [gtcfc:11.4:7.2] [keggfc:14.2] [sgdfc:1.5.2:3.2.0:3.3.0] [db:gtc-*saccharomyces cerevisiae*] |
| CONTIG3811 | 4063801_f2_1 | 6368 | 20471 | 1665 | 555 | YLR371W | 313 | 1.1(10)-26 | *Saccharomyces cerevisiae* | [ui:ylr371w] [pn:gdp/gtp exchange factor for rho1p:rho1 gdp-gtp exchange protein 2] [gn:rom2:l8039] [gtcfc:12.13:12.8] [keggfc:14.2] [sgdfc:1.5.2:3.2.0:10.2.4] [db:gtc-*saccharomyces cerevisiae*] |
| CONTIG5358 | 13750326_c1_8 | 6369 | 20472 | 2046 | 682 | YLR371W | 1006 | 1.5(10)-101 | *Saccharomyces cerevisiae* | [ui:ylr371w] [pn:gdp/gtp exchange factor for rho1p:rho1 gdp-gtp exchange protein 2] [gn:rom2:l8039] [gtcfc:12.13:12.8] [keggfc:14.2] [sgdfc:1.5.2:3.2.0:10.2.4] [db:gtc-*saccharomyces cerevisiae*] |
| CONTIG5358 | 25587508_c3_13 | 6370 | 20473 | 549 | 183 | YLR371W | 342 | 9.1(10)-30 | *Saccharomyces cerevisiae* | [ui:ylr371w] [pn:gdp/gtp exchange factor for rho1p:rho1 gdp-gtp exchange protein 2] [gn:rom2:l8039] [gtcfc:12.13:12.8] [keggfc:14.2] [sgdfc:1.5.2:3.2.0:10.2.4] [db:gtc-*saccharomyces cerevisiae*] |
| CONTIG5795 | 24335958_c2_34 | 6371 | 20474 | 420 | 140 | YML048W | 94 | 0.00054 | *Saccharomyces cerevisiae* | [ui:yml048w] [pn:involved in glucose repression] [gn:eff2] [gtcfc:12.13] [keggfc:14.2] [sgdfc:1.5.2] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x10461.y | 21898302_f3_1 | 6372 | 20475 | 696 | 232 | YML048W | 338 | 90(10)-31 | *Saccharomyces cerevisiae* | *saccharomyces cerevisiae* [ui:yml048w] [pn:involved in glucose repression] [gn:eff2] [gtcfc:12.13] [keggfc:14.2] [sgdfc:1.5.2] [db:gtc- |
| CONTIG2086 | 6737932_c1_2 | 6373 | 20476 | 1110 | 370 | YNL257C | 398 | 8.1(10)-36 | *Saccharomyces cerevisiae* | *saccharomyces cerevisiae* [ui:ynl257c] [pn:snf1p protein kinase interacting protein:sip3 protein] [gn:sip3:n0844] [gtcfc:12.13] [keggfc:14.2] [sgdfc:1.5.2] [db:gtc- |
| b3x17312.x | 213252_f1_1 | 6374 | 20477 | 729 | 243 | YNL257C | 215 | 2.7(10)-16 | *Saccharomyces cerevisiae* | *saccharomyces cerevisiae* [ui:ynl257c] [pn:snf1p protein kinase interacting protein:sip3 protein] [gn:sip3:n0844] [gtcfc:12.13] [keggfc:14.2] [sgdfc:1.5.2] [db:gtc- |
| CONTIG2147 | 24414068_c1_2 | 6375 | 20478 | 447 | 149 | YNL201C | 308 | 1.8(10)-26 | *Saccharomyces cerevisiae* | *saccharomyces cerevisiae* [ui:ynl201c] [pn:involved in regulation of carbon metabolism:hypothetical 98.1 kd protein in spx19-gcr2 intergenic region] [gn:n1366] [gtcfc:12.13] [keggfc:14.2] [sgdfc:1.5.2] [db:gtc-*saccharomyces i cerevisiae*] |
| CONTIG3791 | 25594427_f1_1 | 6376 | 20479 | 1212 | 404 | YNL201C | 170 | 3.6(10)-19 | *Saccharomyces cerevisiae* | *saccharomyces cerevisiae* [ui:ynl201c] [pn:involved in regulation of carbon metabolism:hypothetical 98.1 kd protein in spx19-gcr2 intergenic region] [gn:n1366] [gtcfc:12.13] [keggfc:14.2] [sgdfc:1.5.2] [db:gtc-*saccharomyces cerevisiae*] |
| b3x15662.y | 7260150_f1_1 | 6377 | 20480 | 528 | 176 | YNL201C | 283 | 8.6(10)-24 | *Saccharomyces cerevisiae* | *saccharomyces cerevisiae* [ui:ynl201c] [pn:involved in regulation of carbon metabolism:hypothetical 98.1 kd protein in spx19-gcr2 intergenic region] [gn:n1366] [gtcfc:12.13] [keggfc:4.2] [sgdfc:1.5.2] [db:gtc-*saccharomyces cerevisiae*] |
| CONTIG5747 | 10756952_c2_40 | 6378 | 20481 | 564 | 188 | YNL090W | 621 | 9.3(10)-61 | *Saccharomyces cerevisiae* | *saccharomyces cerevisiae* [ui:ynl090w] [pn:gtp-binding protein of the rho subfamily of ras-like proteins:rho2 protein] [gn:rho2:n2237] [gtcfc:12.13:12.16:12.8] [keggfc:14.2] [sgdfc:1.5.2:3.2.0:9.4.0:10.2.3] [db:gtc-*saccharomyces cerevisiae*] |
| CONTIG1952 | 14187550_f2_2 | 6379 | 20482 | 207 | 69 | YNR002C | 130 | 3.1(10)-8 | *Saccharomyces cerevisiae* | [ui:ynr002c] [pn:strong similarity to *y. lipolytica* glyoxylate pathway |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3471 | 6413176_c1_5 | 6380 | 20483 | 876 | 292 | YNR002C | 538 | 5.7(10)-52 | Saccharomyces cerevisiae | regulator gpr1:fun34 protein] [gn:fun34:n2029] [gtcfc:12.13] [keggfc:14.2] [sgdfc:1.5.2] [db:gtc-saccharomyces cerevisiae] [ui:ynr002c] [pn:strong similarity to y. lipolytica glyoxylate pathway regulator gpr1:fun34 protein] [gn:fun34:n2029] [gtcfc:12.13] [keggfc:14.2] [sgdfc:1.5.2] [db:gtc-saccharomyces cerevisiae] |
| CONTIG598 | 14570462_c2_4 | 6381 | 20484 | 768 | 256 | YNR002C | 535 | 1.2(10)-51 | Saccharomyces cerevisiae | [ui:ynr002c] [pn:strong similarity to y. lipolytica glyoxylate pathway regulator gpr1:fun34 protein] [gn:fun34:n2029] [gtcfc:12.13] [keggfc:14.2] [sgdfc:1.5.2] [db:gtc-saccharomyces cerevisiae] |
| CONTIG1152 | 1250000_f3_4 | 6382 | 20485 | 843 | 281 | YOR125C | 691 | 3.6(10)-68 | Saccharomyces cerevisiae | [ui:yor125c] [pn:involved in glucose repression:cat5 protein:ubiquinone biosynthesis protein coq7] [gn:cat5:coq7:o2284:yor3284c] [gtcfc:12.13:9.12] [keggfc:14.2] [sgdfc:1.5.2:1.7.3] [db:gtc-saccharomyces cerevisiae] |
| CONTIG4461 | 6924017_c2_4 | 6383 | 20486 | 1734 | 578 | YPL026C | 259 | 4.0(10)-42 | Saccharomyces cerevisiae | [ui:ypl026c] [pn:suppressor kinase of snf3] [gn:sks1] [gtcfc:12.13] [keggfc:14.2] [sgdfc:1.5.2] [db:gtc-saccharomyces cerevisiae] |
| CONTIG3974 | 1956881_c2_3 | 6384 | 20487 | 858 | 286 | YPL002C | 299 | 1.3(10)-38 | Saccharomyces cerevisiae | [ui:ypl002c] [pn:involved in glucose derepression] [gn:snf8] [gtcfc:12.13] [keggfc:14.2] [sgdfc:1.5.2] [db:gtc-saccharomyces cerevisiae] |
| CONTIG4717 | 34156676_f1_1 | 6385 | 20488 | 606 | 202 | YPR165W | 548 | 5.0(10)-53 | Saccharomyces cerevisiae | [ui:ypr165w] [pn:gtp-binding protein of the rho subfamily of ras-like proteins:rho1 protein] [gn:rho1:p9325] [gtcfc:12.13:12.16:12.8] [keggfc:13.3] [sgdfc:1.5.2:3.2.0:9.4.0:10.2.3] [db:gtc-saccharomyces cerevisiae] |
| CONTIG4819 | 4723132_f1_1 | 6386 | 20489 | 606 | 202 | YPR165W | 737 | 4.7(10)-73 | Saccharomyces cerevisiae | [ui:ypr165w] [pn:gtp-binding protein of the rho subfamily of ras-like proteins:rho1 protein] [gn:rho1:p9325] [gtcfc:12.13:12.16:12.8] [keggfc:13.3] [sgdfc:1.5.2:3.2.0:9.4.0:10.2.3] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4082 | 11022577_f2_1 | 6387 | 20490 | 1239 | 413 | YHL003C | 1089 | 2.3(10)-110 | *Saccharomyces cerevisiae* | [ui:yhl003c] [pn:longevity-assurance protein:longevity-assurance protein 1] [gn:lag1] [gtcfc:12.13:12.8] [keggfc:14.2] [sgdfc:3.10.0:11.5.0] [db:gtc-*saccharomyces cerevisiae*] |
| CONTIG3085 | 34413175_c2_5 | 6388 | 20491 | 1263 | 421 | YIL123W | 1009 | 7.0(10)-102 | *Saccharomyces cerevisiae* | [ui:yil123w] [pn:strong similarity to sun4p, uth1p, nca3p and *c. wickerhamii* beta-glucosidase:hypothetical:48.1 kd protein in kgd1-rpl1 intergenic region] [gtcfc:12.13] [keggfc:14.2] [sgdfc:11.5.0] [db:gtc-*saccharomyces cerevisiae*] |
| CONTIG4489 | 14459376_f1_2 | 6389 | 20492 | 534 | 178 | YIL123W | 235 | 3.5(10)-19 | *Saccharomyces cerevisiae* | [ui:yil123w] [pn:strong similarity to sun4p, uth1p, nca3p and *c. wickerhamii* beta-glucosidase:hypothetical 48.1 kd protein in kgd1-rpl1 intergenic region] [gtcfc:12.13] [keggfc:14.2] [sgdfc:11.5.0] [db:gtc-*saccharomyces cerevisiae*] |
| CONTIG2528 | 395426_f3_1 | 6390 | 20493 | 1302 | 434 | YKL008C | 336 | 1.5(10)-30 | *Saccharomyces cerevisiae* | [ui:ykl008c] [pn:strong similarity to lag1p:hypothetical 49.0 kd protein ufd4-cap1 intergenic region] [gn:ykl156] [gtcfc:12.13] [keggfc:14.2] [sgdfc:11.5.0] [db:gtc-*saccharomyces cerevisiae*] |
| CONTIG5207 | 10198557_f2_3 | 6391 | 20494 | 984 | 328 | YDL025C | 329 | 4.2(10)-29 | *Saccharomyces cerevisiae* | [ui:ydl025c] [pn:ser/thr protein kinase of the dead/deah box family] [gtcfc:14.2] [sgdfc:11.1.0:15.0.0] [db:gtc-*saccharomyces cerevisiae*] |
| CONTIG5780 | 20345001_c2_28 | 6392 | 20495 | 2706 | 902 | YDR466W | 755 | 2.2(10)-78 | *Saccharomyces cerevisiae* | [ui:ydr466w] [pn:similarity ser/thr protein kinase] [gtcfc:12.13:14.3] [keggfc:14.2] [sgdfc:15.0.0:13.0.0] [db:gtc-*saccharomyces cerevisiae*] |
| CONTIG4588 | 4959626_c3_8 | 6393 | 20496 | 810 | 270 | YDR490C | 113 | 0.00084 | *Saccharomyces cerevisiae* | [ui:ydr490c] [pn:similarity to ser/thr protein kinases] [gtcfc:12.13:14.3] [keggfc:14.2] [sgdfc:15.0.0:13.0.0] [db:gtc-*saccharomyces cerevisiae*] |
| CONTIG1369 | 3914057_c3_4 | 6394 | 20497 | 1080 | 360 | YDR507C | 1088 | 3.0(10)-110 | *Saccharomyces cerevisiae* | [ui:ydr507c] [pn:ser/thr-protein kinase] [gn:gin4] [gtcfc:12.13:14.3] [keggfc:14.2] [sgdfc:15.0.0:13.0.9] [db:gtc-*saccharomyces cerevisiae*] |
| CONTIG1896 | 31688383_f1_1 | 6395 | 20498 | 1575 | 525 | YDR507C | 177 | 1.2(10)-20 | *Saccharomyces cerevisiae* | [ui:ydr507c] [pn:ser/thr-protein kinase] [gn:gin4] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2418 | 13930402_c3_4 | 6396 | 20499 | 951 | 317 | YDR507C | 207 | 1.8(10)-15 | Saccharomyces cerevisiae | [ui:ydr507c] [pn:ser/thr-protein kinase] [gn:gin4] [gtcfc:12.13:14.3] [keggfc:14.2] [sgdfc:15.0.0:13.0.9] [db:gtc-saccharomyces cerevisiae] |
| CONTIG1440 | 23600192_f2_1 | 6397 | 20500 | 771 | 257 | YFR014C | 308 | 1.3(10)-27 | Saccharomyces cerevisiae | [ui:yfr014c] [pn:ca2+/calmodulin-dependent ser/thr protein kinase type i:calcium/calmodulin-dependent protein kinase type i] [gn:cmk1] [gtcfc:12.13:12.8I3.1] [ec:2.7.1.123] [keggfc:14.1] [sgdfc:3.1.0:9.2.0:15.0.0] [db:gtc-saccharomyc] |
| CONTIG4006 | 14540907_f1_2 | 6398 | 20501 | 687 | 229 | YGR080W | 153 | 1.3(10)-10 | Saccharomyces cerevisiae | [ui:ygr080w] [pn:weak similarity to human tyrosine kinase a6:hypothetical 37.1 kd protein in pac10-tom20 intergenic region] [gtcfc:12.13:14.3] [keggfc:14.2] [sgdfc:15.0.0:13.0.0] [db:gtc-saccharomyces cerevisiae] |
| CONTIG4006 | 22363752_f3_4 | 6399 | 20502 | 573 | 191 | YGR080W | 148 | 4.9(10)-10 | Saccharomyces cerevisiae | [ui:ygr080w] [pn:weak similarity to human tyrosine kinase a6:hypothetical 37.1 kd protein in pac10-tom20 intergenic region] [gtcfc:12.13:14.3] [keggfc:14.2] [sgdfc:15.0.0:13.0.0] [db:gtc-saccharomyces cerevisiae] |
| CONTIG4652 | 23859655_c3_8 | 6400 | 20503 | 909 | 303 | YGR262C | 336 | 1.5(10)-30 | Saccharomyces cerevisiae | [ui:ygr262c] [pn:weak similarity to protein kinases:hypothetical 29.9 kd protein in apl6-mcs1 intergenic region] [gtcfc:12.13:14.3] [keggfc:14.2] [sgdfc:15.0.0:13.0.0] [db:gtc-saccharomyces cerevisiae] |
| CONTIG5520 | 4093775_f1_3 | 6401 | 20504 | 1263 | 421 | YHR205W | 248 | 1.0(10)-18 | Saccharomyces cerevisiae | [ui:yhr205w] [pn:strong similarity to s. pombe sck1 protein kinase:camp-dependent protein kinase sch9] [gn:sch9:kom1] [gtcfc:12.13:12.8] [ec:2.7.1.37] [keggfc:14.1] [sgdfc:3.8.0:15.0.0] [db:gtc-saccharomyces cerevisiae] |
| CONTIG5520 | 23539062_f1_4 | 6402 | 20505 | 1131 | 377 | YHR205W | 1351 | 4.0(10)-138 | Saccharomyces cerevisiae | [ui:yhr205w] [pn:strong similarity to s. pombe sck1 protein kinase:camp-dependent protein kinase sch9] [gn:sch9:kom1] [gtcfc:12.13:12.8] [ec:2.7.1.37] [keggfc:14.1] [sgdfc:3.8.0:15.0.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5619 | 29782012_c3_20 | 6403 | 20506 | 4140 | 1380 | YJL095W | 1086 | 1.7(10)-137 | Saccharomyces cerevisiae | [db:gtc-saccharomyces cerevisiae] [ui:yjl095w] [pn:ser/thr protein kinase of the mekk family:serine/threonine protein kinase bck1/slk1/ssp31] [gn:bck1:slk1:ssp31:las3:j0906] [gtcfc:12.13.12.8:13.2:14.1] [ec:2.7.--] [keggfc:14.1] [sgdfc:3.1.0:3.2.0:3.8.0:9.2.0:10.2.5: 8 keggfc:14.2] [sgdfc:15.0.0:13.0.0] |
| CONTIG5276 | 23832527_c1_11 | 6404 | 20507 | 972 | 324 | YLR063W | 489 | 9.0(10)-47 | Saccharomyces cerevisiae | [ui:ylr063w] [pn:ser/thr protein kinase] [gtcfc:12.13.14.3] |
| CONTIG1192 | 433325_f2_1 | 6405 | 20508 | 519 | 173 | YMR216C | 281 | 1.1(10)-23 | Saccharomyces cerevisiae | [ui:ymr216c] [pn:similarity to ser/thr protein kinases] [gtcfc:12.13.14.3] [keggfc:14.2] [sgdfc:15.0.0:13.0.0] [db:gtc-saccharomyces cerevisiae] |
| CONTIG4234 | 6837841_f2_1 | 6406 | 20509 | 1731 | 577 | YMR216C | 688 | 4.5(10)-107 | Saccharomyces cerevisiae | [ui:ymr216c] [pn:similarity to ser/thr protein kinases] [gtcfc:12.13.14.3] [keggfc:14.2] [sgdfc:15.0.0:13.0.0] [db:gtc-saccharomyces cerevisiae] |
| b3x16065.y | 12632160_c1_5 | 6407 | 20510 | 186 | 62 | YMR216C | 119 | 2.5(10)-6 | Saccharomyces cerevisiae | [ui:ymr216c] [pn:similarity to ser/thr protein kinases] [gtcfc:12.13.14.3] [keggfc:14.2] [sgdfc:15.0.0:13.0.0] [db:gtc-saccharomyces cerevisiae] |
| CONTIG3370 | 22866412_c1_6 | 6408 | 20511 | 2367 | 789 | YOL100W | 545 | 1.1(10)-51 | Saccharomyces cerevisiae | [ui:yol100w] [pn:similarity to ser/thr protein kinase] [gtcfc:12.13.14.3] [keggfc:14.2] [sgdfc:15.0.0:13.0.0] [db:gtc-saccharomyces cerevisiae] |
| CONTIG3118 | 1178827_c1_1 | 6409 | 20512 | 846 | 282 | YOL045W | 938 | 2.3(10)-94 | Saccharomyces cerevisiae | [ui:yol045w] [pn:similarity to ser/thr protein kinase] [gtcfc:12.13.14.3] [keggfc:14.2] [sgdfc:15.0.0:13.0.0] [db:gtc-saccharomyces cerevisiae] |
| CONTIG64637 | 15819388_f2_1 | 6410 | 20513 | 2799 | 933 | YOL045W | 334 | 2.3(10)-62 | Saccharomyces cerevisiae | [ui:yol045w] [pn:similarity to ser/thr protein kinase] [gtcfc:12.13.14.3] [keggfc:14.2] [sgdfc:15.0.0:13.0.0] [db:gtc-saccharomyces cerevisiae] |
| CONTIG1179 | 547030_f3_1 | 6411 | 20514 | 1086 | 362 | YOL016C | 1065 | 8.3(10)-108 | Saccharomyces cerevisiae | [ui:yol016c] [pn:ca2+/calmodulin-dependent ser/thr protein kinase, type ii:calcium/calmodulin-dependent protein kinase type ii] [gn:cmk2] [gtcfc:12.13.14.1] [sgdfc:5.0.0:13.0.0] [db:gtc-saccharomyces cerevisiae] [ec:2.7.1.123] [keggfc:14.1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2469 | 20343800_f2_1 | 6412 | 20515 | 1458 | 486 | YOR267C | 587 | 3.7(10)-57 | Saccharomyces cerevisiae | [sgdfc:9.2.0:15.0.0] [db:gtc-saccharomyces cerev [ui:yor267c] [pn:similarity to ser/thr protein kinases] [gtcfc:12.13:14.3] [keggfc:14.2] [sgdfc:15.0.0:13.0.0] [db:gtc-saccharomyces cerevisiae] |
| CONTIG3562 | 11797027_f3_4 | 6413 | 20516 | 1401 | 467 | YOR267C | 869 | 4.9(10)-87 | Saccharomyces cerevisiae | [ui:yor267c] [pn:similarity to ser/thr protein kinases] [gtcfc:12.13:14.3] [keggfc:14.2] [sgdfc:15.0.0:13.0.0] [db:gtc-saccharomyces cerevisiae] |
| CONTIG2806 | 10161442_f2_1 | 6414 | 20517 | 858 | 286 | YPL236C | 233 | 1.7(10)-19 | Saccharomyces cerevisiae | [ui:ypl236c] [pn:similarity to s. pombe hypothetical protein spac3h1.13] [gtcfc:12.13:14.1] [keggfc:14.2] [sgdfc:15.0.0:13.1.0] [db:gtc-saccharomyces cerevisiae] |
| CONTIG5023 | 4070138_c2_9 | 6415 | 20518 | 1317 | 439 | YPL203W | 1355 | 1.5(10)-138 | Saccharomyces cerevisiae | [ui:ypl203w] [pn:camp-dependent protein kinase 2, catalytic chain:camp-dependent protein kinase type 2:pka 2] [gn:tpk2:ykr1:pka2] [gtcfc:12.13:12.8] [ec:2.7.1.37] [keggfc:13.1] [sgdfc:9.2.0:15.0.0] [db:gtc-saccharomyces cerevisiae] |
| CONTIG5056 | 488131_f1_4 | 6416 | 20519 | 1212 | 404 | YPL203W | 1302 | 6.4(10)-133 | Saccharomyces cerevisiae | [ui:ypl203w] [pn:camp-dependent protein kinase 2, catalytic chain:camp-dependent protein kinase type 2:pka 2] [gn:tpk2:ykr1:pka2] [gtcfc:12.13:12.8] [ec:2.7.1.37] [keggfc:13.1] [sgdfc:9.2.0:15.0.0] [db:gtc-saccharomyces cerevisiae] |
| CONTIG5114 | 192076_f1_1 | 6417 | 20520 | 2856 | 952 | YPL150W | 695 | 1.3(10)-68 | Saccharomyces cerevisiae | [ui:ypl150w] [pn:similarity to ser/thr kinases] [gtcfc:12.13:14.3] [keggfc:14.2] [sgdfc:15.0.0:13.0.0] [db:gtc-saccharomyces cerevisiae] |
| CONTIG728 | 25976513_c2_2 | 6418 | 20521 | 546 | 182 | YPL141C | 486 | 1.2(10)-45 | Saccharomyces cerevisiae | [ui:ypl141c] [pn:strong similarity to protein kinase kin4p] [gtcfc:12.13:14.3] [keggfc:14.2] [sgdfc:15.0.0:13.0.0] [db:gtc-saccharomyces cerevisiae] |
| CONTIG5628 | 863912_f3_8 | 6419 | 20522 | 2574 | 858 | YAL041W | 853 | 7.0(10)-98 | Saccharomyces cerevisiae | [ui:yal041w] [pn:gtp/gdp exchange factor for cdc42p:cell division control protein 24:calcium regulatory protein] [gn:cdc24:cls4] [gtcfc:12.13:12.8:12.9] [keggfc:13.1:13.3] [sgdfc:3.2.0:3.3.0:3.8.0:9.2.0:10.1. |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4077 | 25835202_c3_7 | 6420 | 20523 | 408 | 136 | YDL135C | 158 | 1.1(10)-11 | Saccharomyces cerevisiae | 3:10.2.4] [db:gtc-saccharo [ui:ydl135c] [pn:rho gdp dissociation inhibitor with activity toward rho1p] [gn:rdi1] [gtcfc:12.13:12.8] [keggfc:14.2] [sgdfc:3.2.0:10.2.4] [db:gtc-saccharomyces cerevisiae] |
| CONTIG4319 | 5273502_c1_8 | 6421 | 20524 | 621 | 207 | YDL135C | 515 | 1.6(10)-49 | Saccharomyces cerevisiae | [ui:ydl135c] [pn:rho gdp dissociation inhibitor with activity toward rho1p] [gn:rdi1] [gtcfc:12.13:12.8] [keggfc:14.2] [sgdfc:3.2.0:10.2.4] [db:gtc-saccharomyces cerevisiae] |
| CONTIG5749 | 24665635_c2_23 | 6422 | 20525 | 600 | 200 | YDL135C | 113 | 4.2(10)-5 | Saccharomyces cerevisiae | [ui:ydl135c] [pn:rho gdp dissociation inhibitor with activity toward rho1p] [gn:rdi1] [gtcfc:12.13:12.8] [keggfc:14.2] [sgdfc:3.2.0:10.2.4] [db:gtc-saccharomyces cerevisiae] |
| CONTIG2879 | 34573406_c1_3 | 6423 | 20526 | 915 | 305 | YPL115C | 295 | 7.0(10)-25 | Saccharomyces cerevisiae | [ui:ypl115c] [pn:gtpase-activating protein for cdc42p and rho1p:protein] [gn:bem3] [gtcfc:12.13:12.8:12.9] [keggfc:13.3] [sgdfc:3.2.0:3.3.0:9.2.0:10.2.4] [db:gtc-saccharomyces cerevisiae] |
| CONTIG3171 | 23626442_c1_4 | 6424 | 20527 | 825 | 275 | YPL115C | 295 | 7.0(10)-25 | Saccharomyces cerevisiae | [ui:ypl115c] [pn:gtpase-activating protein for cdc42p and rho1p:protein] [gn:bem3] [gtcfc:12.13:12.8:12.9] [keggfc:13.3] [sgdfc:3.2.0:3.3.0:9.2.0:10.2.4] [db:gtc-saccharomyces cerevisiae] |
| b9x10d83.y | 29329385_c2_1 | 6425 | 20528 | 453 | 151 | YPL115C | 111 | 3.0(10)-5 | Saccharomyces cerevisiae | [ui:ypl115c] [pn:gtpase-activating protein for cdc42p and rho1p:protein] [gn:bem3] [gtcfc:12.13:12.8:12.9] [keggfc:13.3] [sgdfc:3.2.0:3.3.0:9.2.0:10.2.4] [db:gtc-saccharomyces cerevisiae] |
| CONTIG5809 | 4296926_f1_6 | 6426 | 20529 | 564 | 188 | YBR109C | 470 | 9.3(10)-45 | Saccharomyces cerevisiae | [ui:ybr109c] [pn:calmodulin] [gn:cmd1:ybr0904] [gtcfc:12.13:12.16:12.6:12.8:12.9] [keggfc:14.2] [sgdfc:3.1.0:3.2.0:3.3.0:3.8.0:8.7.0: 9.3.0:10.2.7] [db:gtc-saccharomyces cerevisiae] |
| CONTIG4093 | 19695760_c2_5 | 6427 | 20530 | 924 | 308 | YBR200W | 271 | 1.8(10)-29 | Saccharomyces cerevisiae | [ui:ybr200w] [pn:bud emergence mediator:bem1 protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4093 | 23478436_c2_4 | 6428 | 20531 | 978 | 326 | YBR200W | 370 | 5.4(10)-34 | Saccharomyces cerevisiae | [ui:ybr200w] [pn:bud emergence mediator:bem1 protein] [gn:bem1:sro1:ybr1412] [gtcfc:12.13:12.16:12.8:12.9] [keggfc:13.1] [sgdfc:3.2.0:3.3.0:3.8.0:9.3.0:10.2.7] [db:gtc-saccharomyces cerevisiae] |
| CONTIG2864 | 26386562_c1_5 | 6429 | 20532 | 1113 | 371 | YBR200W | 153 | 2.7(10)-8 | Saccharomyces cerevisiae | [ui:ybr200w] [pn:bud emergence mediator:bem1 protein] [gn:bem1:sro1:ybr1412] [gtcfc:12.13:12.16:12.8:12.9] [keggfc:13.1] [sgdfc:3.2.0:3.3.0:3.8.0:9.3.0:10.2.7] [db:gtc-saccharomyces cerevisiae] |
| CONTIG2881 | 25410625_c3_8 | 6430 | 20533 | 465 | 155 | YOR149C | 100 | 0.0015 | Saccharomyces cerevisiae | [ui:yor149c] [pn:protein kinase c pathway protein:protein] [gn:smp3] [gtcfc:12.13:12.8] [keggfc:14.2] [sgdfc:3.1.0:3.2.0:3.8.0:10.2.7] [db:gtc-saccharomyces cerevisiae] |
| CONTIG2881 | 4334458_c2_7 | 6431 | 20534 | 582 | 194 | YOR149C | 232 | 9.4(10)-19 | Saccharomyces cerevisiae | [ui:yor149c] [pn:protein kinase c pathway protein:protein] [gn:smp3] [gtcfc:12.13:12.8] [keggfc:14.2] [sgdfc:3.1.0:3.2.0:3.8.0:10.2.7] [db:gtc-saccharomyces cerevisiae] |
| CONTIG1696 | 3994012_f1_1 | 6432 | 20535 | 810 | 270 | YPL106C | 927 | 3.5(10)-93 | Saccharomyces cerevisiae | [ui:ypl106c] [pn:heat shock protein of hsp70 family:heat shock protein homolog sse1] [gn:sscl:msi3:lpg3c] [gtcfc:12.7:13.2] [keggfc:14.2] [sgdfc:10.2.7:10.4.8:11.1.0] [db:gtc-saccharomyces cerevisiae] |
| b2x11950.y | 34617300_c1_1 | 6433 | 20536 | 510 | 170 | YDL128W | 354 | 1.8(10)-32 | Saccharomyces cerevisiae | [ui:ydl128w] [pn:ca2+ transport:h+/ca2+ exchange protein, vacuolar] [gn:vcx1] [gtcfc:12.5:12.13:12.16] [keggfc:14.2] [sgdk:1.8.2:7.2.2:8.5.0:9.10.0] [db:gtc-saccharomyces cerevisiae] |
| CONTIG2355 | 2740682_c1_3 | 6434 | 0537 | 1365 | 455 | YGL006W | 699 | 3.3(10)-68 | Saccharomyces cerevisiae | [ui:ygl006w] [pn:ca2+-transporting p-type atpase:calcium-transporting atpase 2:vacuolar ca2+atpase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3119 | 35392812_f2_1 | 6435 | 20538 | 1350 | 450 | YGL006W | 574 | 9.1(10)-79 | Saccharomyces cerevisiae | [ui:ygl006w] [pn:ca2+-transporting p-type atpase:calcium-transporting atpase 2:vacuolar ca2+-atpase] [gn:pca1:pmc1] [gtcfc:12.5:12.13:12.16] [ec:3.6.1.38] [keggfc:14.1] [sgdfc:1.8.2:7.2.2:7.8.0:8.5.0:9.10.0] [db:gtc-saccharomyces cere |
| CONTIG3371 | 9922150_c2_6 | 6436 | 20539 | 225 | 75 | YPL234C | 279 | 1.6(10)-24 | Saccharomyces cerevisiae | [ui:ypl234c] [pn:h+-apase v0 domain 17 kd subunit, vacuolar:proteolipid protein vma1 1] [gn:vma11:tfp3:cls9:p1064] [gtcfc:12.13:12.16:12.5:12.6] [keggfc:14.2] [sgdfc:1.8.2:6.4.0:7.2.2:7.8.0:8.5.0: 9.10.0] [db:gtc-saccharomyces cerevisi |
| CONTIG5387 | 21490702_f3_13 | 6437 | 20540 | 1380 | 460 | YPL066W | 126 | 6.0(10)-5 | Saccharomyces cerevisiae | [ui:ypl066w] [pn:involved in vacuolar traffic] [gn:vps28] [gtcfc:12.13] [keggfc:14.21] [sgdfc:8.5.0] [db:gtc-saccharomyces cerevisiae] |
| CONTIG4730 | 14641882_c1_9 | 6438 | 20541 | 1344 | 448 | YPR173C | 1338 | 1.1(10)-163 | Saccharomyces cerevisiae | [ui:ypr173c] [pn:vacuolar sorting protein:end13 protein] [gn:end13:vps4:grd13:p9705] [gtcfc:12.13:12.16] [keggfc:14.2] [sgdfc:8.5.0:9.10.0] [db:gtc-saccharomyces cerevisiae] |
| b3x13880.x | 32628752_f1_1 | 6439 | 20542 | 264 | 88 | YJR069C | 192 | 2.7(10)-15 | Saccharomyces cerevisiae | [ui:yjr069c] [pn:controls 6-n-hydroxylaminopurine sensitivity and mutagenesis:ham1 protein] [gn:ham1:j18l11] [gtcfc:12.14] [keggfc:14.2] [sgdfc:11.7.0] [db:gtc-saccharomyces cerevisiae] |
| CONTIG4456 | 9960763_c3_8 | 6440 | 20543 | 789 | 263 | YKL110C | 432 | 1.0(10)-53 | Saccharomyces cerevisiae | [ui:ykl110c] [pn:involved in resistance to k.lactis killer toxin:kti12 protein] [gn:kti12:ykl500:ykl446] [gtcfc:12.14] [keggfc:14.2] [sgdfc:11.7.0] [db:gtc-saccharomyces cerevisiae] |
| CONTIG5797 | 23628301_f3_12 | 6441 | 20544 | 1695 | 565 | YAL009W | 384 | 1.2(10)-35 | Saccharomyces cerevisiae | [ui:yal009w] [pn:meiotic protein:sporulation protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5531 | 39038_f2_13 | 6442 | 20545 | 747 | 249 | YBR057C | 128 | 5.0(10)-6 | Saccharomyces cerevisiae | [gn:spo7] [gtcfc:12.15:12.8] [keggfc:14.2] [sgdfc:3.4.0:3.5.0] [db:gtc-saccharomyces cerevisiae] [ui:ybr057c] [pn:meiotic protein:hypothetical 41.4 kd protein in prp6-ubp14 intergenic region] [gn:mum2:ybr0514] [gtcfc:12.15:12.8] [keggfc:14.2] [sgdfc:3.4.0:3.5.0] [db:gtc-saccharomyces cerevisiae] |
| CONTIG1924 | 23560953_c3_4 | 6443 | 20546 | 297 | 99 | YCL048W | 168 | 6.5(10)-12 | Saccharomyces cerevisiae | [ui:ycl048w] [pn:strong similarity to sporulation-specific protein sps2p:hypothetical sps2-like 52.0 kd protein in apa1/dtp-pdi1 intergenic region] [gn:ycl48w] [gtcfc:12.15:12.8] [keggfc:14.2] [sgdfc:3.4.0:3.5.0] [db:gtc-saccharomyces cerevisiae] |
| CONTIG499 | 24406692_f3_1 | 6444 | 20547 | 603 | 201 | YCL048W | 342 | 3.3(10)-31 | Saccharomyces cerevisiae | [ui:ycl048w] [pn:strong similarity to sporulation-specific protein sps2p:hypothetical sps2-like 52.0 kd protein in apa1/dtp-pdi1 intergenic region] [gn:ycl48w] [gtcfc:12.15:12.8] [keggfc:14.2] [sgdfc:3.4.0:3.5.0] [db:gtc-saccharomyces cerevisiae] |
| CONTIG4150 | 30757692_f2_2 | 6445 | 20548 | 1542 | 514 | YDL240W | 341 | 1.1(10)-28 | Saccharomyces cerevisiae | [ui:ydl240w] [pn:gtpase-activating protein of the rho/rac family:protein] [gn:lrg1] [gtcfc:12.15] [keggfc:14.2] [sgdfc:3.4.0] [db:gtc-saccharomyces cerevisiae] |
| CONTIG4150 | 23910752_f3_6 | 6446 | 20549 | 1164 | 388 | YDL240W | 580 | 8.6(10)-63 | Saccharomyces cerevisiae | [ui:ydl240w] [pn:gtpase-activating protein of the rho/rac family:protein] [gn:lrg1] [gtcfc:12.15] [keggfc:14.2] [sgdfc:3.4.0] [db:gtc-saccharomyces cerevisiae] |
| CONTIG4150 | 187761_f2_3 | 6447 | 20550 | 411 | 137 | YDL240W | 92 | 0.0028 | Saccharomyces cerevisiae | [ui:ydl240w] [pn:gtpase-activating protein of the rho/rac family:protein] [gn:lrg1] [gtcfc:12.15] [keggfc:14.2] [sgdfc:3.4.0] [db:gtc-saccharomyces cerevisiae] |
| CONTIG4282 | 10212586_f2_2 | 6448 | 20551 | 903 | 301 | YDR055W | 362 | 2.6(10)-33 | Saccharomyces cerevisiae | [ui:ydr055w] [pn:strong similarity to sps2 protein] [gtcfc:12.15:12.8] [keggfc:14.2] [sgdfc:3.4.0:3.5.0] [db:gtc-saccharomyces cerevisiae] |
| CONTIG5756 | 13835750_f3_11 | 6449 | 20552 | 1239 | 413 | YDR055W | 399 | 3.1(10)-37 | Saccharomyces | [ui:ydr055w] [pn:strong similarity |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | to sps2 protein [gtcfc:12.15:12.8] [keggfc:14.2] [sgdfc:3.4.0:3.5.0] [db:gtc-saccharomyces cerevisiae] |
| CONTIG2124 | 29879577_c3_3 | 6450 | 20553 | 1431 | 477 | YDR108W | 178 | 5.4(10)-19 | Saccharomyces cerevisiae | [ui:ydr108w] [pn:sporulation specific protein:sporulation protein] [gn:gsg1] [gtcfc:12.15:12.8] [keggfc:14.2] [sgdfc:3.4.0:3.5.0] [db:gtc-saccharomyces cerevisiae] |
| CONTIG1087 | 1048281_f1_1 | 6451 | 20554 | 504 | 168 | YDR218C | 215 | 3.8(10)-17 | Saccharomyces cerevisiae | [ui:ydr218c] [pn:septin-related sporulation protein] [gn:spr28] [gtcfc:12.15:12.16:12.8] [keggfc:14.2] [sgdfc:3.4.0:3.5.0:9.3.0] [db:gtc-saccharomyces cerevisiae] |
| CONTIG5162 | 1953125_c2_7 | 6452 | 20555 | 1557 | 519 | YDR403W | 918 | 3.1(10)-92 | Saccharomyces cerevisiae | [ui:ydr403w] [pn:spore wall maturation protein:spore wall maturation protein dit1] [gn:dit1:d9509] [gtcfc:12.15] [keggfc:14.2] [sgdfc:3.4.0] [db:gtc-saccharomyces cerevisiae] |
| CONTIG5776 | 4472215_f1_4 | 6453 | 20556 | 1140 | 380 | YGR059W | 473 | 4.5(10)-45 | Saccharomyces cerevisiae | [ui:ygr059w] [pn:sporulation-specific septin] [gn:spr3] [gtcfc:12.15:12.16] [keggfc:14.2] [sgdfc:3.4.0:9.3.0] [db:gtc-saccharomyces cerevisiae] |
| CONTIG2552 | 34064625_f3_2 | 6454 | 20557 | 627 | 209 | YKL165C | 464 | 3.5(10)-43 | Saccharomyces cerevisiae | [ui:ykl165c] [pn:sporulation protein:hypothetical 105.7 kd protein in tpk3-pir1 intergenic region] [gn:ykl619] [gtcfc:12.15] [keggfc:14.2] [sgdfc:3.4.0] [db:gtc-saccharomyces cerevisiae] |
| CONTIG2552 | 976502_f3_3 | 6455 | 20558 | 270 | 90 | YKL165C | 213 | 3.0(10)-16 | Saccharomyces cerevisiae | [ui:ykl165c] [pn:sporulation protein:hypothetical 105.7 kd protein in tpk3-pir1 intergenic region] [gn:ykl619] [gtcfc:12.15] [keggfc:14.2] [sgdfc:3.4.0] [db:gtc-saccharomyces cerevisiae] |
| CONTIG2870 | 839555_c3_2 | 6456 | 20559 | 852 | 284 | YKL165C | 404 | 1.0(10)-36 | Saccharomyces cerevisiae | [ui:ykl165c] [pn:sporulation protein:hypothetical 105.7 kd protein in tpk3-pir1 intergenic region] [gn:ykl619] [gtcfc:12.15] [keggfc:14.2] [sgdfc:3.4.0] [db:gtc-saccharomyces cerevisiae] |
| CONTIG5472 | 9953437_f2_4 | 6457 | 20560 | 1722 | 574 | YKL165C | 1240 | 2.3(10)-126 | Saccharomyces cerevisiae | [ui:ykl165c] [pn:sporulation protein:hypothetical 105.7 kd protein in tpk3-pir1 intergenic region] [gn:ykl619] [gtcfc:14.21] [sgdfc:3.4.0] [db:gtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3459 | 6281875_f2_2 | 6458 | 20561 | 1311 | 437 | YML115C | 126 | 5.5(10)-5 | *Saccharomyces cerevisiae* | *saccharomyces cerevisiae* [ui:yml115c] [pn:vanadate resistance protein] [gn:van1:vrg7:ym8339] [gtcfc:12.15:12.8] [keggfc:14.2] [sgdfc:3.4.0:3.8.0] [db:gtc-*saccharomyces cerevisiae*] |
| CONTIG5090 | 550678_c3_10 | 6459 | 20562 | 318 | 106 | YML115C | 399 | 3.1(10)-37 | *Saccharomyces cerevisiae* | *saccharomyces cerevisiae* [ui:yml115c] [pn:vanadate resistance protein] [gn:van1:vrg7:ym8339] [gtcfc:12.15:12.8] [keggfc:14.2] [sgdfc:3.4.0:3.8.0] [db:gtc-*saccharomyces cerevisiae*] |
| CONTIG4018 | 6723775_f1_1 | 6460 | 20563 | 933 | 311 | YML110C | 934 | 6.2(10)-94 | *Saccharomyces cerevisiae* | *saccharomyces cerevisiae* [ui:yml110c] [pn:dbf2 interacting protein:hypothetical 34.7 kd protein in ctk3-zds2 intergenic region] [gn:dbi56:ym8339] [gtcfc:12.15] [keggfc:14.2] [db:gtc-*saccharomyces cerevisiae*] |
| CONTIG2174 | 1285131_f1_1 | 6461 | 20564 | 780 | 260 | YMR063W | 119 | 2.3(10)-5 | *Saccharomyces cerevisiae* | *saccharomyces cerevisiae* [ui:ymr063w] [pn:regulator for sporulation and invasive growth] [gn:rim9] [gtcfc:12.15:12.8] [keggfc:14.2] [sgdfc:3.2.0:3.4.0] [db:gtc-*saccharomyces cerevisiae*] |
| CONTIG3791 | 9798180_f1_2 | 6462 | 20565 | 471 | 157 | YNL202W | 319 | 9.4(10)-29 | *Saccharomyces cerevisiae* | *saccharomyces cerevisiae* [ui:ynl202w] [pn:sporulation-specific protein:sporulation-specific protein sps19] [gn:sps19:spx19:n1362] [gtcfc:12.15:12.6:12.8] [sgdfc:3.4.0:3.5.0:9.8.0] [db:gtc-*saccharomyces cerevisiae*] |
| CONTIG3945 | 9922137_c3_5 | 6463 | 20566 | 936 | 312 | YNL202W | 926 | 4.5(10)-93 | *Saccharomyces cerevisiae* | *saccharomyces cerevisiae* [ui:ynl202w] [pn:sporulation-specific protein:sporulation-specific protein sps19] [gn:sps19:spx19:n1362] [gtcfc:12.15:12.6:12.8] [keggfc:14.2] [sgdfc:3.4.0:3.5.0:9.8.0] [db:gtc-*saccharomyces cerevisiae*] |
| CONTIG5353 | 12929652_c3_15 | 6464 | 20567 | 879 | 293 | YNL202W | 881 | 2.6(10)-88 | *Saccharomyces cerevisiae* | *saccharomyces cerevisiae* [ui:ynl202w] [pn:sporulation-specific protein:sporulation-specific protein sps19] [gn:sps19:spx19:n1362] [gtcfc:12.15:12.6:12.8] [keggfc:14.2] [sgdfc:3.4.0:3.5.0:9.8.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5787 | 10548250_c3_37 | 6465 | 20568 | 954 | 318 | YOR313C | 167 | 4.0(10)-12 | *Saccharomyces cerevisiae* | [ui:yor313c] [pn:sporulation-specific protein:sporulation specific protein 4] [gn:sps4:o6120] [gtcfc:12.15] [keggfc:14.2] [sgdfc:3.4.0] [db:gtc-*saccharomyces cerevisiae*] |
| CONTIG1919 | 24391380_f2_3 | 6466 | 20569 | 1167 | 389 | YAL047C | 114 | 0.0014 | *Saccharomyces cerevisiae* | [ui:yal047c] [pn:stu2p interactant:hypothetical 72.1 kd protein in acs1-gcv3 intergenic region] [gn:spi6:fun42] [gtcfc:12.16] [keggfc:14.2] [sgdfc:9.3.0] [db:gtc-*saccharomyces cerevisiae*] |
| CONTIG4316 | 10625306_c3_9 | 6467 | 20570 | 705 | 235 | YAL047C | 96 | 0.041 | *Saccharomyces cerevisiae* | [ui:yal047c] [pn:stu2p interactant:hypothetical 72.1 kd protein in acs1-gcv3 intergenic region] [gn:spi6:fun42] [gtcfc:12.16] [keggfc:14.2] [sgdfc:9.3.0] [db:gtc-*saccharomyces cerevisiae*] |
| CONTIG713 | 2222013_c2_3 | 6468 | 20571 | 429 | 143 | YAL020C | 201 | 5.4(10)-16 | *Saccharomyces cerevisiae* | [ui:yal020c] [pn:alpha-tubulin suppressor:ats1 protein:alpha-tubulin supressor 1] [gn:ats1:yal006:fun28] [gtcfc:12.16] [keggfc:14.2] [sgdfc:9.3.0] [db:gtc-*saccharomyces cerevisiae*] |
| b9x13524.x | 24319792_c2_6 | 6469 | 20572 | 318 | 106 | YAL020C | 109 | 9.3(10)-6 | *Saccharomyces cerevisiae* | [ui:yal020c] [pn:alpha-tubulin suppressor:ats1 protein:alpha-tubulin supressor 1] [gn:ats1:yal006:fun28] [gtcfc:12.16] [keggfc:14.2] [sgdfc:9.3.0] [db:gtc-*saccharomyces cerevisiae*] |
| CONTIG4778 | 36456301_c3_8 | 6470 | 20573 | 3078 | 1026 | YBL034C | 212 | 5.4(10)-13 | *Saccharomyces cerevisiae* | [ui:ybl034c] [pn:mitotic spindle protein:mitotic spindle protein stu1] [gn:stu1:ybl0416] [gtcfc:12.16] [keggfc:14.2] [sgdfc:9.3.0] [db:gtc-*saccharomyces cerevisiae*] |
| CONTIG4097 | 32675441_f1_1 | 6471 | 20574 | 2652 | 884 | YBL007C | 617 | 1.3(10)-115 | *Saccharomyces cerevisiae* | [ui:ybl007c] [pn:cytoskeleton assembly control protein:cytoskeleton assembly control protein sla1] [gn:sla1:ybl0321] [gtcfc:12.16.12.8] [keggfc:14.2] [sgdfc:3.1.0:6.4.0:9.3.0] [db:gtc-*saccharomyces cerevisiae*] |
| CONTIG3731 | 21660187_c1_12 | 6472 | 20575 | 1113 | 371 | YBL007C | 99 | 0.078 | *Saccharomyces* | [ui:ybl007c] [pn:cytoskeleton |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | assembly control protein:cytoskeleton assembly control protein sla1 [gn:sla1:ybl0321] [gtcfc:12.16:12.8] [keggfc:14.2] [sgdfc:3.1.0:6.4.0:9.3.0] [db:gtc-saccharomyces cerevisiae] |
| b1x16816.x | 110301_c3_2 | 6473 | 20576 | 345 | 115 | YBL007C | 279 | 4.2(10)-23 | Saccharomyces cerevisiae | [ui:yb1007c] [pn:cytoskeleton assembly control protein:cytoskeleton assembly control protein sla1 [gn:sla1:ybl0321] [gtcfc:12.16:12.8] [keggfc:14.2] [sgdfc:3.1.0:6.4.0:9.3.0] [db:gtc-saccharomyces cerevisiae] |
| CONTIG5011 | 10833254_c2_9 | 6474 | 20577 | 822 | 274 | YBL007C | 124 | 1.2(10)-7 | Saccharomyces cerevisiae | [ui:yb1007c] [pn:cytoskeleton assembly control protein:cytoskeleton assembly control protein sla1 [gn:sla1:ybl0321] [gtcfc:12.16:12.8] [keggfc:14.2] [sgdfc:3.1.0:6.4.0:9.3.0] [db:gtc-saccharomyces cerevisiae] |
| CONTIG2549 | 3181267_c3_5 | 6475 | 20578 | 1257 | 419 | YBR130C | 94 | 0.11 | Saccharomyces cerevisiae | [ui:ybr130c] [pn:required for mother cell-specific expression of ho:hypothetical 47.4 kd protein in vma2-cks1 intergenic region] [gn:she3:ybr1005] [gtcfc:12.16] [keggfc:14.2] [sgdfc:9.3.0] [db:gtc-saccharomyces cerevisiae] |
| CONTIG4178 | 14881552_f2_5 | 6476 | 20579 | 309 | 103 | YBR130C | 123 | 4.2(10)-7 | Saccharomyces cerevisiae | [ui:ybr130c] [pn:required for mother cell-specific expression of ho:hypothetical 47.4 kd protein in vma2-cks1 intergenic region] [gn:she3:ybr1005] [gtcfc:12.16] [keggfc:14.2] [sgdfc:9.3.0] [db:gtc-saccharomyces cerevisiae] |
| CONTIG4178 | 24391051_f3_7 | 6477 | 20580 | 1152 | 384 | YBR130C | 96 | 0.055 | Saccharomyces cerevisiae | [ui:ybr130c] [pn:required for mother cell-specific expression of ho:hypothetical 47.4 kd protein in vma2-cks1 intergenic region] [gn:she3:ybr1005] [gtcfc:12.16] [keggfc:14.2] [sgdfc:9.3.0] [db:gtc-saccharomyces cerevisiae] |
| CONTIG5321 | 2345083_c1_21 | 6478 | 20581 | 1482 | 494 | YBR130C | 103 | 0.017 | Saccharomyces cerevisiae | [ui:ybr130c] [pn:required for mother cell-specific expression of ho:hypothetical 47.4 kd protein in vma2-cks1 intergenic region] [gn:she3:ybr1005] [gtcfc:12.16] [keggfc:14.2] [sgdfc:9.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2094 | 26682963_f1_1 | 6479 | 20582 | 1284 | 428 | YBR172C | 101 | 0.03599 | Saccharomyces cerevisiae | [keggfc:14.2] [sgdfc:9.3.0] [db:gtc-saccharomyces cerevisiae] [ui:ybr172c] [pn:kinesin-related protein] [gn:smy2:ybr1233] [gtcfc:12.16] [keggfc:14.2] [sgdfc:9.3.0] [db:gtc-saccharomyces cerevisiae] |
| CONTIG5571 | 35957706_f3_16 | 6480 | 20583 | 1920 | 640 | YBR172C | 221 | 7.7(10)-15 | Saccharomyces cerevisiae | [ui:ybr172c] [pn:kinesin-related protein] [gn:smy2:ybr1233] [gtcfc:12.16] [keggfc:14.2] [sgdfc:9.3.0] [db:gtc-saccharomyces cerevisiae] |
| CONTIG2508 | 20426386_f2_1 | 6481 | 20584 | 1071 | 357 | YCR009C | 218 | 1.5(10)-33 | Saccharomyces cerevisiae | [ui:ycr009c] [pn:similarity to human amphiphysin and rvs167p:reduced viability upon starvation protein 161] [gn:rvs161:spe161:ycr9c] [gtcfc:12.16.612.8] [keggfc:14.2] [sgdfc:3.2.0:8.7.0:9.3.0] [db:gtc-saccharomyces cerevisiae] |
| CONTIG4424 | 13010953_f3_4 | 6482 | 20585 | 1395 | 465 | YCR088W | 136 | 2.7(10)-15 | Saccharomyces cerevisiae | [ui:ycr088w] [pn:actin-binding protein:abp1:ycr88w] [gtcfc:12.16.12.8] [keggfc:14.2] [sgdfc:3.1.0:3.2.0:9.3.0] [db:gtc-saccharomyces cerevisiae] |
| CONTIG5731 | 21879562_f2_10 | 6483 | 20586 | 363 | 121 | YCR088W | 226 | 5.7(10)-18 | Saccharomyces cerevisiae | [ui:ycr088w] [pn:actin-binding protein:abp1:ycr88w] [gtcfc:12.16.12.8] [keggfc:14.2] [sgdfc:3.1.0:3.2.0:9.3.0] [db:gtc-saccharomyces cerevisiae] |
| CONTIG5733 | 2773275_f2_8 | 6484 | 20587 | 876 | 292 | YCR088W | 119 | 0.00011 | Saccharomyces cerevisiae | [ui:ycr088w] [pn:actin-binding protein:abp1:ycr88w] [gtcfc:12.16.12.8] [keggfc:14.2] [sgdfc:3.1.0:3.2.0:9.3.0] [db:gtc-saccharomyces cerevisiae] |
| CONTIG5061 | 15628377_c3_13 | 6485 | 20588 | 837 | 279 | YDL178W | 646 | 2.1(10)-63 | Saccharomyces cerevisiae | [ui:ydl178w] [pn:actin interacting protein 2] [gn:aip2] [gtcfc:12.16] [keggfc:14.2] [sgdfc:9.3.0] [db:gtc-saccharomyces cerevisiae] |
| CONTIG5541 | 34100078_c3_21 | 6486 | 20589 | 393 | 131 | YDL178W | 284 | 2.1(10)-24 | Saccharomyces cerevisiae | [ui:ydl178w] [pn:actin interacting protein 2] [gn:aip2] [gtcfc:12.16] [keggfc:14.2] [sgdfc:9.3.0] [db:gtc-saccharomyces cerevisiae] |
| CONTIG5587 | 30272567_f2_5 | 6487 | 20590 | 816 | 272 | YDR085C | 96 | 0.069 | Saccharomyces cerevisiae | [ui:ydr085c] [pn:involved in morphogenesis of the mating |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | projection:afr1 protein] [gn:afr1:d4471] [gtcfc:12.16:12.8:12.9] [keggfc:14.2] [sgdfc:3.2.0:3.3.0:9.3.0] [db:gtc-saccharomyces cerevisiae] |
| CONTIG1278 | 25390933_f3_3 | 6488 | 20591 | 555 | 185 | YDR388W | 127 | 1.8(10)-7 | Saccharomyces cerevisiae | [ui:ydr388w] [pn:reduced viability upon starvation protein:reduced viability upon starvation protein 167] [gn:rvs167:d9509] [gtcfc:12.16:12.8] [keggfc:14.2] [sgdfc:3.2.0:9.3.0] [db:gtc-saccharomyces cerevisiae] |
| CONTIG4621 | 10040878_c2_5 | 6489 | 20592 | 1068 | 356 | YDR388W | 129 | 1.8(10)-5 | Saccharomyces cerevisiae | [ui:ydr388w] [pn:reduced viability upon starvation protein:reduced viability upon starvation protein 167] [gn:rvs167:d9509] [gtcfc:12.16:12.8] [keggfc:14.2] [sgdfc:3.2.0:9.3.0] [db:gtc-saccharomyces cerevisiae] |
| CONTIG5180 | 24398876_c3_15 | 6490 | 20593 | 1440 | 480 | YDR388W | 1148 | 1.3(10)-116 | Saccharomyces cerevisiae | [ui:ydr388w] [pn:reduced viability upon starvation protein:reduced viability upon starvation protein 167] [gn:rvs167:d9509] [gtcfc:12.16:12.8] [keggfc:14.2] [sgdfc:3.2.0:9.3.0] [db:gtc-saccharomyces cerevisiae] |
| b9x10802.x | 188410_f2_1 | 6491 | 20594 | 210 | 70 | YDR388W | 122 | 6.7(10)-7 | Saccharomyces cerevisiae | [ui:ydr388w] [pn:reduced viability upon starvation protein:reduced viability upon starvation protein 167] [gn:rvs167:d9509] [gtcfc:12.16:12.8] [keggfc:14.2] [sgdfc:3.2.0:9.3.0] [db:gtc-saccharomyces cerevisiae] |
| CONTIG3405 | 6350826_f2_3 | 6492 | 20595 | 1020 | 340 | YDR389W | 290 | 1.3(10)-32 | Saccharomyces cerevisiae | [ui:ydr389w] [pn:suppressor of actin mutation:protein] [gn:sac7] [gtcfc:12.16] [keggfc:14.2] [sgdfc:6.4.0:9.3.0] [db:gtc-saccharomyces cerevisiae] |
| CONTIG3884 | 10192052_f1_1 | 6493 | 20596 | 849 | 283 | YDR389W | 147 | 4.9(10)-8 | Saccharomyces cerevisiae | [ui:ydr389w] [pn:suppressor of actin mutation:protein] [gn:sac7] [gtcfc:12.16] [keggfc:14.2] [sgdfc:6.4.0:9.3.0] [db:gtc-saccharomyces cerevisiae] |
| CONTIG5417 | 503288_c3_20 | 6494 | 20597 | 684 | 228 | YDR484W | 137 | 7.4(10)-7 | Saccharomyces cerevisiae | [ui:ydr484w] [pn:suppressor of actin mutation:protein] [gtcfc:12.16] [keggfc:14.2] [sgdfc:9.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3725 | 10032590_c1_4 | 6495 | 20598 | 903 | 301 | YER007W | 188 | 1.7(10)-12 | *Saccharomyces cerevisiae* | [ui:yer007w] [pn:required in the absence of cin8p;protein] [gn:pac2] [gtcfc:12.16] [keggfc:14.2] [sgdfc:9.3.0] [db:gtc-saccharomyces cerevisiae] |
| CONTIG2273 | 2910900_c2_7 | 6496 | 20599 | 975 | 325 | YER016W | 371 | 1.8(10)-40 | *Saccharomyces cerevisiae* | [ui:yer016w] [pn:binding to microtubules;hypothetical 38.4 kd protein in faa2-afg3 intergenic region] [gn:bim1] [gtcfc:12.16] [keggfc:14.2] [sgdfc:9.3.0] [db:gtc-saccharomyces cerevisiae] |
| CONTIG3189 | 21883561_f3_2 | 6497 | 20600 | 960 | 320 | YFL037W | 1371 | 3.1(10)-140 | *Saccharomyces cerevisiae* | [ui:yfl037w] [pn:beta-tubulin;tubulin beta chain] [gn:tub2] [gtcfc:12.16.12.8] [keggfc:14.2] [sgdfc:3.5.0:3.8.0:9.3.0] [db:gtc-saccharomyces cerevisiae] |
| CONTIG1599 | 19956502_c2_3 | 6498 | 20601 | 1101 | 367 | YGL216W | 397 | 4.0(10)-36 | *Saccharomyces cerevisiae* | [ui:ygl216w] [pn:similarity to mouse kinesin-related protein kif3;putative kinesin-like protein ygl216w] [gtcfc:12.16] [keggfc:14.2] [sgdfc:8.0.9.3.0] [db:gtc-saccharomyces cerevisiae] |
| CONTIG3758 | 23630067_f1_1 | 6499 | 20602 | 2148 | 716 | YGL216W | 477 | 8.0(10)-45 | *Saccharomyces cerevisiae* | [ui:ygl216w] [pn:similarity to mouse kinesin-related protein kif3;putative kinesin-like protein ygl216w] [gtcfc:12.16] [keggfc:14.2] [sgdfc:8.0.9.3.0] [db:gtc-saccharomyces cerevisiae] |
| CONTIG5733 | 9766885_f1_2 | 6500 | 20603 | 987 | 329 | YGL116W | 142 | 5.2(10)-7 | *Saccharomyces cerevisiae* | [ui:ygl116w] [pn:cell division control protein;cell division control protein 20] [gn:cdc20] [gtcfc:12.16.12.8] [keggfc:14.2] [sgdfc:3.8.0:9.3.0] [db:gtc-saccharomyces cerevisiae] |
| CONTIG5733 | 2241512_f2_7 | 6501 | 20604 | 609 | 203 | YGL116W | 228 | 3.7(10)-18 | *Saccharomyces cerevisiae* | [ui:ygl116w] [pn:cell division control protein;cell division control protein 20] [gn:cdc20] [gtcfc:12.16.12.8] [keggfc:14.2] [sgdfc:3.8.0:9.3.0] [db:gtc-saccharomyces cerevisiae] |
| CONTIG585 | 1191505_f1_1 | 6502 | 20605 | 1053 | 351 | YGL116W | 632 | 6.4(10)-62 | *Saccharomyces cerevisiae* | [ui:ygl116w] [pn:cell division control protein;cell division control protein 20] [gn:cdc20] [gtcfc:12.16.12.8] [keggfc:14.2] [sgdfc:3.8.0:9.3.0] [db:gtc-saccharomyces cerevisiae] |
| b9x13158.x | 960191_c2_1 | 6503 | 20606 | 492 | 164 | YGL116W | 151 | 7.2(10)-10 | *Saccharomyces cerevisiae* | [ui:ygl116w] [pn:cell division control protein;cell division control protein 20] [gn:cdc20] [gtcfc:12.16.12.8] [keggfc:14.2] [sgdfc:3.8.0:9.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5814 | 25445930_f2_9 | 6504 | 20607 | 1242 | 414 | YGL003C | 472 | 7.0(10)-55 | *Saccharomyces cerevisiae* | protein 20] [gn:cdc20] [gtcfc:12.16:12.8] [keggfc:14.2] [sgdfc:3.8:0:9.3.0] [db:gtc-*saccharomyces cerevisiae*] [ui:ygl003c] [pn:similarity to cdc20p and human p55cdc:hypothetical trp-asp repeats containing protein in pmc1-tfg2 intergenic region] [gtcfc:12.16:12.8] [keggfc:14.2] [sgdfc:3.8:0:9.3.0] [db:gtc-*saccharomyces cerevisiae*] |
| CONTIG5814 | 5275063_f1_1 | 6505 | 20608 | 588 | 196 | YGL003C | 595 | 5.2(10)-58 | *Saccharomyces cerevisiae* | [ui:ygl003c] [pn:similarity to cdc20p and human p55cdc:hypothetical trp-asp repeats containing protein in pmc1-tfg2 intergenic region] [gtcfc:12.16:12.8] [keggfc:14.2] [sgdfc:3.8:0:9.3.0] [db:gtc-*saccharomyces cerevisiae*] |
| CONTIG5521 | 23539626_c1_24 | 6506 | 20609 | 546 | 182 | YGR078C | 452 | 7.5(10)-43 | *Saccharomyces cerevisiae* | [ui:ygr078c] [pn:required in the absence of cin8p:protein] [gn:pac10] [gtcfc:12.16.12.8] [keggfc:14.2] [sgdfc:3.8.0:9.3.0] [db:gtc-*saccharomyces cerevisiae*] |
| CONTIG4045 | 13866715_c3_10 | 6507 | 20610 | 834 | 278 | YHR023W | 94 | 0.28 | *Saccharomyces cerevisiae* | [ui:yhr023w] [pn:type ii myosin heavy chain:myosin-1 isoform:type ii myosin] [gn:myo1] [gtcfc:12.16:12.8] [keggfc:14.2] [sgdfc:3.2.0:3.9.0:9.3.0] [db:gtc-*saccharomyces cerevisiae*] |
| CONTIG4494 | 4773286_f2_3 | 6508 | 20611 | 1419 | 473 | YHR023W | 129 | 0.00018 | *Saccharomyces cerevisiae* | [ui:yhr023w] [pn:type ii myosin heavy chain:myosin-1 isoform:type ii myosin] [gn:myo1] [gtcfc:12.16:12.8] [keggfc:14.2] [sgdfc:3.2.0:3.9.0:9.3.0] [db:gtc-*saccharomyces cerevisiae*] |
| CONTIG4627 | 978506_c2_3 | 6509 | 20612 | 2592 | 864 | YHR023W | 1731 | 2.2(10)-178 | *Saccharomyces cerevisiae* | [ui:yhr023w] [pn:type ii myosin heavy chain:myosin-1 isoform:type ii myosin] [gn:myo1] [gtcfc:12.16:12.8] [keggfc:14.2] [sgdfc:3.2.0:3.9.0:9.3.0] [db:gtc-*saccharomyces cerevisiae*] |
| CONTIG5325 | 12673188_f2_4 | 6510 | 20613 | 2169 | 723 | YHR023W | 228 | 6.0(10)-18 | *Saccharomyces cerevisiae* | [ui:yhr023w] [pn:type ii myosin heavy chain:myosin-1 isoform:type ii myosin] [gn:myo1] [gtcfc:12.16:12.8] [keggfc:14.2] [sgdfc:3.2.0:3.9.0:9.3.0] [db:gtc-*saccharomyces cerevisiae*] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5335 | 20391000_f3_5 | 6511 | 20614 | 1884 | 628 | YHR023W | 135 | 6.0(10)-5 | Saccharomyces cerevisiae | [ui:yhr023w] [pn:type ii myosin heavy chain:myosin-1 isoform:type ii myosin] [gn:myo1] [gtcfc:12.16.12.8] [keggfc:14.2] [sgdfc:3.2.0:3.9.0:9.3.0] [db:gtc-saccharomyces cerevisiae] |
| b9x13n32.x | 11767285_f3_1 | 6512 | 20615 | 492 | 164 | YHR023W | 93 | 0.05299 | Saccharomyces cerevisiae | [ui:yhr023w] [pn:type ii myosin heavy chain:myosin-1 isoform:type ii myosin] [gn:myo1] [gtcfc:12.16.12.8] [keggfc:14.2] [sgdfc:3.2.0:3.9.0:9.3.0] [db:gtc-saccharomyces cerevisiae] |
| CONTIG3220 | 10656511_c3_6 | 6513 | 20616 | 648 | 216 | YIL034C | 556 | 7.2(10)-54 | Saccharomyces cerevisiae | [ui:yil034c] [pn:f-actin capping protein, beta subunit:f-actin capping protein beta subunit] [gn:cap2] [gtcfc:12.16.12.8:12.9] [keggfc:14.2] [sgdfc:3.2.0:3.3.0:9.3.0] [db:gtc-saccharomyces cerevisiae] |
| CONTIG4003 | 12538962_f1_1 | 6514 | 20617 | 1941 | 647 | YJL042W | 529 | 4.0(10)-53 | Saccharomyces cerevisiae | [ui:yjl042] [pn:microtubule-associated protein:map-homologous protein 1] [gn:mhp1:j1206] [gtcfc:12.16] [keggfc:14.2] [sgdfc:9.3.0] [db:gtc-saccharomyces cerevisiae] |
| CONTIG5634 | 2116682_f2_7 | 6515 | 20618 | 2085 | 695 | YJL042W | 469 | 5.7(10)-42 | Saccharomyces cerevisiae | [ui:yjl042] [pn:microtubule-associated protein:map-homologous protein 1] [gn:mhp1:j1206] [gtcfc:12.16] [keggfc:14.2] [sgdfc:9.3.0] [db:gtc-saccharomyces cerevisiae] |
| CONTIG5230 | 3906252_c1_15 | 6516 | 20619 | 1095 | 365 | YJR065C | 1112 | 2.5(10)-125 | Saccharomyces cerevisiae | [ui:yjr065c] [pn:actin related protein:actin-like protein act4] [gn:arp3:act4:j1760] [gtcfc:12.16] [keggfc:14.2] [sgdfc:9.3.0] [db:gtc-saccharomyces cerevisiae] |
| CONTIG1877 | 308_f3_6 | 6517 | 20620 | 606 | 202 | YJR134C | 110 | 2.2(10)-5 | Saccharomyces cerevisiae | [ui:yjr134c] [pn:similarity to paramyosin, myosin:hypothetical 81.2 kd protein in nmd5-hom6 intergenic region] [gn:j2120] [gtcfc:12.16] [keggfc:14.2] [sgdfc:9.3.0] [db:gtc-saccharomyces cerevisiae] |
| CONTIG4822 | 11837806_c2_13 | 6518 | 20621 | 564 | 188 | YJR134C | 96 | 0.029 | Saccharomyces cerevisiae | [ui:yjr134c] [pn:similarity to paramyosin, myosin:hypothetical 81.2 kd protein in nmd5-hom6 intergenic region] [gn:j2120] [gtcfc:12.16] [keggfc:14.2] [sgdfc:9.3.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2827 | 15801_c2_5 | 6519 | 20622 | 636 | 212 | YKL179C | 391 | 9.8(10)-36 | *Saccharomyces cerevisiae* | [ui:ykl179c] [pn:similarity to nuf1p:hypothetical 77.5 kd protein in prp1-ste3 intergenic region] [gtcfc:12.16.12.8] [keggfc:14.2] [sgdfc:3.8.0:9.3.0] [db:gtc-*saccharomyces cerevisiae*] |
| b9x11927.x | 22776681_f3_2 | 6520 | 20623 | 411 | 137 | YKL179C | 176 | 1.8(10)-12 | *Saccharomyces cerevisiae* | [ui:ykl179c] [pn:similarity to nuf1p:hypothetical 77.5 kd protein in prp1-ste3 intergenic region] [gtcfc:12.16.12.8] [keggfc:14.2] [sgdfc:3.8.0:9.3.0] [db:gtc-*saccharomyces cerevisiae*] |
| CONTIG5295 | 33407052_f1_1 | 6521 | 20624 | 1017 | 339 | YKL079W | 107 | 0.00579 | *Saccharomyces cerevisiae* | [ui:ykl079w] [pn:kinesin-related protein:kinesin-related protein smy1:suppressor protein smy1] [gn:smy1:ykl409] [gtcfc:12.16.12.8] [keggfc:14.2] [sgdfc:3.2.0:9.3.0] [db:gtc-*saccharomyces cerevisiae*] |
| b2x17273.x | 13959792_f3_1 | 6522 | 20625 | 525 | 175 | YKL079W | 192 | 3.2(10)-14 | *Saccharomyces cerevisiae* | [ui:ykl079w] [pn:kinesin-related protein:kinesin-related protein smy1:suppressor protein smy1] [gn:smy1:ykl409] [gtcfc:12.16.12.8] [keggfc:14.2] [sgdfc:3.2.0:9.3.0] [db:gtc-*saccharomyces cerevisiae*] |
| CONTIG4510 | 1257680_c2_3 | 6523 | 20626 | 771 | 257 | YKL007W | 321 | 5.7(10)-29 | *Saccharomyces cerevisiae* | [ui:ykl007w] [pn:f-actin capping protein alpha subunit] [gn:cap1:ykl155] [gtcfc:12.16.12.8]2.9] [keggfc:14.2] [gdfc:3.2.0:3.3.0:9.3.0] [db:gtc-*saccharomyces cerevisiae*] |
| CONTIG4813 | 10984801_f1_3 | 6524 | 20627 | 441 | 147 | YLL050C | 552 | 1.8(10)-53 | *Saccharomyces cerevisiae* | [ui:yll050c] [pn:cofilin, actin binding and severing protein:cofilin] [gn:cof1] [gtcfc:12.16.12.8] [keggfc:14.2] [sgdfc:3.2.0:9.3.0] [db:gtc-*saccharomyces cerevisiae*] |
| CONTIG5622 | 1173287_c3_18 | 6525 | 20628 | 2949 | 983 | YLL021W | 521 | 6.5(10)-54 | *Saccharomyces cerevisiae* | [ui:yll021w] [pn:involved in cell polarity:spa2 protein] [gn:spa2:pea1:11209] [gtcfc:12.16.12.8]2.9] [keggfc:14.2] [sgdfc:3.2.0:3.3.0:9.3.0] [db:gtc-*saccharomyces cerevisiae*] |
| CONTIG5622 | 4084632_c2_16 | 6526 | 20629 | 1515 | 505 | YLL021W | 339 | 7.2(10)-34 | *Saccharomyces cerevisiae* | [ui:yll021w] [pn:involved in cell polarity:spa2 protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1715 | 1259628_c3_9 | 6527 | 20630 | 183 | 61 | YLL001W | 214 | 1.8(10)-16 | Saccharomyces cerevisiae | [gn:spa2:pea1:11209] [gtcfc:12.16:12.8:12.9] [keggfc:14.2] [sgdfc:3.2.0:3.3.0:9.3.0] [db:gtc-saccharomyces cerevisiae] [ui:yll001w] [pn:dynamin-related protein:dynamin-related protein dnm1] [gn:dnm1:11381] [gtcfc:12.16.12.6] [keggfc:14.2] [sgdfc:8.7.0:9.3.0] [db:gtc-saccharomyces cerevisiae] |
| CONTIG3452 | 23613381_f1_1 | 6528 | 20631 | 498 | 166 | YLL001W | 466 | 9.3(10)-44 | Saccharomyces cerevisiae | [ui:yll001w] [pn:dynamin-related protein:dynamin-related protein dnm1] [gn:dnm1:11381] [gtcfc:12.16.12.6] [keggfc:14.2] [sgdfc:8.7.0:9.3.0] [db:gtc-saccharomyces cerevisiae] |
| CONTIG3452 | 26345338_f1_2 | 6529 | 20632 | 807 | 269 | YLL001W | 327 | 1.2(10)-28 | Saccharomyces cerevisiae | [ui:yll001w] [pn:dynamin-related protein:dynamin-related protein dnm1] [gn:dnm1:11381] [gtcfc:12.16.12.6] [keggfc:14.2] [sgdfc:8.7.0:9.3.0] [db:gtc-saccharomyces cerevisiae] |
| b9x11d54.y | 1196938_c1_2 | 6530 | 20633 | 762 | 254 | YLL001W | 814 | 3.2(10)-81 | Saccharomyces cerevisiae | [ui:yll001w] [pn:dynamin-related protein:dynamin-related protein dnm1] [gn:dnm1:11381] [gtcfc:12.16.12.6] [keggfc:14.2] [sgdfc:8.7.0:9.3.0] [db:gtc-saccharomyces cerevisiae] |
| CONTIG2156 | 24256265_c1_3 | 6531 | 20634 | 951 | 317 | YLR045C | 208 | 2.7(10)-29 | Saccharomyces cerevisiae | [ui:ylr045c] [pn:suppressor of a cs tubulin mutation:suppressor of tubulin stu2] [gn:stu2:12108] [gtcfc:12.16] [keggfc:14.2] [sgdfc:9.3.0] [db:gtc-saccharomyces cerevisiae] |
| CONTIG3576 | 2907812_c2_6 | 6532 | 20635 | 1164 | 388 | YLR085C | 314 | 5.9(10)-51 | Saccharomyces cerevisiae | [ui:ylr085c] [pn:actin-related protein] [gn:arp6] [gtcfc:12.16] [keggfc:14.2] [sgdfc:9.3.0] [db:gtc-saccharomyces cerevisiae] |
| CONTIG4625 | 4197192_c3_8 | 6533 | 20636 | 333 | 111 | YLR314C | 284 | 1.8(10)-24 | Saccharomyces cerevisiae | [ui:ylr314c] [pn:cell division control protein:cell division control protein 3] [gn:cdc3:18543] [gtcfc:12.16:12.8:12.9] [keggfc:14.2] [sgdfc:3.2.0:3.3.0:3.8.0:3.9.0:9.3.0] [db:gtc-saccharomyces cerevisiae] |
| CONTIG2878 | 473526_c3_5 | 6534 | 20637 | 1230 | 410 | YLR319C | 244 | 2.0(10)-49 | Saccharomyces cerevisiae | [ui:ylr319c] [pn:bud site selection protein:bud site selection protein bud6:actin interacting protein 3] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG949 | 4183150_c1_5 | 6535 | 20638 | 732 | 244 | YLR319C | 439 | 1.0(10)-40 | Saccharomyces cerevisiae | [gn:bud6:aip3:18543] [gtcfc:12.16.12.8] [keggfc:14.2] [gdfc:3.2.0:9.3.0] [db:gtc-saccharomyces cerevisiae] [ui:ylr319c] [pn:bud site selection protein:bud site selection protein bud6:actin interacting protein 3] [gn:bud6:aip3:18543] [gtcfc:12.16.12.8] [keggfc:14.2] [sgdfc:3.2.0:9.3.0] [db:gtc-saccharomyces cerevisiae] |
| CONTIG4214 | 22037713_f2_4 | 6536 | 20639 | 855 | 285 | YLR337W | 170 | 1.0(10)-11 | Saccharomyces cerevisiae | [ui:ylr337w] [pn:verprolin] [gn:vrp1] [gtcfc:12.16.12.6:12.8] [keggfc:14.2] [sgdfc:3.1.0:3.2.0:8.7.0:9.3.0] [db:gtc-saccharomyces cerevisiae] |
| CONTIG5761 | 898500_f3_16 | 6537 | 20640 | 294 | 98 | YLR337W | 125 | 6.5(10)-7 | Saccharomyces cerevisiae | [ui:ylr337w] [pn:verprolin] [gn:vrp1] [gtcfc:12.16.12.6:12.8] [keggfc:14.2] [sgdfc:3.1.0:3.2.0:8.7.0:9.3.0] [db:gtc-saccharomyces cerevisiae] |
| CONTIG5403 | 34642778_f1_2 | 6538 | 20641 | 1950 | 650 | YLR429W | 94 | 0.35999 | Saccharomyces cerevisiae | [ui:ylr429w] [pn:similarity to actin binding protein coronin] [gtcfc:12.16] [keggfc:14.2] [sgdfc:9.3.0] [db:gtc-saccharomyces cerevisiae] |
| CONTIG5759 | 957936_c1_17 | 6539 | 20642 | 1515 | 505 | YLR429W | 1505 | 2.0(10)-154 | Saccharomyces cerevisiae | [ui:ylr429w] [pn:similarity to actin binding protein coronin] [gtcfc:12.16] [keggfc:14.2] [sgdfc:9.3.0] [db:gtc-saccharomyces cerevisiae] |
| CONTIG5739 | 24804528_c3_33 | 6540 | 20643 | 1182 | 394 | YML104C | 392 | 1.7(10)-36 | Saccharomyces cerevisiae | [ui:yml104c] [pn:intermediate filament protein:structural protein mdm1] [gn:mdm1:ym8339] [gtcfc:12.16.12.8] [keggfc:14.2] [sgdfc:3.8.0:9.3.0] [db:gtc-saccharomyces cerevisiae] |
| b3x14621.y | 21955093_f1_1 | 6541 | 20644 | 528 | 176 | YML085C | 647 | 1.6(10)-63 | Saccharomyces cerevisiae | [ui:yml085c] [pn:alpha-1 tubulin:tubulin alpha-1 chain] [gn:tub1] [gtcfc:12.16] [keggfc:14.2] [sgdfc:9.3.0] [db:gtc-saccharomyces cerevisiae] |
| CONTIG5543 | 4772652_c3_19 | 6542 | 20645 | 1359 | 453 | YMR033W | 389 | 3.6(10)-36 | Saccharomyces cerevisiae | [ui:ymr033w] [pn:actin-related protein] [gn:arp9] [gtcfc:12.16] [keggfc:14.2] [sgdfc:9.3.0] [db:gtc-saccharomyces cerevisiae] |
| CONTIG4982 | 22298162_f1_4 | 6543 | 20646 | 1863 | 621 | YMR092C | 914 | 8.3(10)-92 | Saccharomyces cerevisiae | [ui:ymr092c] [pn:actin cytoskeleton component:actin interacting protein 1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3926 | 5897562_f2_2 | 6544 | 20647 | 1413 | 471 | YMR109W | 1572 | 1.6(10)-161 | *Saccharomyces cerevisiae* | [gn:aip1:ym9582] [gtcfc:12.16] [keggfc:14.2] [sgdfc:9.3.0] [db:gtc-*saccharomyces cerevisiae*] [ui:ymr109w] [pn:myosin i] [gn:myo5] [gtcfc:12.16:12.8] [keggfc:14.2] [sgdfc:3.2.0:9.3.0] [db:gtc-*saccharomyces cerevisiae*] |
| CONTIG5038 | 15727137_c3_7 | 6545 | 20648 | 612 | 204 | YMR109W | 104 | 0.00018 | *Saccharomyces cerevisiae* | [ui:ymr109w] [pn:myosin i] [gn:myo5] [gtcfc:12.16:12.8] [keggfc:14.2] [sgdfc:3.2.0:9.3.0] [db:gtc-*saccharomyces cerevisiae*] |
| b1x19775.y | 5319525_f3_2 | 6546 | 20649 | 474 | 158 | YMR109W | 303 | 1.1(10)-25 | *Saccharomyces cerevisiae* | [ui:ymr109w] [pn:myosin i] [gn:myo5] [gtcfc:12.16:12.8] [keggfc:14.2] [sgdfc:3.2.0:9.3.0] [db:gtc-*saccharomyces cerevisiae*] |
| CONTIG1080 | 34408180_c3_5 | 6547 | 20650 | 423 | 141 | YMR138W | 200 | 3.7(10)-16 | *Saccharomyces cerevisiae* | [ui:ymr138w] [pn:gtp-binding protein:gtp-binding protein cin4] [gn:cin4:gtp1:ugx1:ym9375] [gtcfc:12.16:12.8] [keggfc:14.2] [sgdfc:3.8.0:9.3.0] [db:gtc-*saccharomyces cerevisiae*] |
| CONTIG3524 | 34236641_f2_1 | 6548 | 20651 | 1980 | 660 | YNL271C | 420 | 9.0(10)-50 | *Saccharomyces cerevisiae* | [ui:ynl271c] [pn:budding protein:bni1 protein:synthetic lethal 39] [gn:bni1:she5:n0646] [gtcfc:12.16:12.8] [keggfc:14.2] [sgdfc:3.2.0:9.3.0] [db:gtc-*saccharomyces cerevisiae*] |
| CONTIG4299 | 11760912_c1_3 | 6549 | 20652 | 1815 | 605 | YNL271C | 1201 | 3.1(10)-121 | *Saccharomyces cerevisiae* | [ui:ynl271c] [pn:budding protein:bni1 protein:synthetic lethal 39] [gn:bni1:she5:n0646] [gtcfc:12.16:12.8] [keggfc:14.2] [sgdfc:3.2.0:9.3.0] [db:gtc-*saccharomyces cerevisiae*] |
| CONTIG5680 | 10795577_c3_46 | 6550 | 20653 | 699 | 233 | YNL271C | 219 | 1.8(10)-16 | *Saccharomyces cerevisiae* | [ui:ynl271c] [pn:budding protein:bni1 protein:synthetic lethal 39] [gn:bni1:she5:n0646] [gtcfc:12.16:12.8] [keggfc:14.2] [sgdfc:3.2.0:9.3.0] [db:gtc-*saccharomyces cerevisiae*] |
| CONTIG5680 | 12890627_c3_45 | 6551 | 20654 | 3873 | 1291 | YNL271C | 687 | 4.4(10)-78 | *Saccharomyces cerevisiae* | [ui:ynl271c] [pn:budding protein:bni1 protein:synthetic lethal 39] [gn:bni1:she5:n0646] [gtcfc:12.16:12.8] [keggfc:14.2] [sgdfc:3.2.0:9.3.0] [db:gtc-*saccharomyces cerevisiae*] |
| CONTIG4986 | 36522702_c3_11 | 6552 | 20655 | 1002 | 334 | YLN243W | 439 | 2.0(10)-40 | *Saccharomyces cerevisiae* | [ui:ynl243w] [pn:cytoskeleton assembly control protein:sla2 protein:transmembrane protein mop2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4986 | 20509442_c2_9 | 6553 | 20656 | 2001 | 667 | YNL243W | 377 | 3.3(10)-58 | Saccharomyces cerevisiae | [gn:sla2:end4:mop2:ufg1:n1102] [gtcfc:12.16.12.6.12.8.12.9] [keggfc:14.2] [sgdfc:3.2.0:3.3.0:6.4.0:8.7.0:9.3.0] [db:gtc-saccharomyces cere [ui:ynl243w] [pn:cytoskeleton assembly control protein:sla2 protein:transmembrane protein mop2] |
| CONTIG5691 | 23605000_c3_32 | 6554 | 20657 | 1746 | 582 | YNL138W | 1039 | 4.7(10)-105 | Saccharomyces cerevisiae | [gn:sla2:end4:mop2:ufg1:n1102] [gtcfc:12.16.12.6.12.8.12.9] [keggfc:14.2] [sgdfc:3.2.0:3.3.0:6.4.0:8.7.0:9.3.0] [db:gtc-saccharomyces cere [ui:ynl138w] [pn:adenylate cyclase-associated protein, 70 kda:adenylyl cyclase-associated protein:cap] [gn:srv2:cap1:nl210:n1838] [gtcfc:12.16.12.8] [keggfc:14.2] [sgdfc:3.1.0:3.2.0:9.3.0] [db:gtc-saccharomyces cerevisiae] |
| CONTIG5591 | 13828377_f3_8 | 6555 | 20658 | 1227 | 409 | YNL084C | 473 | 1.8(10)-52 | Saccharomyces cerevisiae | [ui:ynl084c] [pn:required for endocytosis and cytoskeletal organization:end3 protein] [gn:end3:n2307] [gtcfc:12.16.12.6.12.8.12.9] [keggfc:14.2] [sgdfc:3.2.0:3.3.0:8.7.0:9.3.0] [db:gtc-saccharomyces cerevisiae] |
| CONTIG2630 | 7062807_f3_3 | 6556 | 20659 | 1137 | 379 | YNL079C | 181 | 1.3(10)-13 | Saccharomyces cerevisiae | [ui:ynl079c] [pn:tropomyosin 1] [gn:tpm1:n2332] [gtcfc:12.16.12.8.12.9] [keggfc:14.2] [sgdfc:3.1.0:3.2.0:3.3.0:9.3.0] [db:gtc-saccharomyces cerevisiae] |
| CONTIG3587 | 24017307_f2_2 | 6557 | 20660 | 987 | 329 | YNL079C | 92 | 0.029 | Saccharomyces cerevisiae | [ui:ynl079c] [pn:tropomyosin 1] [gn:tpm1:n2332] [gtcfc:12.16.12.8.12.9] [keggfc:14.2] [sgdfc:3.1.0:3.2.0:3.3.0:9.3.0] [db:gtc-saccharomyces cerevisiae] |
| CONTIG5652 | 14657183_f3_13 | 6558 | 20661 | 390 | 130 | YNL079C | 96 | 8.1(10)-5 | Saccharomyces cerevisiae | [ui:ynl079c] [pn:tropomyosin 1] [gn:tpm1:n2332] [gtcfc:12.16.12.8.12.9] [keggfc:14.2] [sgdfc:3.1.0:3.2.0:3.3.0:9.3.0] [db:gtc-saccharomyces cerevisiae] |
| CONTIG4290 | 33785677_c3_11 | 6559 | 20662 | 420 | 140 | YOR122C | 492 | 4.4(10)-47 | Saccharomyces cerevisiae | [ui:yor122c] [pri:profilin] [gn:pfy1:pfy:prf1:o3275:yor3275c] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1543 | 16579002_c3_2 | 6560 | 20663 | 984 | 328 | YOR141C | 494 | 1.7(10)-46 | *Saccharomyces cerevisiae* | [gtcfc:12.16:12.8] [keggfc:14.2] [sgdfc:3.2.0:9.3.0] [dbgtc-*saccharomyces cerevisiae*] [ui:yor141c] [pn:actin-related protein] [gn:arp8] [gtcfc:12.16] [keggfc:14.2] [sgdfc:9.3.0] [dbgtc-*saccharomyces cerevisiae*] |
| b3x14418.y | 10119075_c1_6 | 6561 | 20664 | 789 | 263 | YOR141C | 149 | 2.0(10)-9 | *Saccharomyces cerevisiae* | [ui:yor141c] [pn:actin-related protein] [gn:arp8] [gtcfc:12.16] [keggfc:14.2] [sgdfc:9.3.0] [dbgtc-*saccharomyces cerevisiae*] |
| CONTIG2891 | 798311_c3_6 | 6562 | 20665 | 573 | 191 | YOR156C | 104 | 0.005 | *Saccharomyces cerevisiae* | [ui:yol156c] [pn:interacts with cdc12p in 2-hybrid assay] [gn:nfi1] [gtcfc:12.16:12.8] [keggfc:14.2] [sgdfc:3.2.0:3.8.0:3.9.0:9.3.0] [dbgtc-*saccharomyces cerevisiae*] |
| b9x13h02.x | 31879280_f3_1 | 6563 | 20666 | 495 | 165 | YOR156C | 179 | 9.3(10)-13 | *Saccharomyces cerevisiae* | [ui:yor156c] [pn:interacts with cdc12p in 2-hybrid assay] [gn:nfi1] [gtcfc:12.16:12.8] [keggfc:14.2] [sgdfc:3.2.0:3.8.0:3.9.0:9.3.0] [dbgtc-*saccharomyces cerevisiae*] |
| CONTIG2589 | 10172691_f3_2 | 6564 | 20667 | 1563 | 521 | YOR349W | 147 | 3.7(10)-16 | *Saccharomyces cerevisiae* | [ui:yor349w] [pn:chromosome segregation protein:cin1 protein] [gn:cin1:o6350] [gtcfc:12.16:12.8] [keggfc:14.2] [sgdfc:3.8.0:9.3.0] [dbgtc-*saccharomyces cerevisiae*] |
| CONTIG5212 | 4725882_f3_10 | 6565 | 20668 | 594 | 198 | YOR367W | 170 | 5.7(10)-13 | *Saccharomyces cerevisiae* | [ui:yor367w] [pn:similarity to mammalian smooth muscle protein sm22] [gtcfc:12.16] [keggfc:14.2] [sgdfc:9.3.0] [dbgtc-*saccharomyces cerevisiae*] |
| CONTIG5571 | 24406687_f2_10 | 6566 | 20669 | 1212 | 404 | YPL105C | 105 | 0.01499 | *Saccharomyces cerevisiae* | [ui:ypl105c] [pn:similarity to smy2p] [gtcfc:12.16] [keggfc:14.2] [sgdfc:9.3.0] [dbgtc-*saccharomyces cerevisiae*] |
| CONTIG4430 | 4351557_c1_6 | 6567 | 20670 | 810 | 270 | YPR034W | 290 | 2.7(10)-25 | *Saccharomyces cerevisiae* | [ui:ypr034w] [pn:similarity to actins] [gn:arp7] [gtcfc:12.16] [keggfc:14.2] [sgdfc:9.3.0] [dbgtc-*saccharomyces cerevisiae*] |
| b2x16596.x | 471041_f3_1 | 6568 | 20671 | 651 | 217 | YAL058W | 327 | 2.2(10)-29 | *Saccharomyces cerevisiae* | [ui:yal058w] [pn:similarity to calnexins:calnexin homolog precursor] [gn:cne1:fun48] [gtcfc:12.16] [keggfc:14.2] [sgdfc:9.4.0] [dbgtc-*saccharomyces cerevisiae*] |
| CONTIG4324 | 10586087_f1_2 | 6569 | 20672 | 768 | 256 | YBL102W | 257 | 3.5(10)-22 | *Saccharomyces cerevisiae* | [ui:ybl102w] [pn:suppressor of sed5 ts mutants:sft2 protein] [gn:sft2:yb10812] [gtcfc:12.16] [keggfc:14.2] [sgdfc:9.4.0] [dbgtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5516 | 2112580_f2_4 | 6570 | 20673 | 351 | 117 | YBL102W | 138 | 1.3(10)-9 | Saccharomyces cerevisiae | saccharomyces cerevisiae [ui:ybl102w] [pn:suppressor of sed5 ts mutants:sft2 protein] [gn:sft2;ybl0812] [gtcfc:12.16] [keggfc:14.2] [sgdfc:9.4.0] [db:gtc-saccharomyces cerevisiae] |
| CONTIG5516 | 16679015_f1_1 | 6571 | 20674 | 342 | 114 | YBL102W | 116 | 5.2(10)-7 | Saccharomyces cerevisiae | saccharomyces cerevisiae [ui:ybl102w] [pn:suppressor of sed5 ts mutants:sft2 protein] [gn:sft2;ybl0812] [gtcfc:12.16] [keggfc:14.2] [sgdfc:9.4.0] [db:gtc-saccharomyces cerevisiae] |
| CONTIG2210 | 33759380_c2_5 | 6572 | 20675 | 510 | 170 | YDR297W | 531 | 3.2(10)-51 | Saccharomyces cerevisiae | saccharomyces cerevisiae [ui:ydr297w] [pn:suppressor of rvs161 and rvs167 mutations:sur2 protein:syringomycin response protein 2] [gn:sur2;syr2;d9740] [gtcfc:12.16.12.8] [keggfc:14.2] [sgdfc:3.2.0.9.4.0] [db:gtc-saccharomyces cerevisiae] |
| CONTIG5308 | 4329537_f1_3 | 6573 | 20676 | 765 | 255 | YEL036C | 908 | 3.6(10)-91 | Saccharomyces cerevisiae | saccharomyces cerevisiae [ui:yel036c] [pn:protein of the endoplasmatic reticulum:aminonitrophenyl propanediol resistance protein] [gn:anp1;gem3;sygp-orf28] [gtcfc:12.16] [keggfc:14.2] [sgdfc:9.4.0] [db:gtc-saccharomyces cerevisiae] |
| CONTIG4573 | 15631461_f1_5 | 6574 | 20677 | 306 | 102 | YGR105W | 192 | 2.7(10)-15 | Saccharomyces cerevisiae | saccharomyces cerevisiae [ui:ygr105w] [pn:atpase assembly integral membrane protein, vacuolar:vacuolar atpase assembly integral membrane protein] [gn:vma21] [gtcfc:12.16] [keggfc:14.2] [sgdfc:6.4.0.9.4.0] [db:gtc-saccharomyces cerevisiae] |
| CONTIG4999 | 4332936_c1_8 | 6575 | 20678 | 579 | 193 | YKL065C | 176 | 1.3(10)-13 | Saccharomyces cerevisiae | saccharomyces cerevisiae [ui:ykl065c] [pn:yeast endoplasmic reticulum 25 kda transmembrane protein:hypothetical 23.4 kd protein in nup100-msn4 intergenic region] [gn:yet1;ykl331] [gtcfc:12.16] [keggfc:14.2] [sgdfc:9.4.0] [db:gtc-saccharomyces cerevisiae] |
| CONTIG5673 | 33765927_f1_4 | 6576 | 20679 | 723 | 241 | YKL065C | 136 | 5.2(10)-8 | Saccharomyces cerevisiae | saccharomyces cerevisiae [ui:ykl065c] [pn:yeast endoplasmic reticulum 25 kda transmembrane protein:hypothetical 23.4 kd protein in nup100-msn4 intergenic region] [gn:yet1;ykl331] [gtcfc:12.16] [keggfc:14.2] [sgdfc:9.4.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4257 | 22460061_f2_1 | 6577 | 20680 | 972 | 324 | YLR220W | 674 | 2.2(10)-66 | Saccharomyces cerevisiae | [ui:ylr220w] [pn:involved in calcium regulation:ccc1 protein] [gn:ccc1.18083] [gtcfc:12.16:12.6] [keggfc:14.2] [sgdfc:1.8.2:9.4.0] [db:gtc-saccharomyces cerevisiae] |
| CONTIG3782 | 23439035_c1_3 | 6578 | 20681 | 1236 | 412 | YDR080W | 418 | 3.8(10)-38 | Saccharomyces cerevisiae | [ui:ydr080w] [pn:required for the vacuolar assembly:hypothetical 113.4 kd protein in sed1-pdc2 intergenic region] [gn:vam2:d44446] [gtcfc:12.16] [keggfc:14.2] [sgdfc:6.4.0:9.10.0] [db:gtc-saccharomyces cerevisiae] |
| CONTIG5593 | 23484375_f3_11 | 6579 | 20682 | 663 | 221 | YDR080W | 404 | 1.2(10)-36 | Saccharomyces cerevisiae | [ui:ydr080w] [pn:required for the vacuolar assembly:hypothetical 113.4 kd protein in sed1-pdc2 intergenic region) [gn:vam2:d44446] [gtcfc:12.16] [keggfc:14.2] [sgdfc:6.4.0:9.10.0] [db:gtc-saccharomyces cerevisiae] |
| CONTIG2592 | 14540931_f1_2 | 6580 | 20683 | 897 | 299 | YGL212W | 173 | 2.2(10)-11 | Saccharomyces cerevisiae | [ui:ygl212w] [pn:vacuolar morphogenesis protein:protein] [gn:vam7] [gtcfc:12.16] [keggfc:14.2] [sgdfc:9.10.0] [db:gtc-saccharomyces cerevisiae] |
| CONTIG5635 | 801000_f3_9 | 6581 | 20684 | 861 | 287 | YGL212W | 114 | 0.00021 | Saccharomyces cerevisiae | [ui:ygl212w] [pn:vacuolar morphogenesis protein:protein] [gn:vam7] [gtcfc:12.16] [keggfc:14.2] [sgdfc:9.10.0] [db:gtc-saccharomyces cerevisiae] |
| CONTIG2568 | 4022782_c3_3 | 6582 | 20685 | 636 | 212 | YHR026W | 582 | 1.3(10)-56 | Saccharomyces cerevisiae | [ui:yhr026w] [pn:h+atpase 23 kd subunit, vacuolar:proteolipid protein] [gn:vma16:ppa1] [gtcfc:12.16.12.5:12.6] [keggfc:14.2] [sgdfc:7.2.2:7.8.0:9.10.0] [db:gtc-saccharomyces cerevisiae] |
| CONTIG4735 | 16423305_c3_9 | 6583 | 20686 | 675 | 225 | YKL119C | 194 | 1.6(10)-15 | Saccharomyces cerevisiae | [ui:ykl119c] [pn:h+atpase assembly protein, vacuolar:vacuolar atpase assembly integral membrane protein vma12:protein vph2] [gn:vma12:vph2:cls10:ykl520] [gtcfc:12.16] [keggfc:14.2] [sgdfc:6.4.0:9.10.0] [db:gtc-saccharomyces cerevisiae] |
| CONTIG1187 | 9853437_f3_3 | 6584 | 20687 | 714 | 238 | YMR231W | 222 | 1.3(10)-33 | Saccharomyces cerevisiae | [ui:ymr231w] [pn:vacuolar biogenesis protein:vacuolar biogenesis protein end1:pep5 protein] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1517 | 26444458_c3_1 | 6585 | 20688 | 828 | 276 | YMR231W | 233 | 7.2(10)-23 | Saccharomyces cerevisiae | [gn:end1:pep5:vps11:ym9959] [gtcfc:12.16.12.6] [keggfc:14.2] [sgdfc:8.7.0:9.10.0] [db:gtc-saccharomyces cerevisiae] [ui:ymr231w] [pn:vacuolar biogenesis protein:vacuolar biogenesis protein end1:pep5 protein] [gn:end1:pep5:vps11:ym9959] [gtcfc:12.16.12.6] [keggfc:14.2] [sgdfc:8.7.0:9.10.0] [db:gtc-saccharomyces cerevisiae] |
| CONTIG2609 | 915643_c2_3 | 6586 | 20689 | 534 | 178 | YER060W | 330 | 1.5(10)-29 | Saccharomyces cerevisiae | [ui:yer060w] [pn:purine-cytosine permease:hypothetical 58.1 kd protein in pet117-cem1 intergenic region] [gn:fcy21:fcyy] [gtcfc:12.16.12.3:12.6] [keggfc:14.2] [sgdfc:1.3.7:7.6.0:8.8.0:17.0.0] [db:gtc-saccharomyces cerevisiae] |
| CONTIG2609 | 1213556_c3_4 | 6587 | 20690 | 702 | 234 | YER060W-A | 499 | 7.9(10)-48 | Saccharomyces cerevisiae | [ui:yer060w-a] [pn:strong similarity to fcy2p] [gn:fcy22] [gtcfc:12.16.12.3:12.6] [keggfc:14.2] [sgdfc:1.3.7:7.6.0:8.8.0:17.0.0] [db:gtc-saccharomyces cerevisiae] |
| CONTIG2609 | 3441570 2_c1_2 | 6588 | 20691 | 414 | 138 | YER060W-A | 194 | 1.3(10)-14 | Saccharomyces cerevisiae | [ui:yer060w-a] [pn:strong similarity to fcy2p] [gn:fcy22] [gtcfc:12.16.12.3:12.6] [keggfc:14.2] [sgdfc:1.3.7:7.6.0:8.8.0:17.0.0] [db:gtc-saccharomyces cerevisiae] |
| CONTIG3872 | 4863500_f3_5 | 6589 | 20692 | 981 | 327 | YOR100C | 126 | 1.5(10)-5 | Saccharomyces cerevisiae | [ui:yor100c] [pn:similarity to mitochondrial carrier protein ymc1] [gtcfc:12.16] [keggfc:14.2] [sgdfc:8.8.0] [db:gtc-saccharomyces cerevisiae] |
| CONTIG4420 | 24037512_c2_7 | 6590 | 20693 | 876 | 292 | YOR100C | 747 | 4.0(10)-74 | Saccharomyces cerevisiae | [ui:yor100c] [pn:similarity to mitochondrial carrier protein ymc1] [gtcfc:12.16] [keggfc:14.2] [sgdfc:8.8.0] [db:gtc-saccharomyces cerevisiae] |
| CONTIG1621 | 24485906_f3_1 | 6591 | 20694 | 723 | 241 | YBL037W | 356 | 5.5(10)-34 | Saccharomyces cerevisiae | [ui:ybl037w] [pn:alpha-adaptin, large subunit of the clathrin-associated protein:ap complex:alpha-adaptin homolog in ura7-pol12 intergenic region] [gn:apl3:ybl0412] [gtcfc:12.16.12.6] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4408 | 12191910_c3_10 | 6592 | 20695 | 756 | 252 | YBL037W | 185 | 3.3(10)-13 | Saccharomyces cerevisiae | [sgdfc:6.4.0:8.7.0] [db:gtc-saccharo [ui:ybl037w] [pn:alpha-adaptin, large subunit of the clathrin-associated protein:ap complex:alpha-adaptin homolog in ura7-pol12 intergenic region] [gn:ap13:ybl0412] [gtcfc:12.16.12.6] [keggfc:14.2] [sgdfc:6.4.0:8.7.0] [db:gtc-saccharo |
| CONTIG2516 | 4706642_c2_2 | 6593 | 20696 | 954 | 318 | YDR162C | 182 | 3.1(10)-14 | Saccharomyces cerevisiae | [ui:ydl162c] [pn:nap1p-binding protein] [gn:nbp2] [gtcfc:12.16 keggfc:14.2] [sgdfc:6.4.0] [db:gtc-saccharomyces cerevisiae] |
| CONTIG3342 | 23453211_f1_2 | 6594 | 20697 | 885 | 295 | YDR265W | 369 | 4.7(10)-34 | Saccharomyces cerevisiae | [ui:ydr265w] [pn:peroxisomal assembly protein] [gn:pas4] [gtcfc:12.16.12.6] [keggfc:14.2] [sgdfc:6.4.0:9.8.0] [db:gtc-saccharomyces cerevisiae] |
| CONTIG5372 | 484675_c2_14 | 6595 | 20698 | 2115 | 705 | YGR261C | 490 | 1.6(10)-49 | Saccharomyces cerevisiae | [ui:ygr261c] [pn:beta-adaptin, large subunit of the clathrin-associated protein:ap complex:probable beta-adaptin:clathrin assembly protein large beta chain:clathrin assembly protein complex 2 beta large chain] [gn:ap16:ykss5:g9331] [gtc |
| CONTIG5670 | 13790932_f1_3 | 6596 | 20699 | 2028 | 676 | YHR161C | 447 | 2.2(10)-46 | Saccharomyces cerevisiae | [ui:yhr161c] [pn:similarity to rat clathrin assembly protein ap180:hypothetical 71.7 kd protein in rec104-sol3 intergenic region] [gtcfc:12.16] [keggfc:14.2] [sgdfc:6.4.0] [db:gtc-saccharomyces cerevisiae] |
| CONTIG3178 | 29470261_c2_3 | 6597 | 20700 | 306 | 102 | YJL024C | 291 | 8.6(10)-26 | Saccharomyces cerevisiae | [ui:yjl024c] [pn:clathrin-associated protein complex, small subunit:probable adaptin complex small chain homolog] [gn:aps3:yks7:j1274] [gtcfc:12.16.12.6] [keggfc:14.2] [sgdfc:6.4.0:8.7.0] [db:gtc-saccharomyces cerevisiae] |
| CONTIG3802 | 2788942_c1_5 | 6598 | 20701 | 189 | 63 | YJL024C | 128 | 1.6(10)-8 | Saccharomyces cerevisiae | [ui:yjl024c] [pn:clathrin-associated protein complex, small subunit:probable adaptin complex small chain homolog] [gn:aps3:yks7:j1274] [gtcfc:12.16.12.6] [keggfc:14.2] [sgdfc:6.4.0:8.7.0] [db:gtc-saccharomyces cerevisiae] |
| blx14032.y | 10032016_c3_2 | 6599 | 20702 | 792 | 264 | YKL197C | 273 | 1.3(10)-22 | Saccharomyces | [ui:ykl197c] [pn:peroxisomal |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5167 | 4454376_f2_4 | 6600 | 20703 | 282 | 94 | YLR327C | 190 | 4.4(10)-15 | Saccharomyces cerevisiae | assembly protein:peroxisome biosynthesis protein] [gn:pas1] [gtcfc:12.16] [keggfc:14.2] [sgdfc:6.4.0:9.2.0] [db:gtc-saccharomyces cerevisiae] [ui:ylr327c] [pn:strong similarity to stf2p] [gtcfc:12.16] [keggfc:14.2] [sgdfc:6.4.0] [db:gtc-saccharomyces cerevisiae] |
| CONTIG2416 | 26751525_c3_6 | 6601 | 20704 | 1002 | 334 | YNL329C | 1003 | 3.1(10)-101 | Saccharomyces cerevisiae | [ui:ynl329c] [pn:peroxisomal assembly protein:peroxisome biosynthesis protein pas8] [gn:pas8:n0310] [gtcfc:12.16:12.6] [keggfc:14.2] [sgdfc:6.4.0:9.8.0] [db:gtc-saccharomyces cerevisiae] |
| CONTIG3028 | 4422750_c2_4 | 6602 | 20705 | 1608 | 536 | YPL195W | 635 | 6.5(10)-62 | Saccharomyces cerevisiae | [ui:ypl195w] [pn:alpha- or gamma-adaptin, large subunit of the clathrin-associated protein:ap complex] [gn:yks4] [gtcfc:12.16.12.6] [keggfc:14.2] [sgdfc:6.4.0:8.7.0] [db:gtc-saccharomyces cerevisiae] |
| CONTIG788 | 2460010_f2_2 | 6603 | 20706 | 441 | 147 | YPL195W | 409 | 3.1(10)-37 | Saccharomyces cerevisiae | [ui:ypl195w] [pn:alpha- or gamma-adaptin, large subunit of the clathrin-associated protein:ap complex] [gn:yks4] [gtcfc:12.16.12.6] [keggfc:14.2] [sgdfc:6.4.0:8.7.0] [db:gtc-saccharomyces cerevisiae] |
| b2x16287.x | 23469002_c3_2 | 6604 | 20707 | 732 | 244 | YPR029C | 128 | 4.2(10)-6 | Saccharomyces cerevisiae | [ui:ypr029c] [pn:gamma-adaptin, large subunit of the clathrin-associated protein:ap complex] [gn:apl4] [gtcfc:12.16:12.6] [keggfc:14.2] [sgdfc:6.4.0:8.7.0] [db:gtc-saccharomyces cerevisiae] |
| CONTIG1553 | 7313775_f1_1 | 6605 | 20708 | 513 | 171 | YBR241C | 425 | 5.5(10)-40 | Saccharomyces cerevisiae | [ui:ybr241c] [pn:similarity to glucose transport proteins:probable metabolite transport protein ybr241c] [gn:ybr1625] [gtcfc:12.2:12.6] [keggfc:14.2] [sgdfc:1.5.3:7.3.0:17.0.0] [db:gtc-saccharomyces cerevisiae] |
| CONTIG2225 | 5212782_c2_3 | 6606 | 20709 | 633 | 211 | YBR241C | 510 | 5.4(10)-49 | Saccharomyces cerevisiae | [ui:ybr241c] [pn:similarity to glucose transport proteins:probable metabolite transport protein ybr241c] [gn:ybr1625] [gtcfc:12.2:12.6] [keggfc:14.2] [sgdfc:1.5.3:7.3.0:17.0.0] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5819 | 23540907_c2_50 | 6607 | 20710 | 1515 | 505 | YBR241C | 701 | 3.1(10)-69 | *Saccharomyces cerevisiae* | [ui:ybr241c] [pn:similarity to glucose transport proteins:probable metabolite transport protein ybr241c] [gn:ybr1625] [gtcfc:12.2:12.6] [keggfc:14.2] [sgdfc:1.5.3:7.3.0:17.0.0] [db:gtc-saccharomyces cerevisiae] |
| CONTIG5144 | 24392002_f3_3 | 6608 | 20711 | 1068 | 356 | YDL199C | 362 | 1.5(10)-32 | *Saccharomyces cerevisiae* | [ui:ydl199c] [pn:similarity to sugar transporter proteins] [gtcfc:12.2:12.6] [keggfc:14.2] [sgdfc:1.5.3:7.3.0:17.0.0] [db:gtc-saccharomyces cerevisiae] |
| CONTIG5348 | 6047337_c1_11 | 6609 | 20712 | 609 | 203 | YDL138W | 430 | 8.6(10)-40 | *Saccharomyces cerevisiae* | [ui:ydl138w] [pn:suppressor of snf3 mutant] [gn:rgt2] [gtcfc:12.2] [keggfc:14.2] [sgdfc:1.5.3:7.3.0] [db:gtc-saccharomyces cerevisiae] |
| CONTIG5509 | 23652182_f1_2 | 6610 | 20713 | 1659 | 553 | YDL138W | 447 | 1.2(10)-41 | *Saccharomyces cerevisiae* | [ui:ydl138w] [pn:suppressor of snf3 mutant] [gn:rgt2] [gtcfc:12.2] [keggfc:14.2] [sgdfc:1.5.3:7.3.0] [db:gtc-saccharomyces cerevisiae] |
| CONTIG2140 | 972311_c3_5 | 6611 | 20714 | 915 | 305 | YFL040W | 112 | 0.00129 | *Saccharomyces cerevisiae* | [ui:yfl040w] [pn:similarity to yeast glucose transport proteins:probable metabolite transport protein yfl040w] [gtcfc:12.2:12.6] [keggfc:14.2] [sgdfc:1.5.3:7.3.0:17.0.0] [db:gtc-saccharomyces cerevisiae] |
| CONTIG4937 | 29381925_c2_8 | 6612 | 20715 | 1215 | 405 | YFR045W | 231 | 4.5(10)-19 | *Saccharomyces cerevisiae* | [ui:yfr045w] [pn:similarity to mitochondrial citrate transport proteins:putative mitochondrial carrier yfr045w] [gtcfc:12.2] [keggfc:14.2] [sgdfc:7.3.0] [db:gtc-saccharomyces cerevisiae] |
| CONTIG4958 | 35422157_c3_12 | 6613 | 20716 | 1353 | 451 | YKL217W | 673 | 2.8(10)-66 | *Saccharomyces cerevisiae* | [ui:ykl217w] [pn:carboxylic acid transporter protein homolog] [gn:jen1] [gtcfc:12.2:12.6] [keggfc:14.2] [sgdfc:1.5.3:7.3.0:17.0.0] [db:gtc-saccharomyces cerevisiae] |
| CONTIG5497 | 7081302_c2_7 | 6614 | 20717 | 555 | 185 | YKL217W | 269 | 1.3(10)-22 | *Saccharomyces cerevisiae* | [ui:ykl217w] [pn:carboxylic acid transporter protein:carboxylic acid transporter protein homolog] [gn:jen1] [gtcfc:12.2:12.6] [keggfc:14.2] [sgdfc:1.5.3:7.3.0:17.0.0] [db:gtc-saccharomyces cerevisiae] |
| CONTIG751 | 9942668_f3_1 | 6615 | 20718 | 645 | 215 | YKL217W | 316 | 1.1(10)-27 | *Saccharomyces cerevisiae* | [ui:ykl217w] [pn:carboxylic acid transporter protein:carboxylic acid |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1708 | 16835882_c2_10 | 6616 | 20719 | 930 | 310 | YOR271C | 1072 | 1.5(10)-108 | Saccharomyces cerevisiae | transporter protein homolog] [gn:jen1] [gtcfc:12.2:12.6] [keggfc:14.2] [sgdfc:1.5.3:7.3.0:17.0.0] [db:gtc-saccharomyces cerevisiae] [ui:yor271c] [pn:strong similarity to rattus tricarboxylate carrier] [gtcfc:12.2] [keggfc:14.2] [sgdfc:7.3.0] [db:gtc-saccharomyces cerevisiae] |
| CONTIG1965 | 242312_f1_1 | 6617 | 20720 | 780 | 260 | YOR271C | 849 | 6.4(10)-85 | Saccharomyces cerevisiae | [ui:yor271c] [pn:strong similarity to rattus tricarboxylate carrier] [gtcfc:12.2] [keggfc:14.2] [sgdfc:7.3.0] [db:gtc-saccharomyces cerevisiae] |
| CONTIG854 | 14257050_c2_4 | 6618 | 20721 | 540 | 180 | YBR041W | 500 | 6.2(10)-48 | Saccharomyces cerevisiae | [ui:ybr041w] [pn:similarity to m.muculus fatty acid transport protein:hypothetical 71.7 kd protein in fig1-gip1 intergenic region] [gn:fat1:ybr0411] [gtcfc:12.2] [keggfc:14.2] [sgdfc:1.6.5:7.5.0] [db:gtc-saccharomyces cerevisiae] |
| CONTIG854 | 26567212_c2_3 | 6619 | 20722 | 282 | 94 | YBR041W | 211 | 2.6(10)-16 | Saccharomyces cerevisiae | [ui:ybr041w] [pn:similarity to m.muculus fatty acid transport protein:hypothetical 71.7 kd protein in fig1-gip1 intergenic region] [gn:fat1:ybr0411] [gtcfc:12.2] [keggfc:14.2] [sgdfc:1.6.5:7.5.0] [db:gtc-saccharomyces cerevisiae] |
| CONTIG4552 | 26369586_c2_14 | 6620 | 20723 | 1185 | 395 | YKL188C | 430 | 2.7(10)-75 | Saccharomyces cerevisiae | [ui:ykl188c] [pn:long-chain fatty acid transporter:peroxisomal long-chain fatty acid import protein 1] [gn:pat1:ykl1741] [gtcfc:12.2:12.6] [keggfc:14.2] [sgdfc:1.6.5:7.5.0:7.9.0:8.4.0:9.8.0] [db:gtc-saccharomyces cerevisiae] |
| CONTIG4552 | 510285_c1_12 | 6621 | 20724 | 1107 | 369 | YPL147W | 208 | 9.5(10)-16 | Saccharomyces cerevisiae | [ui:ypl147w] [pn:long-chain fatty acid transporter:peroxisomal long-chain fatty acid import protein 2] [gn:pat2:pxa1:pal1ssh2:lpi1w:p26 07] [gtcfc:12.2:12.6] [keggfc:14.2] [sgdfc:1.6.5:7.5.0:7.9.0:8.4.0:9.8.0] [db:gtc-saccharomyces cerevisiae] |
| CONTIG5470 | 5085003_c3_9 | 6622 | 20725 | 2316 | 772 | YPL147W | 895 | 4.4(10)-166 | Saccharomyces cerevisiae | [ui:ypl147w] [pn:long-chain fatty acid transporter:peroxisomal long-chain fatty acid import protein 2] [gn:pat2:pxa1:pal1ssh2:lpi1w:p26 07] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1202 | 22666557_c1_2 | 6623 | 20726 | 492 | 164 | YDR142C | 361 | 3.2(10)-33 | *Saccharomyces cerevisiae* | 07] [gtcfc:12.2:12.6] [keggfc:14.2] [sgdfc:1.6.5:7.5.0:7.9.0:8.4.0:9.8.0] [db:gtc-*saccharomyces ce* [ui:ydr142c] [pn:peroxisomal import protein:peroxisome import protein pas7:peroxin 7] [gn:pas7:peb1:pex7:yd2943] [gtcfc:12.2:12.6] [keggfc:14.2] [sgdfc:8.4.0:9.8.0] [db:gtc-*saccharomyces cerevisiae*] |
| CONTIG3815 | 15038180_c3_7 | 6624 | 20727 | 282 | 94 | YDR142C | 277 | 2.6(10)-24 | *Saccharomyces cerevisiae* | [ui:ydr142c] [pn:peroxisomal import protein:peroxisome import protein pas7:peroxin 7] [gn:pas7:peb1:pex7:yd2943] [gtcfc:12.2:12.6] [keggfc:14.2] [sgdfc:8.4.0:9.8.0] [db:gtc-*saccharomyces cerevisiae*] |
| CONTIG2834 | 803312_c2_2 | 6625 | 20728 | 894 | 298 | YGL186C | 757 | 3.6(10)-75 | *Saccharomyces cerevisiae* | [ui:ygl186c] [pn:similarity to hypothetical protein fcy21p and weak similarity to fcy2 protein:hypothetical 64.5 kd protein in cox4-gts1 intergenic region] [gn:g1370] [gtcfc:12.3:12.6] [keggfc:14.2] [sgdfc:1.3.7:7.6.0:17.0.0] [db:gtc-*saccharomyces cerevisiae*] |
| CONTIG5642 | 12148577_f2_2 | 6626 | 20729 | 1587 | 529 | YGL186C | 1007 | 3.0(10)-118 | *Saccharomyces cerevisiae* | [ui:ygl186c] [pn:similarity to hypothetical protein fcy21p and weak similarity to fcy2 protein:hypothetical 64.5 kd protein in cox4-gts1 intergenic region] [gn:g1370] [gtcfc:12.3:12.6] [keggfc:14.2] [sgdfc:1.3.7:7.6.0:17.0.0] [db:gtc-*saccharomyces cerevisiae*] |
| b9x10393.y | 4355156_c1_1 | 6627 | 20730 | 534 | 178 | YGL186C | 300 | 5.0(10)-26 | *Saccharomyces cerevisiae* | [ui:ygl186c] [pn:similarity to hypothetical protein fcy21p and weak similarity to fcy2 protein:hypothetical 64.5 kd protein in cox4-gts1 intergenic region] [gn:g1370] [gtcfc:12.3:12.6] [keggfc:14.2] [sgdfc:1.3.7:7.6.0:17.0.0] [db:gtc-*saccharomyces cerevisiae*] |
| CONTIG4416 | 23553827_f1_1 | 6628 | 20731 | 906 | 302 | YGR096W | 453 | 5.9(10)-43 | *Saccharomyces cerevisiae* | [ui:ygr096w] [pn:similarity to bovine graves disease carrier protein:putative mitochondrial carrier ygr096w] [gtcfc:12.3] [keggfc:14.2] [sgdfc:1.3.7:7.6.0] [db:gtc-*saccharomyces cerevisiae*] |
| CONTIG5156 | 21994017_c3_14 | 6629 | 20732 | 339 | 113 | YHR002W | 159 | 3.6(10)-11 | *Saccharomyces cerevisiae* | [ui:yhr002w] [pn:similarity to bovine mitochondrial carrier |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4092 | 4103578_f1_1 | 6630 | 20733 | 810 | 270 | YPR011C | 653 | 3.7(10)-64 | Saccharomyces cerevisiae | protein/grave"s disease carrier protein:putative mitochondrial carrier yhr002w] [gtcfc:12.3] [keggfc:14.2] [sgdfc:1.3.7:7.6.0] [db:gtc-saccharomyces cerevisiae] [ui:ypr011c] [pn:similarity to adp/atp carrier proteins and graves disease carrier protein] [gtcfc:12.3] [keggfc:14.2] [sgdfc:1.3.7:7.6.0] [db:gtc-saccharomyces cerevisiae] |
| CONTIG3292 | 24395161_f2_2 | 6631 | 20734 | 579 | 193 | YPR011C | 163 | 1.0(10)-11 | Saccharomyces cerevisiae | [ui:ypr011c] [pn:similarity to adp/atp carrier proteins and graves disease carrier protein] [gtcfc:12.3] [keggfc:14.2] [sgdfc:1.3.7:7.6.0] [db:gtc-saccharomyces cerevisiae] |
| CONTIG1318 | 32462785_f2_3 | 6632 | 20735 | 267 | 89 | YBR235W | 208 | 1.3(10)-15 | Saccharomyces cerevisiae | [ui:ybr235w] [pn:similarity to bumetanide-sensitive na-k-cl cotransport protein:hypothetical 124.0 kd protein in pcs60-abd1 intergenic region] [gn:ybr1601] [gtcfc:12.4:12.5:12.6] [keggfc:14.2] [sgdfc:1.8.2:7.2.2:7.2.3:17.0.0] [db:gtc- |
| CONTIG2248 | 34094015_f2_1 | 6633 | 20736 | 1458 | 486 | YBR235W | 268 | 3.6(10)-20 | Saccharomyces cerevisiae | [ui:ybr235w] [pn:similarity to bumetanide-sensitive na-k-cl cotransport protein:hypothetical 124.0 kd protein in pcs60-abd1 intergenic region] [gn:ybr1601] [gtcfc:12.4:12.5:12.6] [keggfc:14.2] [sgdfc:1.8.2:7.2.2:7.2.3:17.0.0] [db:gtc- |
| CONTIG3606 | 14644442_c1_5 | 6634 | 20737 | 1434 | 478 | YBR235W | 1191 | 3.7(10)-121 | Saccharomyces cerevisiae | [ui:ybr235w] [pn:similarity to bumetanide-sensitive na-k-cl cotransport protein:hypothetical 124.0 kd protein in pcs60-abd1 intergenic region] [gn:ybr1601] [gtcfc:12.4:12.5:12.6] [keggfc:14.2] [sgdfc:1.8.2:7.2.2:7.2.3:17.0.0] [db:gtc- |
| CONTIG5398 | 20351377_f1_4 | 6635 | 20738 | 1530 | 510 | YBR296C | 988 | 9.3(10)-141 | Saccharomyces cerevisiae | [ui:ybr296c] [pn:strong similarity to phosphate-repressible phosphate permease:putative phosphate-repressible phosphate permease ybr29c] [gn:ybr2113] [gtcfc:12.4:12.6:13.10] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1600 | 26376660_f1_2 | 6636 | 20739 | 792 | 264 | YCR037C | 368 | 7.5(10)-33 | Saccharomyces cerevisiae | [sgdfc:1.4.3:1.8.2:7.2.3:17.0.0] [db:gtc-sacch [ui:ycr037c] [pn:member of the phosphate permease family:inorganic phosphate transporter pho87] [gn:pho87:ycr37:ycr524] [gtcfc:12.4:13.10] [keggfc:14.2] [sgdfc:1.4.3:1.8.2:7.2.3:17.0.0] [db:gtc-saccharomyces cerevisiae] |
| CONTIG2512 | 783532_c1_2 | 6637 | 20740 | 504 | 168 | YCR037C | 519 | 3.8(10)-49 | Saccharomyces cerevisiae | [ui:ycr037c] [pn:member of the phosphate permease family:inorganic phosphate transporter pho87] [gn:pho87:ycr37:ycr524] [gtcfc:12.4:13.10] [keggfc:14.2] [sgdfc:1.4.3:1.8.2:7.2.3:17.0.0] [db:gtc-saccharomyces cerevisiae] |
| b3x14152.x | 210967_c3_3 | 6638 | 20741 | 969 | 323 | YCR037C | 256 | 7.7(10)-21 | Saccharomyces cerevisiae | [ui:ycr037c] [pn:member of the phosphate permease family:inorganic phosphate transporter pho87] [gn:pho87:ycr37:ycr524] [gtcfc:12.4:13.10] [keggfc:14.2] [sgdfc:1.4.3:1.8.2:7.2.3:17.0.0] [db:gtc-saccharomyces cerevisiae] |
| CONTIG2431 | 20486557_c2_6 | 6639 | 20742 | 246 | 82 | YJL198W | 144 | 6.7(10)-9 | Saccharomyces cerevisiae | [ui:yjl198w] [pn:strong similarity to pho87p:hypothetical 97.7 kd membrane protein in prp21-ubp12 intergenic region] [gn:j0336] [gtcfc:12.4:12.6:13.10] [keggfc:14.2] [sgdfc:1.4.3:1.8.2:7.2.3:17.0.0] [db:gtc-saccharomyces cerevisiae] |
| CONTIG2844 | 14178762_c2_5 | 6640 | 20743 | 960 | 320 | YJL198W | 105 | 0.01299 | Saccharomyces cerevisiae | [ui:yjl198w] [pn:strong similarity to pho87p:hypothetical 97.7 kd membrane protein in prp21-ubp12 intergenic region] [gn:j0336] [gtcfc:12.4:12.6:13.10] [keggfc:14.2] |
| CONTIG1635 | 24804812_f1_1 | 6641 | 20744 | 729 | 243 | YJL117W | 162 | 1.2(10)-10 | Saccharomyces cerevisiae | [ui:yjl117w] [pn:inorganic phosphate transporter:inorganic phosphate transporter pho86] [gn:pho86:j0744] [gtcfc:12.4:13.10] [keggfc:14.2] [sgdfc:1.4.3:1.8.2:7.2.3] [db:gtc-saccharomyces cerevisiae] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG481 | 10579187_c3_3 | 6642 | 20745 | 219 | 73 | YJL117W | 97 | 0.00017 | *Saccharomyces cerevisiae* | [ui:yjl117w] [pn:inorganic phosphate transporter:inorganic phosphate transporter pho86] [gn:pho86;j0744] [gtcfc:12.4:13.10] [keggfc:14.2] [sgdfc:1.4.3:1.8.2:7.2.3] [db·gtc-*saccharomyces cerevisiae*] |
| CONTIG5446 | 14881535_f1_2 | 6643 | 20746 | 2487 | 829 | YLR092W | 1744 | 9.3(10)-180 | *Saccharomyces cerevisiae* | [ui:ylr092w] [pn:strong similarity to sul1p] [gn:sel2] [gtcfc:12.4:12.6] [keggfc:14.2] [sgdfc:1.2.3:1.8.2:7.2.3:17.0.0] [db·gtc-*saccharomyces cerevisiae*] |
| CONTIG3415 | 788317_f1_1 | 6644 | 20747 | 765 | 255 | YNR013C | 118 | 0.00032 | *Saccharomyces cerevisiae* | [ui:ynr013c] [pn:similarity to membrane protein pho87p and hypothetical protein yjl198w:hypothetical 99.5 kd protein in urk1-smm1 intergenic region] [gn:n2052] [gtcfc:12.4:12.6:13.10] [keggfc:14.2] |
| CONTIG3530 | 11876286_c2_6 | 6645 | 20748 | 264 | 88 | YNR013C | 165 | 3.8(10)-11 | *Saccharomyces cerevisiae* | [sgdfc:1.4.3:1.8.2:7.2.3:17.0.0] [db [ui:ynr013c] [pn:similarity to membrane protein pho87p and hypothetical protein yjl198w:hypothetical 99.5 kd protein in urk1-smm1 intergenic region] [gn:n2052] [gtcfc:12.4:12.6:13.10] [keggfc:14.2] |
| CONTIG2761 | 4039134_c1_2 | 6646 | 20749 | 1266 | 422 | YNR013C | 1153 | 3.8(10)-117 | *Saccharomyces cerevisiae* | [sgdfc:1.4.3:1.8.2:7.2.3:17.0.0] [db [ui:ynr013c] [pn:similarity to membrane protein pho87p and hypothetical protein yjl198w:hypothetical 99.5 kd protein in urk1-smm1 intergenic region] [gn:n2052] [gtcfc:12.4:12.6:13.10] [keggfc:14.2] |
| CONTIG3466 | 4475255_c3_4 | 6647 | 20750 | 420 | 140 | YPR138C | 343 | 2.7(10)-31 | *Saccharomyces cerevisiae* | [ui:ypr138c] [pn:strong similarity to ammonium transport proteins:ammonium transporter mep3] [gn:mep3:p9659] [gtcfc:12.5] [keggfc:14.2] [sgdfc:1.2.3:7.2.2:17.0.0] [db·gtc *saccharomyces cerevisiae*] |
| b9x10b25.x | 31407754_c2_2 | 6648 | 20751 | 528 | 176 | YPR138C | 578 | 3.3(10)-56 | *Saccharomyces cerevisiae* | [ui:ypr138c] [pn:strong similarity to ammonium transport proteins:ammonium transporter |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG238 | 4375052_c3_1 | 6649 | 20752 | 678 | 226 | YAL026C | 792 | 5.9(10)-78 | Saccharomyces cerevisiae | mcp3] [gn:mcp3:p9659] [gtcfc:12.5] [keggfc:14.2] [sgdfc:1.2.3;7.2.2;17.0.0] [db:gtc-saccharomyces cerevisiae] [ui:yal026c] [pn:p-type amino-phospholipids-atpase;probable calcium-transporting atpase 3;endoplasmic reticulum ca2+-atpase] [gn:pmc1;drs2:fun38] [gtcfc:12.2:12.5;12.6;12.16] [sgdfc:7.2.2;7.8.0] [ec:3.6.1.38] [keggfc:14.1] |
| CONTIG2297 | 26367325_c1_3 | 6650 | 20753 | 975 | 325 | YAL026C | 1093 | 9.0(10)-111 | Saccharomyces cerevisiae | [db:gtc-sac [ui:yal026c] [pn:p-type amino-phospholipids-atpase;probable calcium-transporting atpase 3;endoplasmic reticulum ca2+-atpase] [gn:pmc1;drs2:fun38] [gtcfc:12.2:12.5;12.6;12.16] [sgdfc:7.2.2;7.8.0] [ec:3.6.1.38] [keggfc:14.1] |
| CONTIG3268 | 5906250_c2_7 | 6651 | 20754 | 1353 | 451 | YAL026C | 761 | 1.3(10)-74 | Saccharomyces cerevisiae | [db:gtc-sac [ui:yal026c] [pn:p-type amino-phospholipids-atpase;probable calcium-transporting atpase 3;endoplasmic reticulum ca2+-atpase] [gn:pmc1;drs2:fun38] [gtcfc:12.2:12.5;12.6;12.16] [sgdfc:7.2.2;7.8.0] [ec:3.6.1.38] [keggfc:14.1] |
| CONTIG5035 | 483516_c3_15 | 6652 | 20755 | 390 | 130 | YAL026C | 319 | 2.6(10)-27 | Saccharomyces cerevisiae | [db:gtc-sac [ui:yal026c] [pn:p-type amino-phospholipids-atpase;probable calcium-transporting atpase 3;endoplasmic reticulum ca2+-atpase] [gn:pmc1;drs2:fun38] [gtcfc:12.2:12.5;12.6;12.16] [sgdfc:7.2.2;7.8.0] [ec:3.6.1.38] [keggfc:14.1] |
| CONTIG5397 | 24413193_c1_18 | 6653 | 20756 | 684 | 228 | YDR456W | 611 | 1.1(10)-59 | Saccharomyces cerevisiae | [db:gtc-sac [ui:ydr456w] [pn:similarity to mammalian na+/h+ antiporters] [gtcfc:12.5:12.6] [keggfc:14.2] [sgdfc:1.8.2:7.2.2:17.0.0] [db:gtc-saccharomyces cerevisiae] |
| CONTIG1608 | 23879781_c3_9 | 6654 | 20757 | 948 | 316 | YLR138W | 433 | 1.1(10)-45 | Saccharomyces cerevisiae | [ui:ylr138w] [pn:putative na+/h+ antiporter] [gn:nha1] [gtcfc:12.5:12.6] [keggfc:14.2] [sgdfc:1.8.2:7.2.2.2] [db:gtc-saccharomyces cerevisiae] |
| CONTIG5606 | 7115936_f3_23 | 6655 | 20758 | 1239 | 413 | YLR138W | 1185 | 1.6(10)-120 | Saccharomyces cerevisiae | [ui:ylr138w] [pn:putative na+/h+ antiporter] [gn:nha1] [gtcfc:12.5:12.6] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5606 | 35180166_f2_15 | 6656 | 20759 | 1434 | 478 | YLR138W | 465 | 5.4(10)-58 | Saccharomyces cerevisiae | [sgdfc:1.8:2:7.2.2] [dbgtc-saccharomyces cerevisiae] [ui:ylr138w] [pn:putative na+/h+ antiporter] [gn:nha1] [gtcfc:12.5:12.6] [keggfc:14.2] [sgdfc:1.8:2:7.2.2] [dbgtc-saccharomyces cerevisiae] |
| CONTIG4942 | 29330192_c3_24 | 6657 | 20760 | 1653 | 551 | YDR091C | 2313 | 4.7(10)-240 | Saccharomyces cerevisiae | [ui:ydr091c] [pn:strong similarity to human rnase 1 inhibitor and m.jannaschii abc transporter protein] [gtcfc:12.6:10.2] [keggfc:14.2] [sgdfc:7.9.0] [dbgtc-saccharomyces cerevisiae] |
| CONTIG1100 | 19562952_c1_1 | 6658 | 20761 | 627 | 209 | YDR406W | 414 | 2.2(10)-37 | Saccharomyces cerevisiae | [ui:ydr406w] [pn:atp-binding cassette transporter family member] [gn:pdr15] [gtcfc:12.6] [keggfc:14.2] [sgdfc:7.9.0] [dbgtc-saccharomyces cerevisiae] |
| CONTIG5296 | 26797286_c2_12 | 6659 | 20762 | 1833 | 611 | YDR406W | 1504 | 2.5(10)-154 | Saccharomyces cerevisiae | [ui:ydr406w] [pn:atp-binding cassette transporter family member] [gn:pdr15] [gtcfc:12.6] [keggfc:14.2] [sgdfc:7.9.0] [dbgtc-saccharomyces cerevisiae] |
| CONTIG5296 | 865925_c3_14 | 6660 | 20763 | 804 | 268 | YDR406W | 486 | 4.9(10)-45 | Saccharomyces cerevisiae | [ui:ydr406w] [pn:atp-binding cassette transporter family member] [gn:pdr15] [gtcfc:12.6] [keggfc:14.2] [sgdfc:7.9.0] [dbgtc-saccharomyces cerevisiae] |
| CONTIG5761 | 5101436_f3_12 | 6661 | 20764 | 1842 | 614 | YER036C | 2436 | 4.2(10)-253 | Saccharomyces cerevisiae | [ui:yer036c] [pn:similarity to members of the abc transporter family;probable atp-dependent transporter yer036c] [gtcfc:12.6] [keggfc:14.2] [sgdfc:7.9.0] [dbgtc-saccharomyces cerevisiae] |
| CONTIG3011 | 25425802_c2_8 | 6662 | 20765 | 843 | 281 | YFL028C | 657 | 1.3(10)-64 | Saccharomyces cerevisiae | [ui:yfl028c] [pn:atp-binding cassette transporter family member;probable atp-dependent transporter yfl028c] [gn:caf16] [gtcfc:12.6] [keggfc:14.2] [sgdfc:7.9.0] [dbgtc-saccharomyces cerevisiae] |
| CONTIG4658 | 15907831_c3_7 | 6663 | 20766 | 825 | 275 | YFL028C | 560 | 2.7(10)-54 | Saccharomyces cerevisiae | [ui:yfl028c] [pn:atp-binding cassette transporter family member;probable atp-dependent transporter yfl028c] [gn:caf16] [gtcfc:12.6] [keggfc:14.2] [sgdfc:7.9.0] [dbgtc-saccharomyces cerevisiae] |
| CONTIG4530 | 14570388_f3_4 | 6664 | 20767 | 276 | 92 | YLL048C | 263 | 3.1(10)-21 | Saccharomyces cerevisiae | [ui:yll048c] [pn:similarity to rat |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2029 | 20320275_c1_1 | 6665 | 20768 | 336 | 112 | YLR188W | 277 | 2.5(10)-23 | Saccharomyces cerevisiae | [ui:ylr188w] [pn:atp-binding cassette transporter family member:atp-dependent permease mdl1] [gn:mdl1:19470] [gtcfc:12.6.11.1] [keggfc:14.2] [sgdfc:7.9.0] [db:gtc-saccharomyces cerevisiae] |
| b3x19039.x | 20019533_f2_1 | 6666 | 20769 | 501 | 167 | YLR188W | 412 | 5.2(10)-38 | Saccharomyces cerevisiae | [ui:ylr188w] [pn:atp-binding cassette transporter family member:atp-dependent permease mdl1] [gn:mdl1:19470] [gtcfc:12.6.11.1] [keggfc:14.2] [sgdfc:7.9.0] [db:gtc-saccharomyces cerevisiae] |
| CONTIG4368 | 34023325_c3_7 | 6667 | 20770 | 900 | 300 | YOL075C | 443 | 1.0(10)-40 | Saccharomyces cerevisiae | [ui:yol075c] [pn:similarity to a.gambiae atp-binding-cassette protein] [gtcfc:12.6] [keggfc:14.2] [sgdfc:7.9.0] [db:gtc-saccharomyces cerevisiae] |
| CONTIG4643 | 23859467_f2_2 | 6668 | 20771 | 861 | 287 | YOL075C | 434 | 9.3(10)-40 | Saccharomyces cerevisiae | [ui:yol075c] [pn:similarity to a.gambiae atp-binding-cassette protein] [gtcfc:12.6] [keggfc:14.2] [sgdfc:7.9.0] [db:gtc-saccharomyces cerevisiae] |
| CONTIG4643 | 21912952_f3_4 | 6669 | 20772 | 1557 | 519 | YOL075C | 918 | 3.1(10)-92 | Saccharomyces cerevisiae | [ui:yol075c] [pn:similarity to a.gambiae atp-binding-cassette protein] [gtcfc:12.6] [keggfc:14.2] [sgdfc:7.9.0] [db:gtc-saccharomyces cerevisiae] |
| CONTIG4029 | 819077_c2_8 | 6670 | 20773 | 2232 | 744 | YPL270W | 1053 | 1.6(10)-106 | Saccharomyces cerevisiae | [ui:ypl270w] [pn:atp-binding cassette:abc transporter family member:atp-dependent permease mdl2] [gn:mdl2:ssh1] [gtcfc:12.6.11.1] [keggfc:14.2] [sgdfc:7.9.0] [db:gtc-saccharomyces cerevisiae] |
| CONTIG5597 | 2142151_c3_21 | 6671 | 20774 | 1278 | 426 | YBR290W | 450 | 1.2(10)-42 | Saccharomyces cerevisiae | [ui:ybr290w] [pm:metal homeostasis protein:metal homeostatis protein bsd2] [gn:bsd2:ybr2037] [gtcfc:12.6] [keggfc:14.2] [sgdfc:[18.1]:7.2.1] [db:gtc-saccharomyces cerevisiae] |
| CONTIG5220 | 25394527_c1_8 | 6672 | 20775 | 423 | 141 | YDR270W | 316 | 3.3(10)-27 | Saccharomyces cerevisiae | [ui:ydr270w] [pn:probable copper-transporting atpase] [gn:ccc2] [gtcfc:12.6] [keggfc:14.2] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5220 | 11134712_c1_7 | 6673 | 20776 | 2880 | 960 | YDR270W | 558 | 7.0(10)-91 | Saccharomyces cerevisiae | [sgdfc:1.8.1:7.2.1:7.8.0] [db:gtc-saccharomyces cerevisiae] [ui:ydr270w] [pn:probable copper-transporting atpase] [gn:ccc2] [gtcfc:12.6] [keggfc:14.2] [sgdfc:1.8.1:7.2.1:7.8.0] [db:gtc-saccharomyces cerevisiae] |
| CONTIG5221 | 4723903_c1_16 | 6674 | 20777 | 1911 | 637 | YDR270W | 173 | 5.4(10)-16 | Saccharomyces cerevisiae | [ui:ydr270w] [pn:probable copper-transporting atpase] [gn:ccc2] [gtcfc:12.6] [keggfc:14.2] [sgdfc:1.8.1:7.2.1:7.8.0] [db:gtc-saccharomyces cerevisiae] |
| CONTIG1580 | 34236641_f3_3 | 6675 | 20778 | 369 | 123 | YLR130C | 90 | 0.0016 | Saccharomyces cerevisiae | [ui:ylr130c] [pn:low affinity zinc transporter] [gn:znt2] [gtcfc:12.6] [keggfc:14.2] [sgdfc:1.8.1:7.2.1] [db:gtc-saccharomyces cerevisiae] |
| CONTIG5819 | 5895067_f2_5 | 6676 | 20779 | 387 | 129 | YLR130C | 442 | 8.6(10)-42 | Saccharomyces cerevisiae | [ui:ylr130c] [pn:low affinity zinc transporter] [gn:znt2] [gtcfc:12.6] [keggfc:14.2] [sgdfc:1.8.1:7.2.1] [db:gtc-saccharomyces cerevisiae] |
| CONTIG2369 | 4490632_c1_4 | 6677 | 20780 | 1035 | 345 | YAL067C | 406 | 7.0(10)-38 | Saccharomyces cerevisiae | [ui:yal067c] [pn:suppressor of sulfoxyde ethionine resistance:hypothetical 68.8 kd protein in gdh3 5"region] [gn:seo1] [gtcfc:12.6:13.3] [keggfc:14.2] [sgdfc:7.7.0:7.10.0:17.0.0] [db:gtc-saccharomyces cerevisiae] |
| CONTIG4389 | 3016876_c1_4 | 6678 | 20781 | 246 | 82 | YAL067C | 168 | 1.0(10)-11 | Saccharomyces cerevisiae | [ui:yal067c] [pn:suppressor of sulfoxyde ethionine resistance:hypothetical 68.8 kd protein in gdh3 5"region] [gn:seo1] [gtcfc:12.6:13.3] [keggfc:14.2] [sgdfc:7.7.0:7.10.0:17.0.0] [db:gtc-saccharomyces cerevisiae] |
| CONTIG4389 | 555342_c3_6 | 6679 | 20782 | 1293 | 431 | YAL067C | 792 | 7.0(10)-79 | Saccharomyces cerevisiae | [ui:yal067c] [pn:suppressor of sulfoxyde ethionine resistance:hypothetical 68.8 kd protein in gdh3 5"region] [gn:seo1] [gtcfc:12.6:13.3] [keggfc:14.2] [sgdfc:7.7.0:7.10.0:17.0.0] [db:gtc-saccharomyces cerevisiae] |
| CONTIG5195 | 22558275_c1_8 | 6680 | 20783 | 861 | 287 | YAL067C | 777 | 2.7(10)-77 | Saccharomyces cerevisiae | [ui:yal067c] [pn:suppressor of sulfoxyde ethionine resistance:hypothetical 68.8 kd protein in gdh3 5"region] [gn:seo1] [gtcfc:12.6:13.3] [keggfc:14.2] [sgdfc:7.7.0:7.10.0:17.0.0] [db:gtc-saccharomyces cerevisiae] |
| CONTIG5195 | 9798555_c3_9 | 6681 | 20784 | 1092 | 364 | YAL067C | 682 | 32(10)-67 | Saccharomyces cerevisiae | [ui:yal067c] [pn:suppressor of |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | cerevisiae | sulfoxyde ethionine resistance:hypothetical 68.8 kd protein in gdh3 5"region] [gn:seo1] [gtcfc:12.6:13.3] [kegcfc:14.2] [sgdfc:7.7.0:7.10.0:17.0.0] [db:gtc-saccharomyces cerevisiae |
| CONTIG5471 | 26462875_f3_8 | 6682 | 20785 | 663 | 221 | YAL067C | 187 | 9.3(10)-14 | Saccharomyces cerevisiae | [ui:yal067c] [pn:suppressor of sulfoxyde ethionine resistance:hypothetical 68.8 kd protein in gdh3 5"region] [gn:seo1] [gtcfc:12.6:13.3] [kegcfc:14.2] [sgdfc:7.7.0:7.10.0:17.0.0] [db:gtc-saccharomyces cerevisiae |
| CONTIG5813 | 9875126_c2_47 | 6683 | 20786 | 396 | 132 | YMR123W | 179 | 6.4(10)-14 | Saccharomyces cerevisiae | [ui:ymr123w] [pn:resistance against pichia farinosa killer toxin:smk toxin when expressed by a multi copy plasmid] [gn:rpkr1] [gtcfc:12.6:13.3] [kegcfc:14.2] [sgdfc:7.10.0:17.0.0] [db:gtc-saccharomyces cerevisiae |
| CONTIG4533 | 16220688_c2_5 | 6684 | 20787 | 2466 | 822 | YDR093W | 2400 | 2.7(10)-249 | Saccharomyces cerevisiae | [ui:ydr093w] [pn:similarity to p. falciparum atpase 2:probable calcium-transporting atpase 4] [gn:drs2:yd8557] [kegcfc:12.6] [ec:3.6.1.38] [kegfc:14.1] [sgdfc:7.8.0] [db:gtc-saccharomyces cerevisiae |
| CONTIG4834 | 26445187_f3_4 | 6685 | 20788 | 2445 | 815 | YDR093W | 1527 | 9.1(10)-157 | Saccharomyces cerevisiae | [ui:ydr093w] [pn:similarity to p. falciparum atpase 2:probable calcium-transporting atpase 4] [gn:drs2:yd8557] [kegcfc:12.6] [ec:3.6.1.38] [kegfc:14.1] [sgdfc:7.8.0] [db:gtc-saccharomyces cerevisiae |
| CONTIG326 | 33695388_c3_3 | 6686 | 20789 | 555 | 185 | YER166W | 606 | 8.0(10)-58 | Saccharomyces cerevisiae | [ui:yer166w] [pn:similarity to atpase p. falciparum atpase 2:probable calcium-transporting atpase 5] [gn:sygp-orf7] [gtcfc:12.6] [ec:3.6.1.38] [kegfc:14.1] [sgdfc:7.8.0] [db:gtc-saccharomyces cerevisiae |
| CONTIG4501 | 4031306_c1_9 | 6687 | 20790 | 390 | 130 | YER166W | 240 | 8.1(10)-19 | Saccharomyces cerevisiae | [ui:yer166w] [pn:similarity to atpase p. falciparum atpase 2:probable calcium-transporting atpase 5] [gn:sygp-orf7] [gtcfc:12.6] [ec:3.6.1.38] [kegfc:14.1] [sgdfc:7.8.0] [db:gtc-saccharomyces cerevisiae |

TABLE 2

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG608 | 4814625_c3_1 | 6688 | 20791 | 501 | 167 | YER166W | 515 | 4.2(10)-48 | Saccharomyces cerevisiae | [ui:yer166w] [pn:similarity to atpase p. falciparum atpase 2:probable calcium-transporting atpase 5] [gnssygp-orf7] [gtcfc:12.6] [ec:3.6.1.38] [keggfc:14.1] [sgdfc:7.8.0] [db:gtc-saccharomyces cerevisiae] |
| CONTIG3066 | 12790912_c3_10 | 6689 | 20792 | 2457 | 819 | YMR162C | 1665 | 2.2(10)-171 | Saccharomyces cerevisiae | [ui:ymr162c] [pn:similarity to atpases] [gtcfc:12.6] [keggfc:14.2] [sgdfc:7.8.0] [db:gtc-saccharomyces cerevisiae] |
| CONTIG5758 | 26812517_c2_21 | 6690 | 20793 | 990 | 330 | YMR162C | 386 | 2.5(10)-34 | Saccharomyces cerevisiae | [ui:ymr162c] [pn:similarity to atpases] [gtcfc:12.6] [keggfc:14.2] [sgdfc:7.8.0] [db:gtc-saccharomyces cerevisiae] |
| b1x15548.x | 23631392_c2_3 | 6691 | 20794 | 579 | 193 | YMR162C | 463 | 1.6(10)-42 | Saccharomyces cerevisiae | [ui:ymr162c] [pn:similarity to atpases] [gtcfc:12.6] [keggfc:14.2] [sgdfc:7.8.0] [db:gtc-saccharomyces cerevisiae] |
| CONTIG1020 | 5085349_c1_3 | 6692 | 20795 | 993 | 331 | YMR162C | 623 | 1.3(10)-59 | Saccharomyces cerevisiae | [ui:ymr162c] [pn:similarity to atpases] [gtcfc:12.6] [keggfc:14.2] [sgdfc:7.8.0] [db:gtc-saccharomyces cerevisiae] |
| CONTIG1766 | 7313802_f1_1 | 6693 | 20796 | 801 | 267 | YGR260W | 229 | 2.2(10)-18 | Saccharomyces cerevisiae | [ui:ygr260w] [pn:similarity to allantoate transport protein:hypothetical 60.1 kd protein in rad2-ap16 intergenic region] [gtcfc:12.6] [keggfc:14.2] [sgdfc:7.7.0:17.0.0] [db:gtc-saccharomyces cerevisiae] |
| CONTIG4034 | 175056_c1_4 | 6694 | 20797 | 1446 | 482 | YGR260W | 622 | 7.2(10)-61 | Saccharomyces cerevisiae | [ui:ygr260w] [pn:similarity to allantoate transport protein:hypothetical 60.1 kd protein in rad2-ap16 intergenic region] [gtcfc:12.6] [keggfc:14.2] [sgdfc:7.7.0:17.0.0] [db:gtc-saccharomyces cerevisiae] |
| CONTIG3312 | 7057_f1_1 | 6695 | 20798 | 1533 | 511 | YIL166C | 1028 | 6.9(10)-104 | Saccharomyces cerevisiae | [ui:yil166c] [pn:similarity to allantoate permease dal5p:hypothetical 61.9 kd protein in suc2 5'region] [gtcfc:12.6] [keggfc:14.2] [sgdfc:7.7.0:17.0.0] [db:gtc-saccharomyces cerevisiae] |
| CONTIG5018 | 25446900_c3_19 | 6696 | 20799 | 1242 | 414 | YIL166C | 859 | 5.5(10)-86 | Saccharomyces cerevisiae | [ui:yil166c] [pn:similarity to allantoate permease dal5p:hypothetical 61.9 kd protein in suc2 5'region] [gtcfc:12.6] [keggfc:14.2] [sgdfc:7.7.0:17.0.0] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5018 | 12929035_c3_18 | 6697 | 20800 | 324 | 108 | YIL166C | 109 | 2.0(10)-5 | *Saccharomyces cerevisiae* | [db:gtc-saccharomyces cerevisiae] [ui:yil166c] [pn:similarity to allantoate permease dal5p:hypothetical 61.9 kd protein in suc2 5"region] [gtcfc:12.6] [keggfc:14.2] [sgdfc:7.7.0:17.0.0] |
| CONTIG5818 | 6035255_f1_2 | 6698 | 20801 | 1794 | 598 | YIL166C | 1074 | 9.1(10)-109 | *Saccharomyces cerevisiae* | [db:gtc-saccharomyces cerevisiae] [ui:yil166c] [pn:similarity to allantoate permease dal5p:hypothetical 61.9 kd protein in suc2 5"region] [gtcfc:12.6] [keggfc:14.2] [sgdfc:7.7.0:17.0.0] |
| CONTIG3436 | 34158510_f2_3 | 6699 | 20802 | 1254 | 418 | YLR004C | 467 | 1.8(10)-44 | *Saccharomyces cerevisiae* | [db:gtc-saccharomyces cerevisiae] [ui:ylr004c] [pn:similarity to allantoate transport protein] [gtcfc:12.6] [keggfc:14.2] [sgdfc:7.7.0:17.0.0] |
| CONTIG5192 | 1304627_c3_17 | 6700 | 20803 | 1563 | 521 | YLR004C | 1244 | 8.9(10)-127 | *Saccharomyces cerevisiae* | [db:gtc-saccharomyces cerevisiae] [ui:ylr004c] [pn:similarity to allantoate transport protein] [gtcfc:12.6] [keggfc:14.2] [sgdfc:7.7.0:17.0.0] |
| CONTIG4360 | 9954506_c1_3 | 6701 | 20804 | 681 | 227 | YBL089W | 230 | 1.0(10)-29 | *Saccharomyces cerevisiae* | [ui:ybl089w] [pn:weak similarity to a. thaliana aminoacid permease aap3:hypothetical 57.1 kd protein in map2-tel1 intergenic region] [gn:ybl0703] [gtcfc:12.6] [keggfc:14.2] [sgdfc:7.11.0:17.0.0] [db:gtc-saccharomyces cerevisiae] |
| CONTIG5736 | 1053127_f1_7 | 6702 | 20805 | 513 | 171 | YBL011W | 349 | 5.2(10)-31 | *Saccharomyces cerevisiae* | [ui:ybl011w] [pn:suppresses a choline-transport mutant:hypothetical 85.7 kd protein in rrn6-hir1 intergenic region] [gn:sct1:ybl0315:ybl0309] [gtcfc:12.6:12.13] [keggfc:14.2] [sgdfc:7.11.0] [db:gtc-saccharomyces cerevisiae] |
| CONTIG5736 | 24268805_f2_13 | 6703 | 20806 | 1794 | 598 | YBL011W | 1097 | 3.3(10)-111 | *Saccharomyces cerevisiae* | [ui:ybl011w] [pn:suppresses a choline-transport mutant:hypothetical 85.7 kd protein in rrn6-hir1 intergenic region] [gn:sct1:ybl0315:ybl0309] [gtcfc:12.6:12.13] [keggfc:14.2] [sgdfc:7.11.0] [db:gtc-saccharomyces cerevisiae] |
| CONTIG5819 | 35555166_c3_52 | 6704 | 20807 | 672 | 224 | YBL011W | 472 | 2.0(10)-44 | *Saccharomyces cerevisiae* | [ui:ybl011w] [pn:suppresses a choline-transport mutant:hypothetical 85.7 kd |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | | protein in rrn6-hir1 intergenic region] [gn:sct1;ybl0315;ybl0309] [gtcfc:12.6:12.13] [keggfc:7.11.0] [sgdfc:14.2] [db:gtc-saccharomyces cerevisiae] |
| CONTIG4250 | 3912830_c2_5 | 6705 | 20808 | 507 | 169 | YDL206W | 187 | 1.3(10)-13 | Saccharomyces cerevisiae | [ui:ydl206w] [pn:weak similarity to transporter proteins] [gtcfc:12.6] [keggfc:14.2] [sgdfc:7.11.0] [db:gtc-saccharomyces cerevisiae] |
| CONTIG4250 | 31796927_c3_6 | 6706 | 20809 | 1527 | 509 | YDL206W | 158 | 3.3(10)-8 | Saccharomyces cerevisiae | [ui:ydl206w] [pn:weak similarity to transporter proteins] [gtcfc:12.6] [keggfc:14.2] [sgdfc:7.11.0] [db:gtc-saccharomyces cerevisiae] |
| CONTIG583 | 43867055_c3_2 | 6707 | 20810 | 624 | 208 | YEL064C | 456 | 2.7(10)-43 | Saccharomyces cerevisiae | [ui:yel064c] [pn:similarity to ybl089w:hypothetical 53.3 kd protein in hxt8-can1 intergenic region] [gtcfc:12.6] [keggfc:14.2] [sgdfc:7.11.0:17.0.0] [db:gtc-saccharomyces cerevisiae] |
| CONTIG12 | 24414062_c3_4 | 6708 | 20811 | 399 | 133 | YER119C | 250 | 6.2(10)-21 | Saccharomyces cerevisiae | [ui:yer119c] [pn:weak similarity to e. herbicola tyrosine permease:hypothetical 48.8 kd protein in ssu81-scs2 intergenic region] [gtcfc:12.6] [keggfc:14.2] [sgdfc:7.11.0:17.0.0] [db:gtc-saccharomyces cerevisiae] |
| CONTIG3058 | 24414062_f1_1 | 6709 | 20812 | 798 | 266 | YER119C | 413 | 1.0(10)-38 | Saccharomyces cerevisiae | [ui:yer119c] [pn:weak similarity to e. herbicola tyrosine permease:hypothetical 48.8 kd protein in ssu81-scs2 intergenic region] [gtcfc:12.6] [keggfc:14.2] [sgdfc:7.11.0:17.0.0] [db:gtc-saccharomyces cerevisiae] |
| CONTIG1878 | 9869051_c2_2 | 6710 | 20813 | 1200 | 400 | YIL088C | 684 | 1.3(10)-77 | Saccharomyces cerevisiae | [ui:yil088c] [pn:weak similarity to a. thaliana aminoacid permease aap4:hypothetical 53.7 kd protein in sga1-sds3 intergenic region] [gtcfc:12.1:11.1] [keggfc:14.2] [sgdfc:7.11.0:17.0.0] [db:gtc-saccharomyces cerevisiae] |
| CONTIG3768 | 816902_c3_4 | 6711 | 20814 | 720 | 240 | YIL006W | 432 | 9.9(10)-41 | Saccharomyces cerevisiae | [ui:yil006w] [pn:similarity to flx1p:putative mitochondrial carrier yil006w] [sgdfc:1.7.4:7.11.0] [keggfc:14.2] [gtcfc:12.6] [db:gtc-saccharomyces cerevisiae] |
| CONTIG3513 | 4970052_c3_10 | 6712 | 20815 | 1452 | 484 | YJR001W | 350 | 6.2(10)-56 | Saccharomyces cerevisiae | [ui:yjr001w] [pn:weak similarity to a. thaliana aminoacid permease aap4:hypothetical 65.3 kd protein in pre3-sag1 intergenic region] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5231 | 5112760_f3_5 | 6713 | 20816 | 1536 | 512 | YJR001W | 865 | 1.3(10)-86 | *Saccharomyces cerevisiae* | [gn:j1409;yjr83] [keggfc:14.2] [sgdfc:7.11.0:17.0.0] [db:gtc-*saccharomyces cerevisiae*] [ui:yjr001w] [pn:weak similarity to *a. thaliana* aminoacid permease aap4:hypothetical 65.3 kd protein in pre3-sag1 intergenic region] [gn:j1409;yjr83] [keggfc:14.2] [sgdfc:7.11.0:17.0.0] [db:gtc-*saccharomyces cerevisiae*] |
| CONTIG1449 | 24422183_f3_2 | 6714 | 20817 | 471 | 157 | YJR124C | 259 | 6.0(10)-22 | *Saccharomyces cerevisiae* | [ui:yjr124c] [pn:weak similarity to staphylococcus multidrug resistance protein:hypothetical 49.7 kd protein in rps5-zms1 intergenic region] [gn:j2046] [gtcfc:12.6] [keggfc:14.2] [sgdfc:7.11.0:17.0.0] [db:gtc-*saccharomyces cerevisiae*] |
| CONTIG1449 | 29687515_f1_1 | 6715 | 20818 | 294 | 98 | YJR124C | 212 | 9.8(10)-17 | *Saccharomyces cerevisiae* | [ui:yjr124c] [pn:weak similarity to staphylococcus multidrug resistance protein:hypothetical 49.7 kd protein in rps5-zms1 intergenic region] [gn:j2046] [gtcfc:12.6] [keggfc:14.2] [sgdfc:7.11.0:17.0.0] [db:gtc-*saccharomyces cerevisiae*] |
| CONTIG3638 | 433325_c2_4 | 6716 | 20819 | 576 | 192 | YJR124C | 401 | 1.8(10)-37 | *Saccharomyces cerevisiae* | [ui:yjr124c] [pn:weak similarity to staphylococcus multidrug resistance protein:hypothetical 49.7 kd protein in rps5-zms1 intergenic region] [gn:j2046] [gtcfc:12.6] [keggfc:14.2] [sgdfc:7.11.0:17.0.0] [db:gtc-*saccharomyces cerevisiae*] |
| CONTIG5664 | 18887_f1_3 | 6717 | 20820 | 1443 | 481 | YJR124C | 573 | 1.1(10)-55 | *Saccharomyces cerevisiae* | [ui:yjr124c] [pn:weak similarity to staphylococcus multidrug resistance protein:hypothetical 49.7 kd protein in rps5-zms1 intergenic region] [gn:j2046] [gtcfc:12.6] [keggfc:14.2] [sgdfc:7.11.0:17.0.0] [db:gtc-*saccharomyces cerevisiae*] |
| CONTIG5288 | 4319661_f3_10 | 6718 | 20821 | 1332 | 444 | YKL221W | 793 | 5.5(10)-79 | *Saccharomyces cerevisiae* | [ui:ykl221w] [pn:weak similarity to human x-linked pest-containing transporter:hypothetical 52.3 kd protein in fre2 5"region] [gtcfc:12.6] [keggfc:14.2] [sgdfc:7.11.0:17.0.0] [db:gtc-*saccharomyces cerevisiae*] |
| CONTIG167 | 11776042_f1_1 | 6719 | 20822 | 864 | 288 | YKL146W | 245 | 3.2(10)-27 | *Saccharomyces cerevisiae* | [ui:ykl146w] [pn:strong similarity to *s. pombe* hypothetical protein c3h1.09c:hypothetical 75.5 kd protein in sdh1-cim5/yta3 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3818 | 32535156_c1_1 | 6720 | 20823 | 432 | 144 | YKL146W | 242 | 1.5(10)-19 | *Saccharomyces cerevisiae* | intergenic region] [gn:ykl600] [gtcfc:12.6] [keggfc:14.2] [sgdfc:7.11.0:17.0.0] [db:gtc-*saccharomyces cerevisia* [ui:ykl146w] [pn:strong similarity to s. pombe hypothetical protein c3h1.09c:hypothetical 75.5 kd protein in sdh1-cim5/yta3 intergenic region] [gn:ykl600] [gtcfc:12.6] [keggfc:14.2] [sgdfc:7.11.0:17.0.0] [db:gtc-*saccharomyces cerevisiae* |
| CONTIG5819 | 4375257_c3_53 | 6721 | 20824 | 1248 | 416 | YKR067W | 711 | 2.7(10)-70 | *Saccharomyces cerevisiae* | [ui:ykr067w] [pn:strong similarity to sct1p:hypothetical 83.6 kd protein in ccp1-sis2 intergenic region] [gtcfc:12.6] [keggfc:14.2] [sgdfc:7.11.0] [db:gtc-*saccharomyces cerevisiae* |
| CONTIG4080 | 19539067_c3_6 | 6722 | 20825 | 1344 | 448 | YNL125C | 561 | 2.1(10)-54 | *Saccharomyces cerevisiae* | [ui:ynl125c] [pn:similarity to ykl221w and human x-linked pest-containing transporter:hypothetical 73.8 kd protein in spc98-tom70 intergenic region] [gn:n1882:n1223:esbp6] [gtcfc:12.6] [keggfc:14.2] [sgdfc:7.11.0:17.0.0] [db:gtc-*sacch* |
| CONTIG4189 | 1455090_f3_2 | 6723 | 20826 | 498 | 166 | YNL125C | 173 | 8.9(10)-16 | *Saccharomyces cerevisiae* | [ui:ynl125c] [pn:similarity to ykl221w and human x-linked pest-containing transporter:hypothetical 73.8 kd protein in spc98-tom70 intergenic region] [gn:n1882:n1223:esbp6] [gtcfc:12.6] [keggfc:14.2] [sgdfc:7.11.0:17.0.0] [db:gtc-*sacch* |
| CONTIG1652 | 20443932_f1_2 | 6724 | 20827 | 690 | 230 | YNL003C | 694 | 1.7(10)-68 | *Saccharomyces cerevisiae* | [ui:ynl003c] [pn:similarity to mitochondrial rat tricarboxylate transport protein precursor:putative mitochondrial carrier protein pet8] [gn:pet8:n2012] [gtcfc:12.6:1.2:12.16] [keggfc:14.2] [sgdfc:7.11.0] [db:gtc-*saccharomyces cerevis* |
| CONTIG1160 | 26582562_f2_2 | 6725 | 20828 | 423 | 141 | YOL119C | 216 | 4.7(10)-17 | *Saccharomyces cerevisiae* | [ui:yol119c] [pn:similarity to monocarboxylate transporter proteins] [gtcfc:12.6] [keggfc:14.2] [sgdfc:7.11.0:17.0.0] [db:*saccharomyces cerevisiae* |
| CONTIG19 | 7051302_c3_1 | 6726 | 20829 | 315 | 105 | YOL119C | 124 | 4.2(10)-7 | *Saccharomyces cerevisiae* | [ui:yol119c] [pn:similarity to monocarboxylate transporter |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4765 | 7051302_c1_7 | 6727 | 20830 | 984 | 328 | YOL119C | 510 | 5.4(10)-49 | Saccharomyces cerevisiae | proteins] [gtcfc:12.6] [keggfc:14.2] [sgdfc:7.11.0:17.0.0] [db:gtc-saccharomyces cerevisiae] [ui:yol119c] [pn:similarity to monocarboxylate transporter proteins] [gtcfc:12.6] |
| CONTIG675 | 5312800_c1_2 | 6728 | 20831 | 1035 | 345 | YOL119C | 322 | 8.5(10)-29 | Saccharomyces cerevisiae | [keggfc:14.2] [sgdfc:7.11.0:17.0.0] [db:gtc-saccharomyces cerevisiae] [ui:yol119c] [pn:similarity to monocarboxylate transporter proteins] [gtcfc:12.6] |
| CONTIG3557 | 20500024_c1_4 | 6729 | 20832 | 1146 | 382 | YOL119C | 716 | 8.0(10)-71 | Saccharomyces cerevisiae | [keggfc:14.2] [sgdfc:7.11.0:17.0.0] [db:gtc-saccharomyces cerevisiae] [ui:yor291w] [pn:similarity to cation translocating atpases] [gtcfc:12.6] [keggfc:14.2] |
| CONTIG4874 | 4117278_c3_6 | 6730 | 20833 | 1848 | 616 | YOR291W | 1395 | 8.9(10)-143 | Saccharomyces cerevisiae | [sgdfc:7.11.0] [db:gtc-saccharomyces cerevisiae] [ui:yor291w] [pn:similarity to cation translocating atpases] [gtcfc:12.6] [keggfc:14.2] |
| CONTIG5817 | 33650312_f2_18 | 6731 | 20834 | 1443 | 481 | YOR291W | 476 | 9.6(10)-59 | Saccharomyces cerevisiae | [sgdfc:7.11.0] [db:gtc-saccharomyces cerevisiae] [ui:yor291w] [pn:similarity to cation translocating atpases] [gtcfc:12.6] [keggfc:14.2] |
| CONTIG5817 | 24398450_f3_38 | 6732 | 20835 | 240 | 80 | YOR291W | 224 | 3.7(10)-17 | Saccharomyces cerevisiae | [sgdfc:7.11.0] [db:gtc-saccharomyces cerevisiae] [ui:yhl017w] [pn:strong similarity to ptm1p:hypothetical 61.2 kd protein in apm2-dur3 intergenic region precursor] [gtcfc:12.6.14.3] |
| CONTIG4492 | 22087875_c2_8 | 6733 | 20836 | 1437 | 479 | YHL017W | 104 | 0.019 | Saccharomyces cerevisiae | [keggfc:14.2] [sgdfc:17.0.0:13.0.0] [db:gtc-saccharomyces cerevisiae] [ui:yhl017w] [pn:strong similarity to ptm1p:hypothetical 61.2 kd protein in apm2-dur3 intergenic region precursor] [gtcfc:12.6.14.3] |
| CONTIG4655 | 24431555_c3_2 | 6734 | 20837 | 1860 | 620 | YHL017W | 692 | 2.7(10)-68 | Saccharomyces cerevisiae | [keggfc:14.2] [sgdfc:17.0.0:13.0.0] [db:gtc-saccharomyces cerevisiae] [ui:yhl017w] [pn:strong similarity to ptm1p:hypothetical 61.2 kd protein in apm2-dur3 intergenic region precursor] [gtcfc:12.6.14.3] |
| CONTIG688 | 24431555_c2_2 | 6735 | 20838 | 447 | 149 | YHL017W | 123 | 6.0(10)-7 | Saccharomyces cerevisiae | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5638 | 23838432_c1_15 | 6736 | 20839 | 1767 | 589 | YCL037C | 96 | 0.05899 | Saccharomyces cerevisiae | [keggfc:14.2] [sgdfc:17.0.0.13.0.0] [db:gtc-saccharomyces cerevisiae] [ui:ycl037c] [pn:suppressor of rho3:hypothetical 51.8 kd protein in glk1-ste50 intergenic region] [gn:sro9;ycl37c] [gtcfc:12.6] [keggfc:14.2] [sgdfc:1.8.1] [db:gtc-saccharomyces cerevisiae] |
| CONTIG2117 | 14100916_f1_1 | 6737 | 20840 | 1107 | 369 | YDR515W | 114 | 0.00056 | Saccharomyces cerevisiae | [ui:ydr515w] [pn:copper homeostasis protein] [gn:slf1] [gtcfc:12.6] [keggfc:14.2] [sgdfc:1.8.1] [db:gtc-saccharomyces cerevisiae] |
| CONTIG4560 | 24095311_f2_1 | 6738 | 20841 | 336 | 112 | YFL041W | 217 | 5.9(10)-17 | Saccharomyces cerevisiae | [ui:yfl041w] [pn:strong similarity to cell surface ferroxidase precursor fet3p:hypothetical 70.9 kd protein in sec53-act1 intergenic region precursor] [gtcfc:12.6] [keggfc:14.2] [sgdfc:1.8.1] [db:gtc-saccharomyces cerevisiae] |
| CONTIG5327 | 25994007_f3_5 | 6739 | 20842 | 1617 | 539 | YGL160W | 310 | 7.5(10)-32 | Saccharomyces cerevisiae | [ui:ygl160w] [pn:similarity to hypothetical protein ylr047c and fre2p:hypothetical 65.8 kd protein in sut1-rck1 intergenic region] [gn:g1837] [gtcfc:12.6] [keggfc:14.2] [sgdfc:1.8.1] [db:gtc-saccharomyces cerevisiae] |
| CONTIG2454 | 6906942_c1_3 | 6740 | 20843 | 1137 | 379 | YJR049C | 246 | 3.1(10)-34 | Saccharomyces cerevisiae | [ui:yjr049c] [pn:associated with ferric reductase activity:utr1 protein:unknown transcript 1 protein] [gn:utr1;j1655] [gtcfc:12.6] [keggfc:14.2] [sgdfc:1.8.1] [db:gtc-saccharomyces cerevisiae] |
| CONTIG5618 | 24470936_c2_21 | 6741 | 20844 | 1026 | 342 | YJR049C | 671 | 4.7(10)-66 | Saccharomyces cerevisiae | [ui:yjr049c] [pn:associated with ferric reductase activity:utr1 protein:unknown transcript 1 protein] [gn:utr1;j1655] [gtcfc:12.6] [keggfc:14.2] [sgdfc:1.8.1] [db:gtc-saccharomyces cerevisiae] |
| CONTIG1675 | 32507707_f3_2 | 6742 | 20845 | 915 | 305 | YJR126C | 450 | 7.4(10)-42 | Saccharomyces cerevisiae | [ui:yjr126c] [pn:similarity to human prostate-specific membrane antigen and transferrin receptor protein:hypothetical 92.0 kd protein in rps5-zms1 intergenic region] [gn:j2050] [gtcfc:12.6] [keggfc:14.2] [sgdfc:1.8.1] [db:gtc-saccharo |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2183 | 10658266_f1_2 | 6743 | 20846 | 1584 | 528 | YJR126C | 247 | 3.8(10)-31 | Saccharomyces cerevisiae | [ui:yjr126c] [pn:similarity to human prostate-specific membrane antigen and transferrin receptor protein:hypothetical 92.0 kd protein in rps5-zms1 intergenic region] [gn:j2050] [gtcfc:12.6] [keggfc:14.2] [sgdfc:1.8.1] [dbgtc-saccharo |
| b2x15488.y | 881262_c3_2 | 6744 | 20847 | 276 | 92 | YJR126C | 130 | 1.8(10)-7 | Saccharomyces cerevisiae | [ui:yjr126c] [pn:similarity to human prostate-specific membrane antigen and transferrin receptor protein:hypothetical 92.0 kd protein in rps5-zms1 intergenic region] [gn:j2050] [gtcfc:12.6] [keggfc:14.2] [sgdfc:1.8.1] [dbgtc-saccharo |
| CONTIG3296 | 978125_c1_5 | 6745 | 20848 | 1023 | 341 | YLL051C | 136 | 5.2(10)-6 | Saccharomyces cerevisiae | [ui:yll051c] [pn:strong similarity to ferric reductase fre2p] [gtcfc:12.6] [keggfc:14.2] [sgdfc:1.8.1] [dbgtc-saccharomyces cerevisiae] |
| CONTIG2351 | 34553768_c2_6 | 6746 | 20849 | 2178 | 726 | YNR060W | 801 | 7.7(10)-80 | Saccharomyces cerevisiae | [ui:ynr060w] [pn:strong similarity to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc |
| CONTIG3089 | 5906687_c1_3 | 6747 | 20850 | 837 | 279 | YNR060W | 348 | 5.9(10)-31 | Saccharomyces cerevisiae | [ui:ynr060w] [pn:strong similarity to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc |
| CONTIG4409 | 16609568_f1_1 | 6748 | 20851 | 1800 | 600 | YNR060W | 628 | 3.2(10)-73 | Saccharomyces cerevisiae | [ui:ynr060w] [pn:strong similarity to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc |
| CONTIG4657 | 24414812_f1_1 | 6749 | 20852 | 1560 | 520 | YNR060W | 701 | 3.1(10)-69 | Saccharomyces cerevisiae | [ui:ynr060w] [pn:strong similarity to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc |
| CONTIG4589 | 23484552_f1_1 | 6750 | 20853 | 1296 | 432 | YNR060W | 283 | 1.2(10)-22 | Saccharomyces cerevisiae | [ui:ynr060w] [pn:strong similarity |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4620 | 2343803_f1_1 | 6751 | 20854 | 1650 | 550 | YNR060W | 705 | 1.2(10)-69 | Saccharomyces cerevisiae | to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc-[ui:ynr060w] [pn:strong similarity to fre2p and hypothetical protein yor381w, and similarity to fre1p:hypothetical 82.0 kd protein in bio3-hxt17 intergenic region precursor] [gn:n3518] [gtcfc:12.6] [keggfc:14.2] [sgdfc:1.8.1] [dbgtc-saccharomyces cerevisiae] |
| CONTIG2018 | 2401017_f2_1 | 6752 | 20855 | 903 | 301 | YOR381W | 415 | 2.7(10)-38 | Saccharomyces cerevisiae | [ui:yor381w] [pn:strong similarity to ferric reductase fre2p] [gtcfc:12.6] [keggfc:14.2] [sgdfc:1.8.1] [db-gtc-saccharomyces cerevisiae] |
| CONTIG1464 | 6742183_f2_2 | 6753 | 20856 | 822 | 274 | YOR381W | 257 | 3.7(10)-21 | Saccharomyces cerevisiae | [ui:yor381w] [pn:strong similarity to ferric reductase fre2p] [gtcfc:12.6] [keggfc:14.2] [sgdfc:1.8.1] [db-gtc-saccharomyces cerevisiae] |
| CONTIG2530 | 1995906_c2_5 | 6754 | 20857 | 2043 | 681 | YOR381W | 715 | 1.0(10)-70 | Saccharomyces cerevisiae | [ui:yor381w] [pn:strong similarity to ferric reductase fre2p] [gtcfc:12.6] [keggfc:14.2] [sgdfc:1.8.1] [db-gtc-saccharomyces cerevisiae] |
| CONTIG4317 | 1953885_f3_2 | 6755 | 20858 | 2097 | 699 | YOR381W | 746 | 5.2(10)-74 | Saccharomyces cerevisiae | [ui:yor381w] [pn:strong similarity to ferric reductase fre2p] [gtcfc:12.6] [keggfc:14.2] [sgdfc:1.8.1] [db-gtc-saccharomyces cerevisiae] |
| CONTIG5391 | 12597202_c3_21 | 6756 | 20859 | 1119 | 373 | YOR384W | 232 | 9.6(10)-19 | Saccharomyces cerevisiae | [ui:yor384w] [pn:strong similarity to ferric reductase fre2p] [gtcfc:12.6] [keggfc:14.2] [sgdfc:1.8.1] [db-gtc-saccharomyces cerevisiae] |
| CONTIG5247 | 30703938_c2_19 | 6757 | 20860 | 1221 | 407 | YPR129W | 200 | 1.8(10)-31 | Saccharomyces cerevisiae | [ui:ypr129w] [pn:suppressor of clathrin deficiency:scd6 protein] [gn:scd6:p9659] [gtcfc:12.6] [keggfc:14.2] [sgdfc:8.7.0] [dbgtc-saccharomyces cerevisiae] |
| CONTIG2449 | 13863760_f3_2 | 6758 | 20861 | 558 | 186 | YLR109W | 261 | 1.3(10)-22 | Saccharomyces cerevisiae | [ui:ylr109w] [pnsimilarity to c. boidinii peroxisomal membrane protein 20k aputative peroxisomal membrane protein] [gn:2916i9354] [gtcfc:14.2] [sgdfc:9.8.0] [dbgtc- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4653 | 13070413_f3_6 | 6759 | 20862 | 633 | 211 | YLR109W | 187 | 9.0(10)-15 | *Saccharomyces cerevisiae* | [ui:ylr109w] [pn:similarity to c. boidinii peroxisomal membrane protein 20k aputative peroxisomal membrane protein] [gn:l2916|9354] [gtcfc:14.2] [keggfc:12.6] [sgdfc:9.8.0] [db:gtc-saccharomyces cerevisiae] |
| CONTIG5494 | 14556527_f1_1 | 6760 | 20863 | 738 | 246 | YLR251W | 184 | 2.5(10)-26 | *Saccharomyces cerevisiae* | [ui:ylr251w] [pn:similarity to peroxisomal rat membrane protein pmp22] [gtcfc:12.6] [keggfc:14.2] [sgdfc:9.8.0] [db:gtc-saccharomyces cerevisiae] |
| CONTIG5494 | 23990636_f1_2 | 6761 | 20864 | 675 | 225 | YLR251W | 319 | 9.4(10)-29 | *Saccharomyces cerevisiae* | [ui:ylr251w] [pn:similarity to peroxisomal rat membrane protein pmp22] [gtcfc:12.6] [keggfc:14.2] [sgdfc:9.8.0] [db:gtc-saccharomyces cerevisiae] |
| CONTIG540 | 23626625_c3_3 | 6762 | 20865 | 483 | 161 | YOL147C | 150 | 7.5(10)-11 | *Saccharomyces cerevisiae* | [ui:yol147c] [pn:peroxisomal membrane protein] [gn:pmp27] [gtcfc:12.6] [keggfc:14.2] [sgdfc:9.8.0] [db:gtc-saccharomyces cerevisiae] |
| CONTIG3007 | 4485902_f1_2 | 6763 | 20866 | 549 | 183 | YDL127W | 391 | 2.2(10)-36 | *Saccharomyces cerevisiae* | [ui:ydl127w] [pn:cyclin, g1/s-specific cyclin pcl2:cyclin hcs26 homolog] [gn:pcl2:cln4] [gtcfc:12.8] [keggfc:13.1] [sgdfc:3.8.0] [db:gtc-saccharomyces cerevisiae] |
| CONTIG4591 | 4475176_c3_8 | 6764 | 20867 | 1146 | 382 | YDL127W | 348 | 7.9(10)-32 | *Saccharomyces cerevisiae* | [ui:ydl127w] [pn:cyclin, g1/s-specific cyclin pcl2:cyclin hcs26 homolog] [gn:pcl2:cln4] [gtcfc:12.8] [keggfc:13.1] [sgdfc:3.8.0] [db:gtc-saccharomyces cerevisiae] |
| CONTIG1013 | 24698791_f2_1 | 6765 | 20868 | 708 | 236 | Q02959 | 438 | 7.0(10)-41 | *Saccharomyces cerevisiae* | [gn:hos3:ypl116w:lph11w] [sr:baker"s yeast] [de:hos3 protein] [sp:q02959] [db:swissprot] |
| b2x12717.y | 10558180_f3_1 | 6766 | 20869 | 528 | 176 | Q02959 | 451 | 2.5(10)-42 | *Saccharomyces cerevisiae* | [gn:hos3:ypl116w:lph11w] [sr:baker"s yeast] [de:hos3 protein] [sp:q02959] [db:swissprot] |
| CONTIG5811 | 1273292_f3_16 | 6767 | 20870 | 1326 | 442 | S74213 | 1059 | 3.6(10)-107 | *Methylophilus methylotrophus* | [pn:formamidase, a] [gn:fmda] [ec:3.5.1.49] [db:pir] |
| b3x16051.y | 23562594_c2_3 | 6768 | 20871 | 216 | 72 | S72165 | 106 | 8.9(10)-6 | *Rhizobium leguminosarum* | [pn:probable alcohol dehydrogenase] [db:pir] |
| CONTIG3137 | 4728300_f3_3 | 6769 | 20872 | 225 | 75 | E69538 | 92 | 0.00129 | *Archaeoglobus fulgidus* | [pn:conserved hypothetical transmembrane protein af2309] [db:pir] |
| CONTIG4762 | 22438207_c1_12 | 6770 | 20873 | 420 | 140 | S78075 | 238 | 3.6(10)-20 | *Saccharomyces cerevisiae* | [pn:hypothetical protein yjr135w- |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5765 | 24489665_f2_6 | 6771 | 20874 | 570 | 190 | S78074 | 309 | 1.1(10)-27 | Saccharomyces cerevisiae | a [db:pir] [pn:hypothetical protein ykl053c-a] [db:pir] [mp:10r] |
| CONTIG4792 | 16251002_f1_1 | 6772 | 20875 | 2436 | 812 | S71461 | 180 | 3.6(10)-11 | Coprinus cinereus | [pn:rad9 protein] [db:pir] |
| CONTIG4237 | 954687_c1_5 | 6773 | 20876 | 357 | 119 | JC5710 | 98 | 6.2(10)-5 | Mus musculus | [pn:tat binding protein-1 interacting protein] [sr, house mouse] [db:pir] |
| CONTIG5502 | 14881512_f1_1 | 6774 | 20877 | 777 | 259 | S71489 | 321 | 9.8(10)-29 | Rattus norvegicus | [pn:sulfoalanine decarboxylase, ] [sr, norway rat] [ec:4.1.1.29] [db:pir] |
| CONTIG4934 | 29376628_f1_1 | 6775 | 20878 | 2859 | 953 | AF036485 | 95 | 0.07499 | no gb taxonomy match | [pn:unknown] [db:genpept-bct] [de:plasmid pnz4000 replication protein (repb2) gene, complete cds; andunknown gene.] [nt:orfc2] |
| CONTIG5610 | 21679692_f2_4 | 6776 | 20879 | 1047 | 349 | U53868 | 95 | 0.16 | Clostridium acetobutylicum | [pn:mtlr] [gn:mtlr] [sr:clostridium acetobutylicum strain=dsm 792] [db:genpept-bct] [de:clostridium acetobutylicum mannitol-specific phosphotransferasesystem (pts) system, mtla, mtlr, mtlf, and mtld genes, completecds.] [nt:putative p |
| CONTIG125 | 627291_f3_1 | 6777 | 20880 | 594 | 198 | AL021287 | 181 | 3.2(10)-13 | Mycobacterium tuberculosis | [pn:monoxygenase] [gn:mtv012.64c] [db:genpept-bct] [de:mycobacterium tuberculosis sequence v012.] [nt:mtv012.64c, len: 524. probable monoxygenase, |
| CONTIG2722 | 29898518_f1_1 | 6778 | 20881 | 360 | 120 | AL021287 | 92 | 0.00129 | Mycobacterium tuberculosis | [pn:monoxygenase] [gn:mtv012.64c] [db:genpept-bct] [de:mycobacterium tuberculosis sequence v012.] [nt:mtv012.64c, len: 524. probable monoxygenase, |
| CONTIG5776 | 5179031_c2_28 | 6779 | 20882 | 762 | 254 | AL021287 | 308 | 4.4(10)-27 | Mycobacterium tuberculosis | [pn:monoxygenase] [gn:mtv012.64c] [db:genpept-bct] [de:mycobacterium tuberculosis sequence v012.] [nt:mtv012.64c, len: 524. probable monoxygenase, |
| CONTIG573 | 35437539_c1_2 | 6780 | 20883 | 1029 | 343 | AL021287 | 400 | 2.3(10)-37 | Mycobacterium tuberculosis | [pn:monoxygenase] [gn:mtv012.64c] [db:genpept-bct] [de:mycobacterium tuberculosis sequence v012.] [nt:mtv012.64c, len: 524. probable monoxygenase, |
| CONTIG5133 | 11753752_f3_4 | 6781 | 20884 | 984 | 328 | AL021841 | 224 | 1.1(10)-18 | Mycobacterium tuberculosis | [pn:hypothetical protein mtv016.42] [gn:mtv016.42] [db:genpept-bct] [de:mycobacterium tuberculosis sequence v016.] [nt:mtv016.42, len: 243. unknown but some similarity to] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4574 | 34250002_f1_1 | 6782 | 20885 | 2475 | 825 | AL021942 | 419 | 4.5(10)-36 | *Mycobacterium tuberculosis* | [pn:hypothetical protein] [gn:mtv039.22] [db:genpept-bct] [de:mycobacterium tuberculosis sequence v039.] [nt:mtv039.22, 1en: 877, unknown. contains ps00699] |
| CONTIG5446 | 24650037_c1_7 | 6783 | 20886 | 240 | 80 | AF036171 | 95 | 0.00062 | *Dictyostelium discoideum* | [pn:homeobox-containing protein] [gn:hbx-2] [db:genpept-inv] [de:dictyostelium discoideum homeobox-containing protein (hbx-2) mrna, partial cds.] |
| CONTIG2839 | 3941375_c3_8 | 6784 | 20887 | 1053 | 351 | AF051898 | 102 | 0.01499 | *Dictyostelium discoideum* | [pn:coronin binding protein] [gn:db10] [db:genpept-inv] [de:dictyostelium discoideum coronin binding protein (db10) mrna, complete cds.] |
| b2x13496.x | 24117127_c3_2 | 6785 | 20888 | 681 | 227 | Z83109 | 90 | 0.51 | *Caenorhabditis elegans* | [pn:f44g3.8] [db:genpept-inv] [de:caenorhabditis elegans cosmid f44g3, complete sequence.] |
| CONTIG1133 | 6131312_f3_1 | 6786 | 20889 | 642 | 214 | AF043699 | 192 | 7.7(10)-14 | *Caenorhabditis elegans* | [pn:k02f2.3] [sr:caenorhabditis elegans strain=bristol n2] [db:genpept-inv] [de:caenorhabditis elegans cosmid k02f2.] [nt:similar to a human orf (gb:d13642) and human] |
| b1x13240.x | 24807651_f3_1 | 6787 | 20890 | 732 | 244 | AF043699 | 271 | 2.8(10)-22 | *Caenorhabditis elegans* | [pn:k02f2.3] [sr:caenorhabditis elegans strain=bristol n2] [db:genpept-inv] [de:caenorhabditis elegans cosmid k02f2.] [nt:similar to a human orf (gb:d13642) and human] |
| b1x13240.y | 11765686_c1_1 | 6788 | 20891 | 594 | 198 | AF043699 | 342 | 7.7(10)-30 | *Caenorhabditis elegans* | [pn:k02f2.3] [sr:caenorhabditis elegans strain=bristol n2] [db:genpept-inv] [de:caenorhabditis elegans cosmid k02f2.] [nt:similar to a human orf (gb:d13642) and human] |
| CONTIG4777 | 34252143_c3_11 | 6789 | 20892 | 210 | 70 | AL021481 | 100 | 0.00021 | *Caenorhabditis elegans* | [pn:y43f4b.5] [db:genpept-inv] [de:caenorhabditis elegans cosmid y43f4b, complete sequence.] |
| CONTIG5500 | 35603436_f1_3 | 6790 | 20893 | 909 | 303 | Z82287 | 141 | 3.1(10)-7 | *Caenorhabditis elegans* | [pn:zk550.b] [db:genpept-inv] [de:caenorhabditis elegans cosmid zk550, complete sequence.] [nt:protein predicted using genefinder; preliminary] |
| CONTIG4756 | 4022311_c1_10 | 6791 | 20894 | 285 | 95 | Z98269 | 171 | 4.5(10)-13 | *Drosophila melanogaster* | [gn:eg:87b1.6] [db:genpept-inv] [de:drosophila melanogaster cosmid 87b1.] |
| CONTIG4769 | 14726437_c2_8 | 6792 | 20895 | 2088 | 696 | AL022018 | 103 | 0.07099 | *Drosophila* | [gn:eg:8d8.4] [sr:fruit fly] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3480 | 4453186_f3_2 | 6793 | 20896 | 2217 | 739 | U86010 | 92 | 0.87 | Drosophila melanogaster | [db:genpept-inv] [de:drosophila melanogaster cosmid 8d8.] [nt:1-evidence=predicted by content;] [pn:zinc-finger nuclear protein hindsight] [gn:hindsight] [sr:fruit fly] [db:genpept-inv] [de:drosophila zinc-finger nuclear protein hindsight, complete cds.] [nt:required for germ band retraction during drosophila] |
| CONTIG4924 | 24099031_c3_12 | 6794 | 20897 | 930 | 310 | AB006362 | 1019 | 6.2(10)-103 | Candida albicans | [gn:casln1] [sr:candida albicans dna] [db:genpept-pln] [de:candida albicans casln1 gene, complete cds.] [nt:similar to sln1p of s. cerevisiae] |
| CONTIG5238 | 34650257_f3_3 | 6795 | 20898 | 1851 | 617 | AB006362 | 2584 | 9.0(10)-269 | Candida albicans | [gn:casln1] [sr:candida albicans dna] [db:genpept-pln] [de:candida albicans casln1 gene, complete cds.] [nt:similar to sln1p of s. cerevisiae] |
| CONTIG5238 | 9953800_f3_4 | 6796 | 20899 | 186 | 62 | AB006362 | 249 | 7.5(10)-20 | Candida albicans | [gn:casln1] [sr:candida albicans dna] [db:genpept-pln] [de:candida albicans casln1 gene, complete cds.] [nt:similar to sln1p of s. cerevisiae] |
| CONTIG4924 | 31925174_c1_10 | 6797 | 20900 | 1020 | 340 | AB006362 | 1109 | 1.8(10)-112 | Candida albicans | [gn:casln1] [sr:candida albicans dna] [db:genpept-pln] [de:candida albicans casln1 gene, complete cds.] [nt:similar to sln1p of s. cerevisiae] |
| CONTIG2524 | 25673907_f2_1 | 6798 | 20901 | 729 | 243 | AB006363 | 1079 | 2.7(10)-109 | Candida albicans | [gn:canik1] [sr:candida albicans dna] [db:genpept-pln] [de:candida albicans canik1 gene, complete cds.] [nt:homologue of histidine kinase] |
| CONTIG704 | 402082_f2_1 | 6799 | 20902 | 282 | 94 | AB006363 | 250 | 4.2(10)-20 | Candida albicans | [gn:canik1] [sr:candida albicans dna] [db:genpept-pln] [de:candida albicans canik1 gene, complete cds.] [nt:homologue of histidine kinase] |
| CONTIG704 | 3131388_f3_2 | 6800 | 20903 | 1197 | 399 | AB006363 | 1548 | 5.5(10)-159 | Candida albicans | [gn:canik1] [sr:candida albicans dna] [db:genpept-pln] [de:candida albicans canik1 gene, complete cds.] [nt:homologue of histidine kinase] |
| b9x13n67.x | 29315663_c3_3 | 6801 | 20904 | 696 | 232 | AB006363 | 922 | 1.2(10)-92 | Candida albicans | [gn:canik1] [sr:candida albicans dna] [db:genpept-pln] [de:candida albicans canik1 gene, complete cds.] [nt:homologue of histidine kinase] |
| CONTIG553 | 25587591_f2_2 | 6802 | 20905 | 195 | 65 | AB010636 | 139 | 4.9(10)-9 | Candida parapsilosis | [pn:sadh] [gn:sadh] [db:genpept-pln] [de:candida parapsilosis dna] [db:genpept-pln] [de:candida parapsilosis gene for |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5661 | 22437512_c3_15 | 6803 | 20906 | 1146 | 382 | AB010636 | 1187 | 9.8(10)-121 | Candida parapsilosis | sadh, complete cds.] [pn:ssadh] [gn:ssadh] [sr:candida parapsilosis dna] [db:genpept-pln] [de:candida parapsilosis gene for sadh, complete cds.] |
| CONTIG3416 | 157892_f2_3 | 6804 | 20907 | 1095 | 365 | AF013273 | 1664 | 1.8(10)-170 | Candida albicans | [pn:histidine kinase 1] [db:genpept-pln] [de:candida albicans histidine kinase 1 gene, complete cds.] [nt:two-component phopho-relay protein homolog; cahk1] |
| CONTIG4713 | 5079500_f2_1 | 6805 | 20908 | 3003 | 1001 | AF013273 | 4730 | 0 | Candida albicans | [pn:histidine kinase 1] [db:genpept-pln] [de:candida albicans histidine kinase 1 gene, complete cds.] [nt:two-component phopho-relay protein homolog; cahk1] |
| CONTIG4845 | 9821038_c1_4 | 6806 | 20909 | 3009 | 1003 | AF013273 | 5056 | 0 | Candida albicans | [pn:histidine kinase 1] [db:genpept-pln] [de:candida albicans histidine kinase 1 gene, complete cds.] [nt:two-component phopho-relay protein homolog; cahk1] |
| CONTIG1906 | 24422265_c2_4 | 6807 | 20910 | 672 | 224 | AF038152 | 408 | 1.1(10)-52 | Mycosphaerella graminicola | [pn:4-hydroxyphenylpyruvate dioxygenase] [gn:hppd] [fn:converts 4-hydroxyphenylpyruvate to hydroxyphenylpyruvate] [ec:1.13.11.27] [db:genpept-pln] [de:mycosphaerella graminicola 4-hydroxyphenylpyruvate dioxygenase(hppd) gene, complete cds.] [nt:tyrosine ca |
| CONTIG5194 | 835177_f2_2 | 6808 | 20911 | 834 | 278 | AF038154 | 1171 | 4.9(10)-119 | Candida albicans | [pn:14-3-3 protein] [gn:bmh] [db:genpept-pln] [de:candida albicans 14-3-3 protein (bmh) gene, complete cds.] |
| CONTIG5598 | 34157200_f3_15 | 6809 | 20912 | 471 | 157 | AF042334 | 151 | 2.7(10)-10 | Arabidopsis thaliana | [pn:jab1] [gn:jab1] [sr:thale cress] [db:genpept-pln] [de:arabidopsis thaliana jab1 (jab1) mrna, complete cds.] [nt:similar to jun activation domain binding protein] |
| CONTIG5598 | 26272312_f2_9 | 6810 | 20913 | 918 | 306 | AF042334 | 410 | 2.1(10)-38 | Arabidopsis thaliana | [pn:jab1] [gn:jab1] [sr:thale cress] [db:genpept-pln] [de:arabidopsis thaliana jab1 (jab1) mrna, complete cds.] [nt:similar to jun activation domain binding protein] |
| CONTIG128 | 25407686_c3_1 | 6811 | 20914 | 522 | 174 | AF043330 | 150 | 4.5(10)-10 | Candida albicans | [pn:secreted aspartyl proteinase] [gn:sap8] [db:genpept-pln] [de:candida albicans secreted aspartyl proteinase (sap8) gene, completecds.] [nt:sap8] |
| CONTIG776 | 4798431_c2_1 | 6812 | 20915 | 666 | 222 | AF043330 | 915 | 6.5(10)-92 | Candida | [pn:secreted aspartyl proteinase] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4521 | 9843750_c3_5 | 6813 | 20916 | 1713 | 571 | AF043331 | 2215 | 1.1(10)-229 | Candida albicans | [gn:sap8] [db:genpept-pln] [de:candida albicans secreted aspartyl proteinase (sap8) gene, completecds.] [nt:sap8p] |
| b3x13783.y | 35803410_f3_1 | 6814 | 20917 | 366 | 122 | AF043331 | 101 | 0.00013 | Candida albicans | [pn:secreted aspartyl proteinase] [gn:sap9] [db:genpept-pln] [de:candida albicans secreted aspartyl proteinase (sap9) gene, completecds.] [nt:sap9p] |
| CONTIG4761 | 4507692_c3_8 | 6815 | 20918 | 942 | 314 | AF045774 | 1603 | 8.0(10)-165 | Candida albicans | [pn:secreted aspartyl proteinase] [gn:sap9] [db:genpept-pln] [de:candida albicans secreted aspartyl proteinase (sap9) gene, completecds.] [nt:sap9p] |
| b2x15833.x | 2390833_f2_1 | 6816 | 20919 | 504 | 168 | AF045774 | 524 | 1.8(10)-50 | Candida albicans | [pn:sir2] [gn:sir2] [db:genpept-pln] [de:candida albicans sir2 (sir2) gene, complete cds.] [nt:similar to saccharomyces cerevisiae sir2] |
| CONTIG1957 | 1094512_f2_1 | 6817 | 20920 | 585 | 195 | AF049069 | 622 | 7.2(10)-61 | Pinus radiata | [pn:sir2] [gn:sir2] [db:genpept-pln] [de:candida albicans sir2 (sir2) gene, complete cds.] [nt:similar to saccharomyces cerevisiae sir2] |
| CONTIG4287 | 33360900_c1_8 | 6818 | 20921 | 1497 | 499 | AJ223459 | 360 | 4.5(10)-31 | Emericella nidulans | [gn:pre87] [sr:monterey pine] [db:genpept-pln] [de:pinus radiata pre87 mrna, complete cds.] |
| CONTIG1313 | 175765_c2_3 | 6819 | 20922 | 771 | 257 | AJ223508 | 435 | 5.7(10)-40 | Arabidopsis thaliana | [pn:prna protein] [gn:prna] [fn:transcriptional activator] [db:genpept-pln] [de:aspergillus nidulans prna gene.] |
| b2x14678.y | 25651050_f2_1 | 6820 | 20923 | 855 | 285 | AC002334 | 96 | 0.11 | Arabidopsis thaliana | [pn:zwille protein] [gn:zwille] [sr:thale cress] [db:genpept-pln] [de:arabidopsis thaliana mrna for zwille protein.] |
| CONTIG4766 | 16021900_c3_7 | 6821 | 20924 | 849 | 283 | AC002340 | 242 | 4.4(10)-20 | Arabidopsis thaliana | [pn:similar to disease resistance protein] [gn:f25118.21] [sr:thale cress] [db:genpept-pln] [de:arabidopsis thaliana chromosome ii bac f25118 genomic sequence,complete sequence.] |
| CONTIG2283 | 36117000_c3_4 | 6822 | 20925 | 1002 | 334 | AC002561 | 571 | 7.7(10)-54 | Arabidopsis thaliana | [gn:t11j7.11] [sr:thale cress] [db:genpept-pln] [de:arabidopsis thaliana chromosome ii bac t11j7 genomic sequence,complete sequence.] [nt:hypothetical protein] |
| | | | | | | | | | | [pn:putative atp-dependent rna helicase] [gn:t24p15.18] [sr:thale cress] [db:genpept-pln] [de:arabidopsis thaliana chromosome ii bac t24p15 |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4297 | 22710042_c3_7 | 6823 | 20926 | 1017 | 339 | AC003033 | 103 | 0.029 | *Arabidopsis thaliana* | genomic sequence,complete sequence.] [pn:putative disease resistance protein (cf-2.2)] [gn:t21114.4] [sr:thale cress] [db:genpept-pln] [de:*arabidopsis thaliana* chromosome ii bac t21114 genomic sequence,complete sequence.] |
| CONTIG4144 | 822026_f3_3 | 6824 | 20927 | 873 | 291 | AC003673 | 201 | 4.4(10)-23 | *Arabidopsis thaliana* | [gn:f19f24.4] [sr:thale cress] [db:genpept-pln] [de:*arabidopsis thaliana* chromosome ii bac f19f24 genomic sequence,complete sequence.] [nt:unknown protein] |
| CONTIG2776 | 522953_c2_7 | 6825 | 20928 | 1632 | 544 | AI021768 | 94 | 0.0057 | *Arabidopsis thaliana* | [pn:resistance protein rpp5 - like] [gn:f24j7.80] [sr:thale cress] [db:genpept-pln] [de:*arabidopsis thaliana* dna chromosome 4, bac clone f24j7 (essaiiproject).] [nt:similarity to downy mildew resistance protein rpp5,] |
| CONTIG4818 | 392055_c2_8 | 6826 | 20929 | 972 | 324 | AI021890 | 99 | 4.4(10)-7 | *Arabidopsis thaliana* | [pn:putative protein] [gn:t1o5.20] [sr:thale cress] [db:genpept-pln] [de:*arabidopsis thaliana* dna chromosome 4, bac clone t1o5 (essaiiproject).] [nt:similarity to nadh dehydrogenase chain 4,] |
| CONTIG3745 | 26572343_c3_9 | 6827 | 20930 | 222 | 74 | Y17007 | 221 | 3.7(10)-17 | *Candida albicans* | [pn:piruvate decarboxylase] [gn:pdc2] [db:genpept-pln] [de:*candida albicans* pdc2 gene.] |
| CONTIG3745 | 36365936_c3_8 | 6828 | 20931 | 1980 | 660 | Y17007 | 3094 | 0 | *Candida albicans* | [pn:piruvate decarboxylase] [gn:pdc2] [db:genpept-pln] [de:*candida albicans* pdc2 gene.] |
| CONTIG3703 | 7063438_c1_6 | 6829 | 20932 | 477 | 159 | AJ222805 | 637 | 1.8(10)-62 | *Candida albicans* | [pn:srp54 protein] [gn:srp54] [fn:54 kd subunit of the signal recognition] [db:genpept-pln] [de:*candida albicans* mrna for srp54 protein homologue.] |
| CONTIG4262 | 25445438_f1_2 | 6830 | 20933 | 936 | 312 | U84588 | 97 | 0.00016 | *Candida albicans* | [db:genpept-pln] [de:*candida albicans* dihydrofolate reductase (dfr1) gene, complete cds.] [nt:orf1] |
| CONTIG4297 | 3914061_c3_6 | 6831 | 20934 | 837 | 279 | U84588 | 91 | 0.00063 | *Candida albicans* | [db:genpept-pln] [de:*candida albicans* dihydrofolate reductase (dfr1) gene, complete cds.] [nt:orf1] |
| CONTIG4915 | 23609406_c2_9 | 6832 | 20935 | 1185 | 395 | U84588 | 122 | 4.5(10)-7 | *Candida albicans* | [db:genpept-pln] [de:*candida albicans* dihydrofolate reductase (dfr1) gene, complete cds.] [nt:orf1] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5656 | 9820801_f2_8 | 6833 | 20936 | 1734 | 578 | U84588 | 403 | 1.2(10)-37 | *Candida albicans* | [db:genpept-pln] [de:*candida albicans* dihydrofolate reductase (dfr1) gene, complete cds.] [nt:orf1] |
| CONTIG5656 | 3163432_c1_15 | 6834 | 20937 | 585 | 195 | U84588 | 993 | 3.5(10)-100 | *Candida albicans* | [pn:dihydrofolate reductase] [gn:dfr1] [db:genpept-pln] [de:*candida albicans* dihydrofolate reductase (dfr1) gene, complete cds.] |
| CONTIG5021 | 15891378_c3_12 | 6835 | 20938 | 1068 | 356 | U96385 | 97 | 0.014 | *Penicillium chrysogenum* | [pn:gata transcription factor] [gn:nreb] [db:genpept-pln] [de:*penicillium chrysogenum* gata transcription factor (nreb) gene,complete cds.] [nt:nreb; nitrogen regulatory gata factor] |
| CONTIG5116 | 16605035_c1_7 | 6836 | 20939 | 2448 | 816 | Z97209 | 100 | 0.035 | *Schizosaccharomyces pombe* | [pn:hypothetical protein] [gn:spac19g12.17c] [sr:fission yeast] [db:genpept-pln] [de:*s. pombe* chromosome i cosmid c19g12.] [nt:spac19g12.17c, partial; unknown, len:223aa, similar] |
| CONTIG3661 | 4381317_f2_1 | 6837 | 20940 | 354 | 118 | AI009227 | 104 | 5.7(10)-6 | *Schizosaccharomyces pombe* | [pn:hypothetical protein] [gn:spac27d7.04] [sr:fission yeast] [db:genpept-pln] [des. *pombe* chromosome i cosmid c27d7.] [nt:spac27d7.04, unknown, len:96aa, similar eg. to] |
| CONTIG2520 | 24020463_c3_3 | 6838 | 20941 | 873 | 291 | AI021817 | 105 | 0.00169 | *Schizosaccharomyces pombe* | [pn:hypothetical protein] [gn:spac8e11.05c] [sr:fission yeast] [db:genpept-pln] [de:*s. pombe* chromosome i cosmid c8e11.] [nt:spac8e11.05c, unknown, len:338aa] |
| CONTIG4146 | 19923386_f1_1 | 6839 | 20942 | 735 | 245 | AI022117 | 642 | 5.5(10)-63 | *Schizosaccharomyces pombe* | [pn:putative o-methyltransferase] [gn:spbc119.03] [sr:fission yeast] [db:genpept-pln] [des. *pombe* chromosome ii cosmid c119.] [nt:spbc119.03, putative o-methyltransferase,] |
| CONTIG5242 | 26375057_f1_1 | 6840 | 20943 | 729 | 243 | AI022305 | 464 | 4.0(10)-44 | *Schizosaccharomyces pombe* | [pn:hypothetical protein] [gn:spbc14c8.06] [sr:fission yeast] [db:genpept-pln] [des. *pombe* chromosome ii cosmid c14c8.] [nt:spbc14c8.06, unknown, len:377aa, similar eg. to h.] |
| CONTIG2785 | 14242216_c2_4 | 6841 | 20944 | 1191 | 397 | AI022305 | 330 | 1.0(10)-39 | *Schizosaccharomyces pombe* | [pn:hypothetical protein] [gn:spbc14c8.14c] [sr:fission yeast] [db:genpept-pln] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4913 | 214583_c2_9 | 6842 | 20945 | 663 | 221 | AI021748 | 247 | 6.2(10)-21 | Schizosaccharomyces pombe | [de:s. *pombe* chromosome ii cosmid c14c8.] [nt:spbc14c8.14c, unknown (appears frame-shifted as] [pn:adenosine deaminase] [gn:spbc16a3.06] [sr:fission yeast] [db:genpept-pln] [de:s. *pombe* chromosome ii cosmid c16a3.] [nt:spbc16a3.06, probable adenosine deaminase; contains] |
| CONTIG454 | 23625277_c3_4 | 6843 | 20946 | 759 | 253 | AI021748 | 139 | 1.5(10)-6 | Schizosaccharomyces pombe | [pn:hypothetical protein] [gn:spbc16a3.11] [sr:fission yeast] [db:genpept-pln] [de:s. *pombe* chromosome ii cosmid c16a3.] [nt:spbc16a3.11, unknown, len:872aa, similar eg. to (] |
| CONTIG1614 | 23867677_c1_2 | 6844 | 20947 | 1224 | 408 | AI022104 | 240 | 1.2(10)-22 | Schizosaccharomyces pombe | [pn:hypothetical protein] [gn:spbc16h5.12c] [sr:fission yeast] [db:genpept-pln] [de:s. *pombe* chromosome ii cosmid c16h5.] [nt:spbc16h5.12c, unknown; (possible alternative n] |
| CONTIG1278 | 10756307_c2_4 | 6845 | 20948 | 462 | 154 | AI022304 | 189 | 1.7(10)-14 | Schizosaccharomyces pombe | [pn:hypothetical protein] [gn:spbc18h10.06c] [sr:fission yeast] [db:genpept-pln] [de:s. *pombe* chromosome ii cosmid c18h10.] [nt:spbc18h10.06c, unknown, len:357aa, similar eg. to |
| CONTIG5247 | 4938912_f1_3 | 6846 | 20949 | 801 | 267 | AI021839 | 483 | 3.8(10)-46 | Schizosaccharomyces pombe | [pn:hypothetical protein] [gn:spbc19g7.16] [sr:fission yeast] [db:genpept-pln] [de:s. *pombe* chromosome ii cosmid c19g7.] [nt:spbc19g7.16, unknown, len:429aa, similar eg. to s.] |
| CONTIG5120 | 22063431_f1_1 | 6847 | 20950 | 1344 | 448 | AI021746 | 242 | 3.7(10)-27 | Schizosaccharomyces pombe | [pn:hypothetical anaphase promoting factor] [gn:spbc1e8.06] [sr:fission yeast] [db:genpept-pln] [de:s. *pombe* chromosome ii cosmid c1e8.] [nt:spbc1e8.06, possible anaphase promoting factor] |
| CONTIG772 | 24304652_f2_1 | 6848 | 20951 | 714 | 238 | AI021747 | 276 | 1.0(10)-30 | Schizosaccharomyces pombe | [pn:hypothetical mitotic feedback control protein] [gn:spbc20f10.06] [sr:fission yeast] [db:genpept-pln] [de:s. *pombe* chromosome ii cosmid c20f10.] [nt:spbc20f10.06, putative mitotic feedback control] |
| CONTIG4577 | 9777127_f1_1 | 6849 | 20952 | 1425 | 475 | AI021747 | 102 | 0.00719 | Schizosaccharomyces pombe | [pn:hypothetical protein] [gn:spbc20f10.10] [sr:fission yeast] [db:genpept-pln] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b2x14795.y | 5883505_c1_3 | 6850 | 20953 | 429 | 143 | AL021816 | 137 | 7.4(10)-9 | Schizosaccharomyces pombe | [de:s. *pombe* chromosome ii cosmid c20f10.] [nt:spbc20f10.10, unknown, len:243aa, similar eg. to] [pn:hypothetical protein] [gn:spbc24e9.11c] [db:genpept-pln] [sr:fission yeast] [de:s. *pombe* chromosome ii cosmid c24e9.] [nt:spbc24e9.11c, probable transporter, len:322aa,] |
| CONTIG5236 | 34037817_f1_4 | 6851 | 20954 | 744 | 248 | AL021816 | 331 | 5.0(10)-30 | Schizosaccharomyces pombe | [pn:hypothetical protein] [gn:spbc24c9.14c] [sr:fission yeast] [db:genpept-pln] [de:s. *pombe* chromosome ii cosmid c24e9.] [nt:spbc24e9.14c, unknown, len:238aa, similar eg. to] |
| CONTIG5818 | 24509812_c2_42 | 6852 | 20955 | 1851 | 617 | AL022299 | 835 | 2.0(10)-83 | Schizosaccharomyces pombe | [pn:hypothetical protein] [gn:spbc29a3.06] [sr:fission yeast] [db:genpept-pln] [des. *pombe* chromosome ii cosmid c29a3.] [nt:spbc29a3.06, unknown, len:556aa, similar eg. to] |
| CONTIG3167 | 23984817_f2_3 | 6853 | 20956 | 1245 | 415 | AL022299 | 118 | 7.9(10)-8 | Schizosaccharomyces pombe | [pn:hypothetical protein] [gn:spbc29a3.08] [sr:fission yeast] [db:genpept-pln] [des. *pombe* chromosome ii cosmid c29a3.] [nt:spbc29a3.08, unknown; len:199aa; some similarity at] |
| b1x13326.y | 10241630_f2_1 | 6854 | 20957 | 285 | 95 | AL022103 | 210 | 3.2(10)-17 | Schizosaccharomyces pombe | [pn:putative protein transport protein] [gn:spbc2g2.03c] [sr:fission yeast] [db:genpept-pln] [de:s. *pombe* chromosome ii cosmid c2g2.] [nt:spbc2g2.03c, putative protein transport protein,] |
| CONTIG5458 | 23437627_c1_10 | 6855 | 20958 | 924 | 308 | AL022103 | 278 | 2.1(10)-24 | Schizosaccharomyces pombe | [pn:hypothetical protein] [gn:spbc2g2.15c] [sr:fission yeast] [db:genpept-pln] [des. *pombe* chromosome ii cosmid c2g2.] [nt:spbc2g2.15c, unknown, len:218aa, similar eg. to m.] |
| CONTIG2557 | 15087583_f2_2 | 6856 | 20959 | 276 | 92 | AL022071 | 92 | 0.0209 | Schizosaccharomyces pombe | [pn:hypothetical protein] [gn:spbc354.05c] [sr:fission yeast] [db:genpept-pln] [des. *pombe* chromosome ii cosmid c354.] [nt:spbc354.05c, unknown, len:793aa, similar eg. to the] |
| CONTIG1612 | 36222075_f2_1 | 6857 | 20960 | 1023 | 341 | AL022244 | 843 | 2.7(10)-84 | Schizosaccharomyces pombe | [pn:hypothetical protein] [gn:spbc3b8.07c] [sr:fission yeast] [db:genpept-pln] [des. *pombe* chromosome ii cosmid c3b8.] |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5039 | 33260311_f1_1 | 6858 | 20961 | 201 | 67 | AL022070 | 125 | 3.3(10)-8 | *Schizosaccharomyces pombe* | [nt:spbc3b8.07c, unknown (putative transmembrane),] [pn:hypothetical protein] [gn:spbc3b9.12] [sr:fission yeast] [db:genpept-pln] [des. *pombe* chromosome ii cosmid c3b9.] [nt:spbc3b9.12, unknown, len:132aa, similar eg. to s.] |
| CONTIG3249 | 4894061_c3_5 | 6859 | 20962 | 540 | 180 | AL021730 | 90 | 0.14999 | *Schizosaccharomyces pombe* | [pn:hypothetical protein] [gn:spbc4c3.06] [sr:fission yeast] [db:genpept-pln] [des. *pombe* chromosome ii cosmid c4c3.] [nt:spbc4c3.06, unknown, len:818aa, similar eg. to,] |
| CONTIG2788 | 968791_f3_3 | 6860 | 20963 | 876 | 292 | AL021730 | 183 | 4.9(10)-19 | *Schizosaccharomyces pombe* | [pn:hypothetical protein] [gn:spbc4c3.07] [sr:fission yeast] [db:genpept-pln] [des. *pombe* chromosome ii cosmid c4c3.] [nt:spbc4c3.07, unknown, len:302aa, similar eg. to a.] |
| CONTIG4780 | 22299050_c1_7 | 6861 | 20964 | 246 | 82 | U75447 | 94 | 0.0016 | *Yarrowia lipolytica* | [pn:p-type calcium atpase] [gn:sca1] [db:genpept-pln] [de:*yarrowia lipolytica* p-type calcium atpase (sca1) gene, completecds.] [nt:secretory calcium atpase] |
| CONTIG5097 | 19573500_f1_2 | 6862 | 20965 | 504 | 168 | AB008430 | 114 | 1.3(10)-5 | *Homo sapiens* | [pn:cdep] [fn:rho guanine nucleotide exchange factor] [sr:*homo sapiens* embryo cartilage chondrocyte cdna to mrna] [db:genpept-pri2] [de:*homo sapiens* mrna for cdep, complete cds.] [nt:band 4.1 superfamily] |
| CONTIG3365 | 6651700_c3_3 | 6863 | 20966 | 810 | 270 | AB011145 | 135 | 1.8(10)-6 | *Homo sapiens* | [pn:kiaa0573 protein] [gn:kiaa0573] [sr:*homo sapiens* male brain cdna to mrna, clone_libpbluescriptii s] [db:genpept-pri2] [de:*homo sapiens* mrna for kiaa0573 protein, partial cds.] |
| CONTIG5647 | 30292180_f1_3 | 6864 | 20967 | 1857 | 619 | AB011157 | 350 | 1.2(10)-31 | *Homo sapiens* | [pn:kiaa0585 protein] [gn:kiaa0585] [sr:*homo sapiens* male brain cdna to mrna, clone_libpbluescriptii s] [db:genpept-pri2] [de:*homo sapiens* mrna for kiaa0585 protein, partial cds.] |
| CONTIG1181 | 21979002_c1_1 | 6865 | 20968 | 525 | 175 | AF042384 | 419 | 2.3(10)-39 | *Homo sapiens* | [pn:bc-2 protein] [sr:human] [db:genpept-pri2] [de:*homo |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5594 | 23829663_c3_19 | 6866 | 20969 | 939 | 313 | AF042384 | 157 | 3.2(10)-10 | Homo sapiens | [pn:bc-2 protein] [sr:human] [db:genpept-pri2] [de:homo sapiens bc-2 protein mrna, complete cds.] [nt:p32; putative breast adenocarcinoma marker] |
| b9x10y60.x | 29454517_c1_3 | 6867 | 20970 | 621 | 207 | AF047599 | 128 | 4.0(10)-6 | Homo sapiens | [pn:bc-2 protein] [sr:human] [db:genpept-pri2] [de:homo sapiens bc-2 protein mrna, complete cds.] [nt:p32; putative breast adenocarcinoma marker] |
| CONTIG2379 | 2850811_f2_3 | 6868 | 20971 | 591 | 197 | AF048977 | 162 | 7.2(10)-11 | Homo sapiens | [pn:origin recognition complex subunit 5] [gn:orc5l] [sr:human] [db:genpept-pri2] [de:homo sapiens origin recognition complex subunit 5 (orc5l) mrna, complete cds.] [nt:orc5p] |
| CONTIG5202 | 1412961_c2_7 | 6869 | 20972 | 1761 | 587 | U60337 | 486 | 1.2(10)-45 | Homo sapiens | [pn:ser/arg-related nuclear matrix protein] [gn:srm160] [fn:splicing factor] [sr:human] [db:genpept-pri2] [de:homo sapiens ser/arg-related nuclear matrix protein (srm160) mrna, complete cds.] [nt:160 kda] |
| CONTIG5765 | 13832755_f2_7 | 6870 | 20973 | 726 | 242 | U61837 | 112 | 2.7(10)-6 | Homo sapiens | [pn:beta-mannosidase] [sr:human] [db:genpept-pri2] [de:homo sapiens beta-mannosidase mrna, complete cds.] [nt:acid hydrolase; glycosyl hydrolase; lysosomal] |
| CONTIG4557 | 21993765_c1_6 | 6871 | 20974 | 666 | 222 | Y15173 | 93 | 0.039 | no gb taxonomy match | [pn:putative cyclin g1 interacting protein] [sr:human] [db:genpept-pri2] [de:homo sapiens putative cyclin g1 interacting protein mrna, completecds.] |
| CONTIG1609 | 24500031_c2_5 | 6872 | 20975 | 1056 | 352 | Y08997 | 766 | 3.2(10)-75 | Xenopus laevis | [gn:e2] [or:human papillomavirus type 75] [db:genpept-vr1] [de:human papillomavirus type 75 e6, e7, e1, e2, e4, l2, and l1 genes.] |
| CONTIG5304 | 16800013_f3_5 | 6873 | 20976 | 360 | 120 | CONTIG741D | 289 | 2.1(10)-26 | Streptococcus pneumoniae | [pn:146kda nuclear protein] [sr:african clawed frog] [db:genpept-vrt] [de:xenopus laevis mrna for 146 kda nuclear protein.] |
| CONTIG5340 | 23868830_c3_9 | 6874 | 20977 | 963 | 321 | CONTIG400C | 114 | 8.5(10)-6 | Enterococcus | [pn:nuclear pore complex glycoprotein p62] [sr:oncorhynchus mykiss] [db:genpept-vrt] [de:oncorhynchus mykiss mrna for nuclear pore complex glycoprotein p62, complete cds.] [ui:spovc] [pn:hypothetical |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5184 | 25516263_f1_2 | 6875 | 20978 | 603 | 201 | CONTIG422C | 122 | 1.5(10)-7 | Enterococcus faecium | protein:probable peptidyl-l-trna hydrolase:stage v sporulation protein c1 [gn:pth] [gtcfc:10.6] [ec:3.1.1.29] [keggfc:14.1] [bsorffc:6.2.1] [db:gtc-bacillus subtilis] |
| CONTIG5648 | 4958425_c1_13 | 6876 | 20979 | 360 | 120 | CONTIG422C | 91 | 0.00032 | Enterococcus faecium | [gn:a540l] [or:paramecium bursaria chlorella virus 1] [db:genpept-vrl] [de:paramecium bursaria chlorella virus 1 genome, complete sequence.] |
| CONTIG5414 | 14664636_f1_1 | 6877 | 20980 | 2652 | 884 | CONTIG427C | 95 | 0.049 | Enterococcus faecium | [gn:a540l] [or:paramecium bursaria chlorella virus 1] [db:genpept-vrl] [de:paramecium bursaria chlorella virus 1 genome, complete sequence.] |
| CONTIG5168 | 799133_c1_10 | 6878 | 20981 | 1188 | 396 | CONTIG491C | 93 | 0.034 | Enterococcus faecium | [pn:b. burgdorferi predicted coding region bb0039] [gn:bb0039] [sr:lyme disease spirochete] [db:genbank] [de:borrelia burgdorferi (section 3 of 70) of the complete genome.] [nt:hypothetical protein; identified by genemark;] |
| CONTIG1818 | 12554653_f2_3 | 6879 | 20982 | 213 | 71 | CONTIG514C | 105 | 6.5(10)-7 | Enterococcus faecium | [ui:trea] [pn:trehalose-6-phosphate hydrolase] [gn:trec] [gtcfc:1.4.7.2] [ec:3.2.1.93] [keggfc:7.1] [bsorffc:2.1.1] [db:gtc-bacillus subtilis] |
| CONTIG2704 | 1416683_c2_6 | 6880 | 20983 | 1047 | 349 | CONTIG187C | 111 | 0.00081 | Acinetobacter baumannii | or:saccharomyces cerevisiae pn:unknown gn:internal of g 1669 le:6964 re:7365 di:direct sr:baker's yeast |
| CONTIG3210 | 5314142_f3_3 | 6881 | 20984 | 507 | 169 | CONTIG188C | 102 | 2.0(10)-5 | Acinetobacter baumannii | [ui:ybr208c] [pn:urea amidolyase] [gn:dur1;2] [gtcfc:2.6:4.1:5.3] [sgdfc:1.1.4:1.2:1:1.3.1] [db:gtc-saccharomyces cerevisiae] |
| CONTIG2059 | 6542500_c2_4 | 6882 | 20985 | 519 | 173 | CONTIG203C | 95 | 9.8(10)-6 | Acinetobacter baumannii | [ui:mj0304] [pn:ferripyochelin binding protein:fbp:hypothetical protein] [gtcfc:12.5] [keggfc:14.2] [ligrfc:13.5] [db:gtc-methanococcus jannaschii] |
| CONTIG5811 | 22783_c1_24 | 6883 | 20986 | 1098 | 366 | CONTIG210C | 93 | 0.01099 | Acinetobacter | [ui:b0454] [pn:hypothetical protein:hypothetical 14.4 kd protein in tesb-hha intergenic region] [gn:ybaz] [keggfc:14.2] [rileyfc:5.7.0] [db:gtc-escherichia coli] esterase (ec 3.1.1.-) - pseudomonas |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| | | | | | | | | | *baumannii* | *putida* this enzyme catalyzes the hydrolysis of ester bonds and are found widely in animals, plants and microorganisms. this enzyme is useful for transesterification, synthesis of esters, and resolution of racemic mixt [ui:b2156] [pn:lysine-specific permease] [gn:lysp:cadr] [gcfc:12.1] [keggfc:14.2] [rileyfc:4.1.1] [db:gtc-escherichia coli] |
| CONTIG2940 | 29303436_f1_2 | 6884 | 20987 | 204 | 68 | CONTIG220C | 91 | 0.00022 | *Acinetobacter baumannii* | |
| CONTIG33 | 10314008_c3_2 | 6885 | 20988 | 687 | 229 | CONTIG223C | 92 | 0.01799 | *Acinetobacter baumannii* | [ui:mg244] [pn:rep helicase, single-stranded dna-dependent atpase:rep:probable dna helicase] [gcfc:9.6;10.8] [ec:3.6.1.-] [keggfc:9.7] [tigrfc:10.2] [db:gtc-mycoplasma genitalium] |
| CONTIG2262 | 33990932_c2_4 | 6886 | 20989 | 309 | 103 | CONTIG138C | 138 | 4.5(10)-10 | *Pseudomonas aeruginosa* | RANGE ON:[GTC *P. aeruginosa*, rel 2.0, contig] |
| CONTIG1833 | 10175182_c2_3 | 6887 | 20990 | 282 | 94 | CONTIG284C | 121 | 2.2(10)-8 | *Pseudomonas aeruginosa* | RANGE ON:[GTC *P. aeruginosa*, rel 2.0, contig] |
| CONTIG4031 | 20839217_c1_3 | 6888 | 20991 | 249 | 83 | CONTIG332C | 124 | 8.6(10)-8 | *Pseudomonas aeruginosa* | RANGE ON:[GTC *P. aeruginosa*, rel 2.0, contig] |
| b9x10g13.y | 4897052_f1_1 | 6889 | 20992 | 255 | 85 | CONTIG351C | 140 | 1.3(10)-10 | *Pseudomonas aeruginosa* | RANGE ON:[GTC *P. aeruginosa*, rel 2.0, contig] |
| CONTIG1078 | 25593802_f3_2 | 6890 | 20993 | 348 | 116 | CONTIG358C | 93 | 2.7(10)-5 | *Pseudomonas aeruginosa* | RANGE ON:[GTC *P. aeruginosa*, rel 2.0, contig] |
| CONTIG3119 | 6725307_c1_4 | 6891 | 20994 | 222 | 74 | CONTIG358C | 115 | 8.0(10)-8 | *Pseudomonas aeruginosa* | RANGE ON:[GTC *P. aeruginosa*, rel 2.0, contig] |
| CONTIG3803 | 24473433_f3_4 | 6892 | 20995 | 345 | 115 | CONTIG358C | 144 | 4.7(10)-11 | *Pseudomonas aeruginosa* | RANGE ON:[GTC *P. aeruginosa*, rel 2.0, contig] |
| CONTIG5220 | 11975300_f2_2 | 6893 | 20996 | 216 | 72 | CONTIG358C | 95 | 1.6(10)-5 | *Pseudomonas aeruginosa* | RANGE ON:[GTC *P. aeruginosa*, rel 2.0, contig] |
| CONTIG4957 | 19704411_f2_4 | 6894 | 20997 | 384 | 128 | CONTIG362C | 97 | 6.5(10)-5 | *Pseudomonas aeruginosa* | RANGE ON:[GTC *P. aeruginosa*, rel 2.0, contig] |
| CONTIG4068 | 22314540_f1_1 | 6895 | 20998 | 447 | 149 | CONTIG489 | 98 | 0.00084 | *Enterobacter cloacae* | RANGE ON:[*E. cloacae*, GTC contig, rel. 2.0] |
| CONTIG4525 | 4415882_f3_3 | 6896 | 20999 | 570 | 190 | Contig088H | 97 | 0.00029 | *Clostridium acetobutylicum* | or:*borrelia burgdorferi* gn:orfa le:713 re:1801 di:direct sr:lyme disease spirochete |
| CONTIG5121 | 4500063_f2_2 | 6897 | 21000 | 1497 | 499 | Contig107H | 91 | 0.027 | *Clostridium acetobutylicum* | [ui:b4043] [pn:lexa repressor] [gn:lexa:extra:spr:tsl:umua] [gcfc:10.2] [ec:3.4.21.88] [keggfc:14.1] [rileyfc:2.0.0] [db:gtc-escherichia coli] |
| CONTIG775 | 14554762_f3_2 | 6898 | 21001 | 357 | 119 | Contig133H | 92 | 0.00013 | *Clostridium acetobutylicum* | [ui:yxiO] [pn:hypothetical protein:hypothetical 47.3 kd protein in wapa-lict intergenic |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG824 | 9773431_f2_1 | 6899 | 21002 | 555 | 185 | Contig144H | 97 | 0.0035 | Clostridium acetobutylicum | region] [gn:s3ar] [gtcfc:14.1] [keggfc:14.2] [bsorffc:8.1.1] [db:gtc-bacillus subtilis] [ui:mth172] [pn:conserved protein gtcfc:14.1:14.2] [keggfc:14.2] [genomfc:14.2] [db:gtc-methanobacterium thermoautotrophicum] |
| CONTIG5529 | 16697933_f2_5 | 6900 | 21003 | 183 | 61 | Contig155H | 92 | 1.5(10)-5 | Clostridium acetobutylicum | Hypothetical protein |
| CONTIG5355 | 14585016_c1_7 | 6901 | 21004 | 528 | 176 | Contig155H | 119 | 2.1(10)-8 | Clostridium acetobutylicum | Hypothetical protein |
| b9x11k74.x | 24651557_f3_1 | 6902 | 21005 | 495 | 165 | Contig164H | 98 | 0.00259 | Clostridium acetobutylicum | [ui:adda] [pn:atp-dependent deoxyribonuclease:subunit a:atp-dependent nuclease subunit a] [gn:recc5] [gtcfc:10.10] [keggfc:14.2] [bsorffc:4.1.2] [db:gtc-bacillus subtilis] |
| CONTIG2868 | 21562643_f1_1 | 6903 | 21006 | 1227 | 409 | Contig215H | 100 | 0.0054 | Clostridium acetobutylicum | Hypothetical protein |
| CONTIG1221 | 447882_f2_1 | 6904 | 21007 | 1236 | 412 | Contig215H | 115 | 0.00016 | Clostridium acetobutylicum | [ui:yybd] [pn:hypothetical protein:hypothetical 70.6 kd protein in feua 5''region precursor:orf1] [gn:yzba] [gtcfc:1.6;5.13;6.5;7.2:14.1] [ec:3.2.1.21] [keggfc:1.6;5.13;6.5;7.1] [bsorffc:8.1.1] [db:gtc-bacillus subtilis] |
| CONTIG5230 | 15814030_f2_9 | 6905 | 21008 | 291 | 97 | Contig227H | 92 | 3.7(10)-5 | Clostridium acetobutylicum | or:mycobacterium tuberculosis pn:unknown protein le:242 re:769 di:complement sr:mycobacterium tuberculosis (strain erdman) dna nt:orf f175; putative |
| CONTIG4630 | 24414063_f3_4 | 6906 | 21009 | 2046 | 682 | Contig244H | 92 | 0.12 | Clostridium acetobutylicum | or:bacteroides ovatus pn:arabinosidase gn:asdi ec:3.2.1.55 le:110 re:2092 di:direct |
| CONTIG10 | 22300262_f3_2 | 6907 | 21010 | 213 | 71 | | | | | |
| CONTIG100 | 5347840_c1_2 | 6908 | 21011 | 186 | 62 | | | | | |
| CONTIG1001 | 23601510_f2_1 | 6909 | 21012 | 300 | 100 | | | | | |
| CONTIG1002 | 26457258_f1_1 | 6910 | 21013 | 546 | 182 | | | | | |
| CONTIG1002 | 26203425_c2_3 | 6911 | 21014 | 186 | 62 | | | | | |
| CONTIG1004 | 5942800_f3_1 | 6912 | 21015 | 225 | 75 | | | | | |
| CONTIG1008 | 21538911_c3_3 | 6913 | 21016 | 234 | 78 | | | | | |
| CONTIG101 | 3180311_f1_1 | 6914 | 21017 | 651 | 217 | | | | | |
| CONTIG101 | 16132215_f3_7 | 6915 | 21018 | 462 | 154 | | | | | |
| CONTIG1010 | 10578905_c2_5 | 6916 | 21019 | 444 | 148 | | | | | |
| CONTIG1016 | 24255251_f3_2 | 6917 | 21020 | 243 | 81 | | | | | |
| CONTIG1017 | 31814567_c2_2 | 6918 | 21021 | 519 | 173 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1018 | 34100952_f3_1 | 6919 | 21022 | 183 | 61 | | | | | |
| CONTIG1018 | 4095275_c3_3 | 6920 | 21023 | 684 | 228 | | | | | |
| CONTIG1019 | 24226451_c2_2 | 6921 | 21024 | 198 | 66 | | | | | |
| CONTIG102 | 5859375_c1_5 | 6922 | 21025 | 201 | 67 | | | | | |
| CONTIG102 | 11718750_c3_7 | 6923 | 21026 | 204 | 68 | | | | | |
| CONTIG1022 | 13867925_c3_2 | 6924 | 21027 | 189 | 63 | | | | | |
| CONTIG1023 | 24250305_f1_2 | 6925 | 21028 | 249 | 83 | | | | | |
| CONTIG1028 | 11187875_f2_1 | 6926 | 21029 | 240 | 80 | | | | | |
| CONTIG103 | 5079800_c2_2 | 6927 | 21030 | 609 | 203 | | | | | |
| CONTIG1033 | 34257883_f3_2 | 6928 | 21031 | 195 | 65 | | | | | |
| CONTIG1035 | 6062550_f2_1 | 6929 | 21032 | 303 | 101 | | | | | |
| CONTIG1037 | 4784761_f2_1 | 6930 | 21033 | 729 | 243 | | | | | |
| CONTIG1038 | 9806716_c3_2 | 6931 | 21034 | 699 | 233 | | | | | |
| CONTIG104 | 32567_f2_1 | 6932 | 21035 | 390 | 130 | | | | | |
| CONTIG1040 | 5208427_f3_1 | 6933 | 21036 | 522 | 174 | | | | | |
| CONTIG1043 | 16894806_c3_3 | 6934 | 21037 | 771 | 257 | | | | | |
| CONTIG1045 | 15734582_f3_2 | 6935 | 21038 | 327 | 109 | | | | | |
| CONTIG1046 | 29782059_f3_3 | 6936 | 21039 | 183 | 61 | | | | | |
| CONTIG1048 | 24257217_f1_1 | 6937 | 21040 | 186 | 62 | | | | | |
| CONTIG1048 | 473160_c1_2 | 6938 | 21041 | 183 | 61 | | | | | |
| CONTIG105 | 3646876_f1_1 | 6939 | 21042 | 195 | 65 | | | | | |
| CONTIG1051 | 20485902_f1_2 | 6940 | 21043 | 435 | 145 | | | | | |
| CONTIG1051 | 2925912_f3_3 | 6941 | 21044 | 219 | 73 | | | | | |
| CONTIG1052 | 5207636_f1_1 | 6942 | 21045 | 186 | 62 | | | | | |
| CONTIG1052 | 3937786_c1_3 | 6943 | 21046 | 186 | 62 | | | | | |
| CONTIG1053 | 6692949_c1_3 | 6944 | 21047 | 303 | 101 | | | | | |
| CONTIG1053 | 4712_c2_4 | 6945 | 21048 | 306 | 102 | | | | | |
| CONTIG1055 | 26382803_c1_4 | 6946 | 21049 | 189 | 63 | | | | | |
| CONTIG1057 | 35807778_f1_1 | 6947 | 21050 | 816 | 272 | | | | | |
| CONTIG1058 | 0_c3_4 | 6948 | 21051 | 279 | 93 | | | | | |
| CONTIG1058 | 14304017_c3_5 | 6949 | 21052 | 288 | 96 | | | | | |
| CONTIG1059 | 31504056_f2_2 | 6950 | 21053 | 189 | 63 | | | | | |
| CONTIG1059 | 24468902_c3_4 | 6951 | 21054 | 375 | 125 | | | | | |
| CONTIG106 | 22439035_f2_1 | 6952 | 21055 | 597 | 199 | | | | | |
| CONTIG1061 | 7157791_f3_1 | 6953 | 21056 | 615 | 205 | | | | | |
| CONTIG1062 | 36132760_c1_1 | 6954 | 21057 | 183 | 61 | | | | | |
| CONTIG1063 | 2000_f2_1 | 6955 | 21058 | 231 | 77 | | | | | |
| CONTIG1065 | 24032201_c2_2 | 6956 | 21059 | 285 | 95 | | | | | |
| CONTIG1066 | 24017516_c1_3 | 6957 | 21060 | 303 | 101 | | | | | |
| CONTIG1068 | 4089137_f2_1 | 6958 | 21061 | 255 | 85 | | | | | |
| CONTIG1069 | 31557_f3_2 | 6959 | 21062 | 297 | 99 | | | | | |
| CONTIG1070 | 23439058_f2_3 | 6960 | 21063 | 264 | 88 | | | | | |
| CONTIG1071 | 29322706_f3_1 | 6961 | 21064 | 243 | 81 | | | | | |
| CONTIG1073 | 48588_f3_2 | 6962 | 21065 | 516 | 172 | | | | | |
| CONTIG1074 | 16022156_c1_3 | 6963 | 21066 | 213 | 71 | | | | | |
| CONTIG1079 | 4687760_f2_3 | 6964 | 21067 | 1017 | 339 | | | | | |
| CONTIG1080 | 4085885_f2_1 | 6965 | 21068 | 318 | 106 | | | | | |
| CONTIG1084 | 6103508_f3_1 | 6966 | 21069 | 594 | 198 | | | | | |
| | | 6967 | 21070 | 879 | 293 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1089 | 865699_c1_4 | 6968 | 21071 | 312 | 104 | | | | | |
| CONTIG1089 | 21507676_c3_5 | 6969 | 21072 | 942 | 314 | | | | | |
| CONTIG109 | 1968876_f1_1 | 6970 | 21073 | 210 | 70 | | | | | |
| CONTIG109 | 4882186_f1_2 | 6971 | 21074 | 231 | 77 | | | | | |
| CONTIG109 | 16585287_c2_3 | 6972 | 21075 | 321 | 107 | | | | | |
| CONTIG1091 | 26832260_c2_5 | 6973 | 21076 | 183 | 61 | | | | | |
| CONTIG1092 | 19938901_f3_3 | 6974 | 21077 | 897 | 299 | | | | | |
| CONTIG1092 | 22479188_c2_4 | 6975 | 21078 | 222 | 74 | | | | | |
| CONTIG1093 | 26620877_f2_2 | 6976 | 21079 | 198 | 66 | | | | | |
| CONTIG1093 | 22460937_f2_3 | 6977 | 21080 | 243 | 81 | | | | | |
| CONTIG1094 | 23446900_f1_1 | 6978 | 21081 | 375 | 125 | | | | | |
| CONTIG1095 | 5_f2_4 | 6979 | 21082 | 345 | 115 | | | | | |
| CONTIG1095 | 3994127_c1_6 | 6980 | 21083 | 210 | 70 | | | | | |
| CONTIG1096 | 26225437_f2_1 | 6981 | 21084 | 231 | 77 | | | | | |
| CONTIG1097 | 10720300_f3_1 | 6982 | 21085 | 282 | 94 | | | | | |
| CONTIG1098 | 5908140_f1_1 | 6983 | 21086 | 297 | 99 | | | | | |
| CONTIG1098 | 11884802_c1_4 | 6984 | 21087 | 186 | 62 | | | | | |
| CONTIG1099 | 21742762_f1_1 | 6985 | 21088 | 315 | 105 | | | | | |
| CONTIG1099 | 9782531_c3_2 | 6986 | 21089 | 321 | 107 | | | | | |
| CONTIG1102 | 25672206_f1_1 | 6987 | 21090 | 372 | 124 | | | | | |
| CONTIG1102 | 30250831_f3_2 | 6988 | 21091 | 189 | 63 | | | | | |
| CONTIG1107 | 3132125_f1_2 | 6989 | 21092 | 186 | 62 | | | | | |
| CONTIG1108 | 30648285_c3_5 | 6990 | 21093 | 219 | 73 | | | | | |
| CONTIG1110 | 36588553_f1_1 | 6991 | 21094 | 213 | 71 | | | | | |
| CONTIG1111 | 6697178_c2_1 | 6992 | 21095 | 306 | 102 | | | | | |
| CONTIG1114 | 21584752_f2_2 | 6993 | 21096 | 717 | 239 | | | | | |
| CONTIG1115 | 3907762_c2_2 | 6994 | 21097 | 918 | 306 | | | | | |
| CONTIG1116 | 22073307_f3_3 | 6995 | 21098 | 228 | 76 | | | | | |
| CONTIG1116 | 9897711_c2_4 | 6996 | 21099 | 198 | 66 | | | | | |
| CONTIG1118 | 870450_f2_3 | 6997 | 21100 | 231 | 77 | | | | | |
| CONTIG112 | 21735305_f3_1 | 6998 | 21101 | 186 | 62 | | | | | |
| CONTIG1121 | 2832662_f3_3 | 6999 | 21102 | 231 | 77 | | | | | |
| CONTIG1123 | 6343899_c1_1 | 7000 | 21103 | 192 | 64 | | | | | |
| CONTIG1123 | 253755_c3_2 | 7001 | 21104 | 237 | 79 | | | | | |
| CONTIG1124 | 4390953_c1_1 | 7002 | 21105 | 267 | 89 | | | | | |
| CONTIG1124 | 25438750_c3_3 | 7003 | 21106 | 189 | 63 | | | | | |
| CONTIG1125 | 1173752_f3_2 | 7004 | 21107 | 372 | 124 | | | | | |
| CONTIG1128 | 24808588_c1_5 | 7005 | 21108 | 279 | 93 | | | | | |
| CONTIG1128 | 35602092_c3_8 | 7006 | 21109 | 360 | 120 | | | | | |
| CONTIG1131 | 22304715_c1_1 | 7007 | 21110 | 285 | 95 | | | | | |
| CONTIG1138 | 4454502_c1_3 | 7008 | 21111 | 768 | 256 | | | | | |
| CONTIG1140 | 23448776_c2_1 | 7009 | 21112 | 468 | 156 | | | | | |
| CONTIG1141 | 29298215_c2_3 | 7010 | 21113 | 252 | 84 | | | | | |
| CONTIG1141 | 15129181_c3_4 | 7011 | 21114 | 684 | 228 | | | | | |
| CONTIG1142 | 4895438_f2_1 | 7012 | 21115 | 282 | 94 | | | | | |
| CONTIG1143 | 6067902_f3_2 | 7013 | 21116 | 630 | 210 | | | | | |
| CONTIG1144 | 9922752_c2_2 | 7014 | 21117 | 186 | 62 | | | | | |
| CONTIG1145 | 6643802_f1_1 | 7015 | 21118 | 366 | 122 | | | | | |
| CONTIG1145 | 24414000_f2_2 | 7016 | 21119 | 213 | 71 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1147 | 26589717_c3_6 | 7017 | 21120 | 201 | 67 | | | | | |
| CONTIG1151 | 34100307_f2_2 | 7018 | 21121 | 372 | 124 | | | | | |
| CONTIG1155 | 29339701_f1_2 | 7019 | 21122 | 465 | 155 | | | | | |
| CONTIG1157 | 35742325_f3_2 | 7020 | 21123 | 639 | 213 | | | | | |
| CONTIG116 | 13788432_c1_2 | 7021 | 21124 | 195 | 65 | | | | | |
| CONTIG1160 | 6820182_c1_5 | 7022 | 21125 | 294 | 98 | | | | | |
| CONTIG1161 | 14085250_f1_2 | 7023 | 21126 | 303 | 101 | | | | | |
| CONTIG1162 | 16222192_f3_3 | 7024 | 21127 | 186 | 62 | | | | | |
| CONTIG1163 | 15636326_c3_3 | 7025 | 21128 | 249 | 83 | | | | | |
| CONTIG1168 | 4878400_f3_2 | 7026 | 21129 | 516 | 172 | | | | | |
| CONTIG117 | 12534767_f2_1 | 7027 | 21130 | 219 | 73 | | | | | |
| CONTIG1171 | 34195262_c1_2 | 7028 | 21131 | 189 | 63 | | | | | |
| CONTIG1172 | 5082000_f3_1 | 7029 | 21132 | 636 | 212 | | | | | |
| CONTIG1175 | 1062917_f1_1 | 7030 | 21133 | 780 | 260 | | | | | |
| CONTIG1178 | 4774132_c1_4 | 7031 | 21134 | 354 | 118 | | | | | |
| CONTIG1178 | 12192275_c3_5 | 7032 | 21135 | 189 | 63 | | | | | |
| CONTIG1178 | 19787554_c3_6 | 7033 | 21136 | 468 | 156 | | | | | |
| CONTIG118 | 14453443_c3_7 | 7034 | 21137 | 621 | 207 | | | | | |
| CONTIG1183 | 6850628_c3_2 | 7035 | 21138 | 489 | 163 | | | | | |
| CONTIG1184 | 6894050_f1_1 | 7036 | 21139 | 213 | 71 | | | | | |
| CONTIG1186 | 5087910_f1_1 | 7037 | 21140 | 477 | 159 | | | | | |
| CONTIG1186 | 2532550_f2_2 | 7038 | 21141 | 336 | 112 | | | | | |
| CONTIG1186 | 22087882_c1_4 | 7039 | 21142 | 291 | 97 | | | | | |
| CONTIG1193 | 20345278_c1_3 | 7040 | 21143 | 234 | 78 | | | | | |
| CONTIG1193 | 14720378_c1_7 | 7041 | 21144 | 189 | 63 | | | | | |
| CONTIG1194 | 660200_c2_3 | 7042 | 21145 | 327 | 109 | | | | | |
| CONTIG1195 | 4948787_f2_2 | 7043 | 21146 | 222 | 74 | | | | | |
| CONTIG1195 | 4962966_f2_3 | 7044 | 21147 | 216 | 72 | | | | | |
| CONTIG1197 | 22344127_c3_3 | 7045 | 21148 | 213 | 71 | | | | | |
| CONTIG12 | 25425767_f3_1 | 7046 | 21149 | 207 | 69 | | | | | |
| CONTIG12 | 35193800_c1_2 | 7047 | 21150 | 186 | 62 | | | | | |
| CONTIG1201 | 21723386_f2_2 | 7048 | 21151 | 192 | 64 | | | | | |
| CONTIG1201 | 29475766_c3_3 | 7049 | 21152 | 234 | 78 | | | | | |
| CONTIG1204 | 1985905_f3_1 | 7050 | 21153 | 204 | 68 | | | | | |
| CONTIG1205 | 25681317_c3_3 | 7051 | 21154 | 258 | 86 | | | | | |
| CONTIG1208 | 25554562_f2_1 | 7052 | 21155 | 489 | 163 | | | | | |
| CONTIG121 | 26428438_c1_2 | 7053 | 21156 | 432 | 144 | | | | | |
| CONTIG1210 | 35834412_f1_1 | 7054 | 21157 | 759 | 253 | | | | | |
| CONTIG1215 | 23600192_c1_3 | 7055 | 21158 | 723 | 241 | | | | | |
| CONTIG1218 | 10360938_c2_6 | 7056 | 21159 | 438 | 146 | | | | | |
| CONTIG1222 | 24320282_c2_5 | 7057 | 21160 | 213 | 71 | | | | | |
| CONTIG1223 | 20112762_f2_1 | 7058 | 21161 | 198 | 66 | | | | | |
| CONTIG1223 | 31266525_c1_2 | 7059 | 21162 | 186 | 62 | | | | | |
| CONTIG1224 | 22845635_c1_2 | 7060 | 21163 | 426 | 142 | | | | | |
| CONTIG1227 | 24256910_c2_3 | 7061 | 21164 | 258 | 86 | | | | | |
| CONTIG1228 | 5164062_f2_1 | 7062 | 21165 | 873 | 291 | | | | | |
| CONTIG1228 | 604125_f3_2 | 7063 | 21166 | 246 | 82 | | | | | |
| CONTIG123 | 13851587_c2_4 | 7064 | 21167 | 333 | 111 | | | | | |
| CONTIG1232 | 24797760_f3_1 | 7065 | 21168 | 183 | 61 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1233 | 22267035_f1_1 | 7066 | 21169 | 1005 | 335 | | | | | |
| CONTIG1233 | 3960782_f2_2 | 7067 | 21170 | 441 | 147 | | | | | |
| CONTIG1234 | 12925900_f2_1 | 7068 | 21171 | 357 | 119 | | | | | |
| CONTIG1235 | 25448513_f3_2 | 7069 | 21172 | 189 | 63 | | | | | |
| CONTIG1235 | 9957312_f3_4 | 7070 | 21173 | 198 | 66 | | | | | |
| CONTIG1236 | 34023312_f1_1 | 7071 | 21174 | 198 | 66 | | | | | |
| CONTIG1237 | 36611640_c3_3 | 7072 | 21175 | 906 | 302 | | | | | |
| CONTIG1238 | 19792250_f1_1 | 7073 | 21176 | 216 | 72 | | | | | |
| CONTIG1238 | 1370337_f3_2 | 7074 | 21177 | 183 | 61 | | | | | |
| CONTIG1238 | 20345086_c1_3 | 7075 | 21178 | 213 | 71 | | | | | |
| CONTIG1238 | 22767057_c1_4 | 7076 | 21179 | 291 | 97 | | | | | |
| CONTIG1239 | 12350312_f2_1 | 7077 | 21180 | 816 | 272 | | | | | |
| CONTIG124 | 9806262_c2_3 | 7078 | 21181 | 288 | 96 | | | | | |
| CONTIG1241 | 6820432_f1_1 | 7079 | 21182 | 234 | 78 | | | | | |
| CONTIG1241 | 12298438_c2_2 | 7080 | 21183 | 738 | 246 | | | | | |
| CONTIG1244 | 1228160_f1_1 | 7081 | 21184 | 228 | 76 | | | | | |
| CONTIG1244 | 976418_f3_3 | 7082 | 21185 | 192 | 64 | | | | | |
| CONTIG1245 | 194075_f3_2 | 7083 | 21186 | 348 | 116 | | | | | |
| CONTIG1248 | 14563912_f3_2 | 7084 | 21187 | 240 | 80 | | | | | |
| CONTIG1253 | 26350002_f3_2 | 7085 | 21188 | 186 | 62 | | | | | |
| CONTIG1254 | 16594050_f1_1 | 7086 | 21189 | 303 | 101 | | | | | |
| CONTIG1255 | 29568785_f2_1 | 7087 | 21190 | 255 | 85 | | | | | |
| CONTIG1258 | 32157802_c3_4 | 7088 | 21191 | 186 | 62 | | | | | |
| CONTIG1259 | 26798428_c3_3 | 7089 | 21192 | 537 | 179 | | | | | |
| CONTIG1260 | 250450_f3_3 | 7090 | 21193 | 183 | 61 | | | | | |
| CONTIG1261 | 2384652_c3_3 | 7091 | 21194 | 798 | 266 | | | | | |
| CONTIG1262 | 2939700_c3_7 | 7092 | 21195 | 228 | 76 | | | | | |
| CONTIG1263 | 24390942_f1_1 | 7093 | 21196 | 231 | 77 | | | | | |
| CONTIG1263 | 29567000_f1_3 | 7094 | 21197 | 210 | 70 | | | | | |
| CONTIG1265 | 14474056_c1_3 | 7095 | 21198 | 201 | 67 | | | | | |
| CONTIG1267 | 127_f2_2 | 7096 | 21199 | 342 | 114 | | | | | |
| CONTIG1267 | 5269592_f2_3 | 7097 | 21200 | 249 | 83 | | | | | |
| CONTIG127 | 26836712_f3_1 | 7098 | 21201 | 246 | 82 | | | | | |
| CONTIG1270 | 24414056_f3_5 | 7099 | 21202 | 210 | 70 | | | | | |
| CONTIG1270 | 17085963_c1_7 | 7100 | 21203 | 192 | 64 | | | | | |
| CONTIG1272 | 15839392_f2_2 | 7101 | 21204 | 381 | 127 | | | | | |
| CONTIG1279 | 24250262_f3_3 | 7102 | 21205 | 291 | 97 | | | | | |
| CONTIG1279 | 13707552_c2_2 | 7103 | 21206 | 264 | 88 | | | | | |
| CONTIG1283 | 3519407_c3_3 | 7104 | 21207 | 327 | 109 | | | | | |
| CONTIG1285 | 29412817_f2_1 | 7105 | 21208 | 777 | 259 | | | | | |
| CONTIG1285 | 24438136_c1_5 | 7106 | 21209 | 375 | 125 | | | | | |
| CONTIG1288 | 189387_c3_6 | 7107 | 21210 | 771 | 257 | | | | | |
| CONTIG1291 | 9846001_c2_1 | 7108 | 21211 | 240 | 80 | | | | | |
| CONTIG1292 | 11847262_f3_2 | 7109 | 21212 | 921 | 307 | | | | | |
| CONTIG1293 | 23863402_c3_4 | 7110 | 21213 | 879 | 293 | | | | | |
| CONTIG1294 | 6126417_f2_1 | 7111 | 21214 | 477 | 159 | | | | | |
| CONTIG1294 | 20438406_c1_2 | 7112 | 21215 | 1071 | 357 | | | | | |
| CONTIG1295 | 35805128_f1_1 | 7113 | 21216 | 285 | 95 | | | | | |
| CONTIG1295 | 22050051_c1_3 | 7114 | 21217 | 183 | 61 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1296 | 22303925_f2_1 | 7115 | 21218 | 240 | 80 | | | | | |
| CONTIG1297 | 33879153_f2_2 | 7116 | 21219 | 336 | 112 | | | | | |
| CONTIG1298 | 34159627_c3_3 | 7117 | 21220 | 276 | 92 | | | | | |
| CONTIG13 | 21759636_f1_2 | 7118 | 21221 | 204 | 68 | | | | | |
| CONTIG1302 | 9949027_f2_2 | 7119 | 21222 | 192 | 64 | | | | | |
| CONTIG1302 | 29944625_c1_5 | 7120 | 21223 | 279 | 93 | | | | | |
| CONTIG1304 | 3245302_f1_1 | 7121 | 21224 | 183 | 61 | | | | | |
| CONTIG1304 | 24883568_c2_10 | 7122 | 21225 | 258 | 86 | | | | | |
| CONTIG1306 | 29495275_c3_2 | 7123 | 21226 | 690 | 230 | | | | | |
| CONTIG1308 | 33617010_f1_3 | 7124 | 21227 | 267 | 89 | | | | | |
| CONTIG1308 | 34180462_c1_6 | 7125 | 21228 | 225 | 75 | | | | | |
| CONTIG1310 | 23550277_c1_3 | 7126 | 21229 | 822 | 274 | | | | | |
| CONTIG1312 | 24415812_f2_1 | 7127 | 21230 | 366 | 122 | | | | | |
| CONTIG1313 | 26366677_c3_4 | 7128 | 21231 | 225 | 75 | | | | | |
| CONTIG1313 | 22265875_c3_5 | 7129 | 21232 | 435 | 145 | | | | | |
| CONTIG1314 | 5079788_c1_1 | 7130 | 21233 | 933 | 311 | | | | | |
| CONTIG1318 | 3495328_f1_2 | 7131 | 21234 | 591 | 197 | | | | | |
| CONTIG1319 | 14648425_f3_3 | 7132 | 21235 | 249 | 83 | | | | | |
| CONTIG1319 | 23472192_c2_5 | 7133 | 21236 | 216 | 72 | | | | | |
| CONTIG1322 | 24845251_c3_5 | 7134 | 21237 | 192 | 64 | | | | | |
| CONTIG1328 | 1969080_f1_1 | 7135 | 21238 | 201 | 67 | | | | | |
| CONTIG1328 | 24398427_c3_3 | 7136 | 21239 | 291 | 97 | | | | | |
| CONTIG1330 | 3245181_f1_1 | 7137 | 21240 | 210 | 70 | | | | | |
| CONTIG1330 | 30593762_f3_2 | 7138 | 21241 | 198 | 66 | | | | | |
| CONTIG1331 | 21878333_c1_1 | 7139 | 21242 | 186 | 62 | | | | | |
| CONTIG1331 | 4861090_c1_3 | 7140 | 21243 | 186 | 62 | | | | | |
| CONTIG1331 | 26569625_c2_4 | 7141 | 21244 | 243 | 81 | | | | | |
| CONTIG1331 | 245625_c3_5 | 7142 | 21245 | 198 | 66 | | | | | |
| CONTIG1334 | 5120452_c3_3 | 7143 | 21246 | 516 | 172 | | | | | |
| CONTIG1337 | 4378313_f2_4 | 7144 | 21247 | 216 | 72 | | | | | |
| CONTIG1337 | 4096875_c1_6 | 7145 | 21248 | 417 | 139 | | | | | |
| CONTIG1338 | 24806502_c2_2 | 7146 | 21249 | 717 | 239 | | | | | |
| CONTIG1339 | 29692163_c2_1 | 7147 | 21250 | 186 | 62 | | | | | |
| CONTIG1340 | 10166527_f2_2 | 7148 | 21251 | 768 | 256 | | | | | |
| CONTIG1340 | 25679656_f3_3 | 7149 | 21252 | 264 | 88 | | | | | |
| CONTIG1342 | 4875302_f1_1 | 7150 | 21253 | 219 | 73 | | | | | |
| CONTIG1345 | 6022135_f3_1 | 7151 | 21254 | 186 | 62 | | | | | |
| CONTIG1345 | 24220377_c2_2 | 7152 | 21255 | 357 | 119 | | | | | |
| CONTIG1347 | 16281455_f3_2 | 7153 | 21256 | 351 | 117 | | | | | |
| CONTIG1348 | 23460285_f3_2 | 7154 | 21257 | 519 | 173 | | | | | |
| CONTIG1348 | 7225900_c2_4 | 7155 | 21258 | 183 | 61 | | | | | |
| CONTIG1348 | 19723186_c2_5 | 7156 | 21259 | 201 | 67 | | | | | |
| CONTIG1348 | 29430160_c3_7 | 7157 | 21260 | 213 | 71 | | | | | |
| CONTIG1349 | 2292417_f3_3 | 7158 | 21261 | 186 | 62 | | | | | |
| CONTIG1349 | 23835925_c1_4 | 7159 | 21262 | 321 | 107 | | | | | |
| CONTIG1350 | 3317762_f1_1 | 7160 | 21263 | 429 | 143 | | | | | |
| CONTIG1352 | 797750_f1_1 | 7161 | 21264 | 264 | 88 | | | | | |
| CONTIG1353 | 787511_f1_1 | 7162 | 21265 | 192 | 64 | | | | | |
| CONTIG1353 | 23709688_f2_2 | 7163 | 21266 | 192 | 64 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1353 | 21500776_c3_4 | 7164 | 21267 | 303 | 101 | | | | | |
| CONTIG1355 | 5172553_f1_2 | 7165 | 21268 | 222 | 74 | | | | | |
| CONTIG1355 | 14971013_f2_3 | 7166 | 21269 | 294 | 98 | | | | | |
| CONTIG1355 | 25580287_c2_6 | 7167 | 21270 | 192 | 64 | | | | | |
| CONTIG1356 | 2353208_f2_1 | 7168 | 21271 | 249 | 83 | | | | | |
| CONTIG1357 | 14540917_f3_2 | 7169 | 21272 | 279 | 93 | | | | | |
| CONTIG1359 | 2947263_c1_3 | 7170 | 21273 | 1023 | 341 | | | | | |
| CONTIG1360 | 6367186_f3_2 | 7171 | 21274 | 288 | 96 | | | | | |
| CONTIG1360 | 3322177_c1_4 | 7172 | 21275 | 204 | 68 | | | | | |
| CONTIG1362 | 29925662_c3_3 | 7173 | 21276 | 225 | 75 | | | | | |
| CONTIG1364 | 10203150_c1_1 | 7174 | 21277 | 333 | 111 | | | | | |
| CONTIG1364 | 33703431_c2_2 | 7175 | 21278 | 258 | 86 | | | | | |
| CONTIG1366 | 10172500_c2_4 | 7176 | 21279 | 201 | 67 | | | | | |
| CONTIG1368 | 5954427_c1_2 | 7177 | 21280 | 297 | 99 | | | | | |
| CONTIG1369 | 34193752_c1_3 | 7178 | 21281 | 228 | 76 | | | | | |
| CONTIG1372 | 5332763_f1_1 | 7179 | 21282 | 189 | 63 | | | | | |
| CONTIG1376 | 6063135_c3_3 | 7180 | 21283 | 324 | 108 | | | | | |
| CONTIG1378 | 47200_f2_2 | 7181 | 21284 | 186 | 62 | | | | | |
| CONTIG1379 | 992950_f3_2 | 7182 | 21285 | 213 | 71 | | | | | |
| CONTIG1379 | 4875807_f3_3 | 7183 | 21286 | 849 | 283 | | | | | |
| CONTIG138 | 35410788_c2_4 | 7184 | 21287 | 186 | 62 | | | | | |
| CONTIG1380 | 4689452_c1_2 | 7185 | 21288 | 324 | 108 | | | | | |
| CONTIG1380 | 4803500_c2_3 | 7186 | 21289 | 282 | 94 | | | | | |
| CONTIG1381 | 14219443_f3_4 | 7187 | 21290 | 195 | 65 | | | | | |
| CONTIG1382 | 656327_f3_3 | 7188 | 21291 | 432 | 144 | | | | | |
| CONTIG1383 | 2006928_f3_1 | 7189 | 21292 | 240 | 80 | | | | | |
| CONTIG1383 | 4892250_f3_2 | 7190 | 21293 | 927 | 309 | | | | | |
| CONTIG1383 | 3131301_c3_4 | 7191 | 21294 | 291 | 97 | | | | | |
| CONTIG1384 | 26573312_c3_4 | 7192 | 21295 | 1059 | 353 | | | | | |
| CONTIG1385 | 3234657_f2_2 | 7193 | 21296 | 186 | 62 | | | | | |
| CONTIG1385 | 24430192_c1_4 | 7194 | 21297 | 216 | 72 | | | | | |
| CONTIG1389 | 26807790_c1_1 | 7195 | 21298 | 741 | 247 | | | | | |
| CONTIG1389 | 23868930_c2_2 | 7196 | 21299 | 183 | 61 | | | | | |
| CONTIG139 | 10207317_f3_2 | 7197 | 21300 | 204 | 68 | | | | | |
| CONTIG1391 | 116250_c1_1 | 7198 | 21301 | 198 | 66 | | | | | |
| CONTIG1391 | 20523263_c2_4 | 7199 | 21302 | 198 | 66 | | | | | |
| CONTIG1394 | 78188_f2_1 | 7200 | 21303 | 288 | 96 | | | | | |
| CONTIG1395 | 24272287_f1_1 | 7201 | 21304 | 279 | 93 | | | | | |
| CONTIG1397 | 7033383_c2_1 | 7202 | 21305 | 1140 | 380 | | | | | |
| CONTIG14 | 24342200_f2_2 | 7203 | 21306 | 222 | 74 | | | | | |
| CONTIG1400 | 32612677_f1_1 | 7204 | 21307 | 225 | 75 | | | | | |
| CONTIG1401 | 11110766_c2_2 | 7205 | 21308 | 228 | 76 | | | | | |
| CONTIG1402 | 34422253_c3_5 | 7206 | 21309 | 1008 | 336 | | | | | |
| CONTIG1403 | 22067317_f1_1 | 7207 | 21310 | 225 | 75 | | | | | |
| CONTIG1403 | 16408375_c3_6 | 7208 | 21311 | 201 | 67 | | | | | |
| CONTIG1404 | 23617127_c2_4 | 7209 | 21312 | 183 | 61 | | | | | |
| CONTIG1404 | 35331637_c2_5 | 7210 | 21313 | 201 | 67 | | | | | |
| CONTIG1404 | 19562802_c3_6 | 7211 | 21314 | 657 | 219 | | | | | |
| CONTIG1405 | 26777343_f2_1 | 7212 | 21315 | 507 | 169 | | | | | |

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1406 | 10814177_f1_1 | 7213 | 21316 | 243 | 81 | | | | | |
| CONTIG1406 | 2739002_c1_3 | 7214 | 21317 | 294 | 98 | | | | | |
| CONTIG1407 | 10677165_f1_2 | 7215 | 21318 | 459 | 153 | | | | | |
| CONTIG1408 | 10439750_f2_4 | 7216 | 21319 | 324 | 108 | | | | | |
| CONTIG141 | 11500_f1_1 | 7217 | 21320 | 261 | 87 | | | | | |
| CONTIG141 | 9946002_f1_2 | 7218 | 21321 | 216 | 72 | | | | | |
| CONTIG1410 | 267953_f1_1 | 7219 | 21322 | 882 | 294 | | | | | |
| CONTIG1415 | 3947127_c2_3 | 7220 | 21323 | 1275 | 425 | | | | | |
| CONTIG1418 | 19813138_f3_2 | 7221 | 21324 | 354 | 118 | | | | | |
| CONTIG1418 | 29961635_c1_3 | 7222 | 21325 | 282 | 94 | | | | | |
| CONTIG1418 | 5274132_c2_4 | 7223 | 21326 | 231 | 77 | | | | | |
| CONTIG1419 | 4395287_f1_1 | 7224 | 21327 | 210 | 70 | | | | | |
| CONTIG1419 | 13781556_f3_2 | 7225 | 21328 | 228 | 76 | | | | | |
| CONTIG1421 | 9814066_c2_1 | 7226 | 21329 | 1032 | 344 | | | | | |
| CONTIG1423 | 34484753_c2_1 | 7227 | 21330 | 336 | 112 | | | | | |
| CONTIG1425 | 26376627_c3_3 | 7228 | 21331 | 204 | 68 | | | | | |
| CONTIG1428 | 267131_f1_1 | 7229 | 21332 | 225 | 75 | | | | | |
| CONTIG1428 | 35366563_c2_2 | 7230 | 21333 | 183 | 61 | | | | | |
| CONTIG1429 | 4882785_f2_1 | 7231 | 21334 | 732 | 244 | | | | | |
| CONTIG1429 | 24272161_f3_2 | 7232 | 21335 | 201 | 67 | | | | | |
| CONTIG1434 | 31337752_f1_2 | 7233 | 21336 | 345 | 115 | | | | | |
| CONTIG1437 | 32316902_f2_3 | 7234 | 21337 | 393 | 131 | | | | | |
| CONTIG1437 | 4413392_f3_6 | 7235 | 21338 | 189 | 63 | | | | | |
| CONTIG1439 | 4781505_c2_2 | 7236 | 21339 | 216 | 72 | | | | | |
| CONTIG144 | 35960061_f1_1 | 7237 | 21340 | 192 | 64 | | | | | |
| CONTIG1441 | 3906252_f3_2 | 7238 | 21341 | 189 | 63 | | | | | |
| CONTIG1441 | 26803752_c1_5 | 7239 | 21342 | 384 | 128 | | | | | |
| CONTIG1442 | 4085925_c1_2 | 7240 | 21343 | 201 | 67 | | | | | |
| CONTIG1444 | 2401038_f2_1 | 7241 | 21344 | 780 | 260 | | | | | |
| CONTIG1446 | 30173462_c2_4 | 7242 | 21345 | 192 | 64 | | | | | |
| CONTIG1447 | 5867837_f3_2 | 7243 | 21346 | 228 | 76 | | | | | |
| CONTIG145 | 29335950_c3_3 | 7244 | 21347 | 213 | 71 | | | | | |
| CONTIG1452 | 34584805_f1_1 | 7245 | 21348 | 699 | 233 | | | | | |
| CONTIG1453 | 2814013_f2_2 | 7246 | 21349 | 621 | 207 | | | | | |
| CONTIG1454 | 22867812_c2_5 | 7247 | 21350 | 219 | 73 | | | | | |
| CONTIG1454 | 5312535_f2_1 | 7248 | 21351 | 207 | 69 | | | | | |
| CONTIG1461 | 2038912_f2_1 | 7249 | 21352 | 645 | 215 | | | | | |
| CONTIG1462 | 21679052_c1_3 | 7250 | 21353 | 855 | 285 | | | | | |
| CONTIG1463 | 1454566_f2_3 | 7251 | 21354 | 216 | 72 | | | | | |
| CONTIG1465 | 1228427_c1_2 | 7252 | 21355 | 399 | 133 | | | | | |
| CONTIG1466 | 14573755_c3_5 | 7253 | 21356 | 252 | 84 | | | | | |
| CONTIG1471 | 26376390_f3_2 | 7254 | 21357 | 318 | 106 | | | | | |
| CONTIG1473 | 26600758_c3_3 | 7255 | 21358 | 522 | 174 | | | | | |
| CONTIG1473 | 10989463_c2_2 | 7256 | 21359 | 228 | 76 | | | | | |
| CONTIG1475 | 36135962_f2_2 | 7257 | 21360 | 216 | 72 | | | | | |
| CONTIG148 | 21895761_f1_1 | 7258 | 21361 | 351 | 117 | | | | | |
| CONTIG1480 | 26351411_f2_2 | 7259 | 21362 | 693 | 231 | | | | | |
| CONTIG1480 | 35321875_c2_4 | 7260 | 21363 | 198 | 66 | | | | | |
| CONTIG1484 | 4820181_f2_3 | 7261 | 21364 | 210 | 70 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1487 | 32140885_f3_5 | 7262 | 21365 | 252 | 84 | | | | | |
| CONTIG1488 | 4898638_c1_3 | 7263 | 21366 | 192 | 64 | | | | | |
| CONTIG1489 | 5084380_f2_2 | 7264 | 21367 | 195 | 65 | | | | | |
| CONTIG1489 | 23676402_c1_5 | 7265 | 21368 | 303 | 101 | | | | | |
| CONTIG1489 | 32039063_c2_6 | 7266 | 21369 | 186 | 62 | | | | | |
| CONTIG1491 | 2166663_f1_1 | 7267 | 21370 | 489 | 163 | | | | | |
| CONTIG1491 | 2441406_c2_3 | 7268 | 21371 | 255 | 85 | | | | | |
| CONTIG1491 | 31507163_c3_4 | 7269 | 21372 | 351 | 117 | | | | | |
| CONTIG1491 | 24803188_c3_5 | 7270 | 21373 | 189 | 63 | | | | | |
| CONTIG1493 | 5890930_f2_3 | 7271 | 21374 | 267 | 89 | | | | | |
| CONTIG1494 | 11907805_c2_3 | 7272 | 21375 | 267 | 89 | | | | | |
| CONTIG1496 | 953312_f3_1 | 7273 | 21376 | 795 | 265 | | | | | |
| CONTIG1497 | 14742312_f1_2 | 7274 | 21377 | 183 | 61 | | | | | |
| CONTIG1497 | 24619026_c2_7 | 7275 | 21378 | 216 | 72 | | | | | |
| CONTIG1497 | 36142125_c2_8 | 7276 | 21379 | 579 | 193 | | | | | |
| CONTIG1498 | 955305_c3_2 | 7277 | 21380 | 201 | 67 | | | | | |
| CONTIG1498 | 11875675_c3_3 | 7278 | 21381 | 189 | 63 | | | | | |
| CONTIG150 | 23860252_c1_1 | 7279 | 21382 | 225 | 75 | | | | | |
| CONTIG1500 | 25566967_f1_2 | 7280 | 21383 | 246 | 82 | | | | | |
| CONTIG1501 | 10722327_f2_3 | 7281 | 21384 | 183 | 61 | | | | | |
| CONTIG1501 | 24016962_c2_5 | 7282 | 21385 | 219 | 73 | | | | | |
| CONTIG1503 | 25594026_c3_3 | 7283 | 21386 | 189 | 63 | | | | | |
| CONTIG1505 | 21725637_c2_4 | 7284 | 21387 | 204 | 68 | | | | | |
| CONTIG1507 | 36337811_c3_4 | 7285 | 21388 | 420 | 140 | | | | | |
| CONTIG1508 | 23631262_c3_2 | 7286 | 21389 | 618 | 206 | | | | | |
| CONTIG1510 | 13678425_f2_1 | 7287 | 21390 | 234 | 78 | | | | | |
| CONTIG1511 | 24846080_f2_1 | 7288 | 21391 | 582 | 194 | | | | | |
| CONTIG1513 | 24062512_c3_1 | 7289 | 21392 | 300 | 100 | | | | | |
| CONTIG1518 | 26645933_f1_1 | 7290 | 21393 | 276 | 92 | | | | | |
| CONTIG1519 | 10975260_f1_2 | 7291 | 21394 | 201 | 67 | | | | | |
| CONTIG1519 | 26816927_f3_4 | 7292 | 21395 | 270 | 90 | | | | | |
| CONTIG1520 | 9812626_f3_1 | 7293 | 21396 | 186 | 62 | | | | | |
| CONTIG1520 | 24492782_c2_2 | 7294 | 21397 | 195 | 65 | | | | | |
| CONTIG1521 | 23440875_f1_1 | 7295 | 21398 | 195 | 65 | | | | | |
| CONTIG1521 | 32289591_f2_3 | 7296 | 21399 | 429 | 143 | | | | | |
| CONTIG1521 | 26257886_c1_5 | 7297 | 21400 | 1329 | 443 | | | | | |
| CONTIG1523 | 495787_f1_1 | 7298 | 21401 | 408 | 136 | | | | | |
| CONTIG1525 | 22065900_f3_2 | 7299 | 21402 | 198 | 66 | | | | | |
| CONTIG1526 | 36339537_f3_3 | 7300 | 21403 | 288 | 96 | | | | | |
| CONTIG1527 | 812550_c1_1 | 7301 | 21404 | 249 | 83 | | | | | |
| CONTIG1528 | 32136265_f2_2 | 7302 | 21405 | 192 | 64 | | | | | |
| CONTIG1528 | 4406576_c1_4 | 7303 | 21406 | 192 | 64 | | | | | |
| CONTIG1529 | 33339142_f1_1 | 7304 | 21407 | 204 | 68 | | | | | |
| CONTIG153 | 555432_c3_5 | 7305 | 21408 | 489 | 163 | | | | | |
| CONTIG1534 | 7037782_f2_2 | 7306 | 21409 | 273 | 91 | | | | | |
| CONTIG1535 | 13958137_f3_3 | 7307 | 21410 | 204 | 68 | | | | | |
| CONTIG1535 | 980252_f3_4 | 7308 | 21411 | 369 | 123 | | | | | |
| CONTIG1535 | 2937950_c3_5 | 7309 | 21412 | 198 | 66 | | | | | |
| CONTIG1536 | 36636588_c3_4 | 7310 | 21413 | 240 | 80 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1537 | 4977250_f3_4 | 7311 | 21414 | 192 | 64 | | | | | |
| CONTIG1538 | 4720077_f2_2 | 7312 | 21415 | 297 | 99 | | | | | |
| CONTIG1538 | 16250393_c3_4 | 7313 | 21416 | 237 | 79 | | | | | |
| CONTIG1539 | 32595637_f1_1 | 7314 | 21417 | 423 | 141 | | | | | |
| CONTIG154 | 11135837_c1_1 | 7315 | 21418 | 192 | 64 | | | | | |
| CONTIG154 | 6256312_c1_2 | 7316 | 21419 | 207 | 69 | | | | | |
| CONTIG1540 | 12923432_f2_1 | 7317 | 21420 | 516 | 172 | | | | | |
| CONTIG1540 | 1213308_f3_3 | 7318 | 21421 | 198 | 66 | | | | | |
| CONTIG1541 | 11973151_c2_2 | 7319 | 21422 | 531 | 177 | | | | | |
| CONTIG1542 | 12923401_c2_6 | 7320 | 21423 | 294 | 98 | | | | | |
| CONTIG1544 | 4101510_c2_3 | 7321 | 21424 | 255 | 85 | | | | | |
| CONTIG1545 | 16454830_f2_3 | 7322 | 21425 | 189 | 63 | | | | | |
| CONTIG1545 | 392050_f3_4 | 7323 | 21426 | 522 | 174 | | | | | |
| CONTIG1546 | 23862763_c1_4 | 7324 | 21427 | 201 | 67 | | | | | |
| CONTIG1546 | 31838286_c2_5 | 7325 | 21428 | 210 | 70 | | | | | |
| CONTIG1547 | 34585765_f1_1 | 7326 | 21429 | 189 | 63 | | | | | |
| CONTIG1547 | 32082526_c1_3 | 7327 | 21430 | 195 | 65 | | | | | |
| CONTIG1548 | 21568786_f2_2 | 7328 | 21431 | 237 | 79 | | | | | |
| CONTIG1549 | 240762_f3_1 | 7329 | 21432 | 345 | 115 | | | | | |
| CONTIG1549 | 23863125_c1_3 | 7330 | 21433 | 231 | 77 | | | | | |
| CONTIG1551 | 19567176_f2_2 | 7331 | 21434 | 276 | 92 | | | | | |
| CONTIG1552 | 24862882_f1_1 | 7332 | 21435 | 270 | 90 | | | | | |
| CONTIG1555 | 22829687_f1_1 | 7333 | 21436 | 537 | 179 | | | | | |
| CONTIG1555 | 31379050_c1_4 | 7334 | 21437 | 204 | 68 | | | | | |
| CONTIG1558 | 24395002_c3_6 | 7335 | 21438 | 267 | 89 | | | | | |
| CONTIG1560 | 5111015_c3_2 | 7336 | 21439 | 189 | 63 | | | | | |
| CONTIG1561 | 36444640_f1_1 | 7337 | 21440 | 348 | 116 | | | | | |
| CONTIG1561 | 21600887_c3_6 | 7338 | 21441 | 249 | 83 | | | | | |
| CONTIG1563 | 970140_c2_3 | 7339 | 21442 | 231 | 77 | | | | | |
| CONTIG1566 | 4865665_c3_5 | 7340 | 21443 | 186 | 62 | | | | | |
| CONTIG1567 | 11976662_f1_1 | 7341 | 21444 | 363 | 121 | | | | | |
| CONTIG1567 | 20314010_f2_2 | 7342 | 21445 | 225 | 75 | | | | | |
| CONTIG1569 | 1365751_c2_4 | 7343 | 21446 | 552 | 184 | | | | | |
| CONTIG1569 | 19613181_c1_1 | 7344 | 21447 | 198 | 66 | | | | | |
| CONTIG157 | 4111650_f3_2 | 7345 | 21448 | 285 | 95 | | | | | |
| CONTIG157 | 4064751_c3_3 | 7346 | 21449 | 231 | 77 | | | | | |
| CONTIG1570 | 25503431_f2_2 | 7347 | 21450 | 417 | 139 | | | | | |
| CONTIG1571 | 4860961_c3_3 | 7348 | 21451 | 789 | 263 | | | | | |
| CONTIG1572 | 31366305_c1_4 | 7349 | 21452 | 189 | 63 | | | | | |
| CONTIG1573 | 14868752_f2_2 | 7350 | 21453 | 402 | 134 | | | | | |
| CONTIG1576 | 2_c1_7 | 7351 | 21454 | 186 | 62 | | | | | |
| CONTIG1578 | 14665887_c2_3 | 7352 | 21455 | 186 | 62 | | | | | |
| CONTIG1579 | 12703175_f1_1 | 7353 | 21456 | 309 | 103 | | | | | |
| CONTIG1579 | 4334632_c3_5 | 7354 | 21457 | 612 | 204 | | | | | |
| CONTIG158 | 6142267_f3_1 | 7355 | 21458 | 186 | 62 | | | | | |
| CONTIG1580 | 29339701_c3_7 | 7356 | 21459 | 480 | 160 | | | | | |
| CONTIG1581 | 24395162_c2_4 | 7357 | 21460 | 273 | 91 | | | | | |
| CONTIG1581 | 5939160_c3_5 | 7358 | 21461 | 333 | 111 | | | | | |
| CONTIG1582 | 24315676_f1_1 | 7359 | 21462 | 273 | 91 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1582 | 6650075_f1_2 | 7360 | 21463 | 432 | 144 | | | | | |
| CONTIG1583 | 823390_f1_1 | 7361 | 21464 | 183 | 61 | | | | | |
| CONTIG1584 | 34198427_c3_5 | 7362 | 21465 | 429 | 143 | | | | | |
| CONTIG1586 | 6678467_f3_2 | 7363 | 21466 | 288 | 96 | | | | | |
| CONTIG1587 | 22272186_c1_3 | 7364 | 21467 | 234 | 78 | | | | | |
| CONTIG1589 | 4703161_c3_3 | 7365 | 21468 | 366 | 122 | | | | | |
| CONTIG1590 | 5289715_c1_5 | 7366 | 21469 | 195 | 65 | | | | | |
| CONTIG1594 | 160302_f1_2 | 7367 | 21470 | 297 | 99 | | | | | |
| CONTIG1598 | 35183305_c1_2 | 7368 | 21471 | 195 | 65 | | | | | |
| CONTIG16 | 23595342_f3_1 | 7369 | 21472 | 192 | 64 | | | | | |
| CONTIG160 | 25500882_c3_3 | 7370 | 21473 | 507 | 169 | | | | | |
| CONTIG1600 | 16182293_f1_1 | 7371 | 21474 | 387 | 129 | | | | | |
| CONTIG1603 | 25520411_c3_6 | 7372 | 21475 | 219 | 73 | | | | | |
| CONTIG1603 | 9925003_c3_7 | 7373 | 21476 | 210 | 70 | | | | | |
| CONTIG1604 | 29469150_f1_1 | 7374 | 21477 | 1191 | 397 | | | | | |
| CONTIG1611 | 9804630_c2_2 | 7375 | 21478 | 192 | 64 | | | | | |
| CONTIG1613 | 7136715_f3_3 | 7376 | 21479 | 444 | 148 | | | | | |
| CONTIG1613 | 6267005_c2_4 | 7377 | 21480 | 207 | 69 | | | | | |
| CONTIG1613 | 9813802_c3_5 | 7378 | 21481 | 216 | 72 | | | | | |
| CONTIG1616 | 14256887_f2_2 | 7379 | 21482 | 198 | 66 | | | | | |
| CONTIG1616 | 24398390_c3_4 | 7380 | 21483 | 261 | 87 | | | | | |
| CONTIG1617 | 31926005_c3_6 | 7381 | 21484 | 765 | 255 | | | | | |
| CONTIG1620 | 32597262_f2_1 | 7382 | 21485 | 888 | 296 | | | | | |
| CONTIG1623 | 10751262_f1_1 | 7383 | 21486 | 285 | 95 | | | | | |
| CONTIG1628 | 13707193_f2_2 | 7384 | 21487 | 198 | 66 | | | | | |
| CONTIG1628 | 32319655_f3_3 | 7385 | 21488 | 285 | 95 | | | | | |
| CONTIG1628 | 33212812_c3_5 | 7386 | 21489 | 567 | 189 | | | | | |
| CONTIG1629 | 23928387_f3_2 | 7387 | 21490 | 210 | 70 | | | | | |
| CONTIG163 | 10242953_f1_1 | 7388 | 21491 | 444 | 148 | | | | | |
| CONTIG163 | 21660805_f3_4 | 7389 | 21492 | 465 | 155 | | | | | |
| CONTIG1630 | 1171936_f1_1 | 7390 | 21493 | 192 | 64 | | | | | |
| CONTIG1630 | 33785450_c3_6 | 7391 | 21494 | 228 | 76 | | | | | |
| CONTIG1631 | 22362640_f2_3 | 7392 | 21495 | 300 | 100 | | | | | |
| CONTIG1634 | 12584555_f2_1 | 7393 | 21496 | 264 | 88 | | | | | |
| CONTIG1635 | 24414167_f1_2 | 7394 | 21497 | 195 | 65 | | | | | |
| CONTIG1636 | 22849053_f3_1 | 7395 | 21498 | 189 | 63 | | | | | |
| CONTIG1637 | 1211592_f2_1 | 7396 | 21499 | 288 | 96 | | | | | |
| CONTIG1639 | 20744093_f1_1 | 7397 | 21500 | 198 | 66 | | | | | |
| CONTIG1639 | 22071003_c2_2 | 7398 | 21501 | 186 | 62 | | | | | |
| CONTIG1640 | 31822538_c1_3 | 7399 | 21502 | 228 | 76 | | | | | |
| CONTIG1641 | 24413463_c3_5 | 7400 | 21503 | 219 | 73 | | | | | |
| CONTIG1642 | 33791532_c1_5 | 7401 | 21504 | 291 | 97 | | | | | |
| CONTIG1642 | 24491437_c2_6 | 7402 | 21505 | 909 | 303 | | | | | |
| CONTIG1643 | 23987800_c3_4 | 7403 | 21506 | 216 | 72 | | | | | |
| CONTIG1644 | 781500_c1_1 | 7404 | 21507 | 183 | 61 | | | | | |
| CONTIG165 | 58332_f3_1 | 7405 | 21508 | 645 | 215 | | | | | |
| CONTIG1651 | 25399142_c2_2 | 7406 | 21509 | 960 | 320 | | | | | |
| CONTIG1651 | 23593812_c2_3 | 7407 | 21510 | 519 | 173 | | | | | |
| CONTIG1653 | 4330262_c2_2 | 7408 | 21511 | 291 | 97 | | | | | |
| | | | | 222 | 74 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1653 | 24023407_c3_3 | 7409 | 21512 | 213 | 71 | | | | | |
| CONTIG1654 | 35350817_f3_1 | 7410 | 21513 | 558 | 186 | | | | | |
| CONTIG1655 | 14566550_c1_2 | 7411 | 21514 | 297 | 99 | | | | | |
| CONTIG1655 | 40905_c3_4 | 7412 | 21515 | 264 | 88 | | | | | |
| CONTIG1656 | 24392252_c3_5 | 7413 | 21516 | 351 | 117 | | | | | |
| CONTIG1658 | 21677000_c3_4 | 7414 | 21517 | 216 | 72 | | | | | |
| CONTIG1664 | 581567_f3_4 | 7415 | 21518 | 225 | 75 | | | | | |
| CONTIG1665 | 2068756_c3_2 | 7416 | 21519 | 183 | 61 | | | | | |
| CONTIG1666 | 6720640_f2_1 | 7417 | 21520 | 303 | 101 | | | | | |
| CONTIG1667 | 50650_f1_2 | 7418 | 21521 | 324 | 108 | | | | | |
| CONTIG1674 | 553962_c3_6 | 7419 | 21522 | 186 | 62 | | | | | |
| CONTIG1679 | 392762_c3_2 | 7420 | 21523 | 267 | 89 | | | | | |
| CONTIG1679 | 2755302_c2_1 | 7421 | 21524 | 261 | 87 | | | | | |
| CONTIG168 | 5860637_c3_2 | 7422 | 21525 | 234 | 78 | | | | | |
| CONTIG168 | 193811_c1_3 | 7423 | 21526 | 201 | 67 | | | | | |
| CONTIG1680 | 9923561_c2_4 | 7424 | 21527 | 348 | 116 | | | | | |
| CONTIG1680 | 6831436_f1_1 | 7425 | 21528 | 222 | 74 | | | | | |
| CONTIG1680 | 3917562_f1_2 | 7426 | 21529 | 195 | 65 | | | | | |
| CONTIG1680 | 29488177_c2_4 | 7427 | 21530 | 183 | 61 | | | | | |
| CONTIG1682 | 31801892_f2_3 | 7428 | 21531 | 207 | 69 | | | | | |
| CONTIG1687 | 2063800_f3_3 | 7429 | 21532 | 198 | 66 | | | | | |
| CONTIG1687 | 26773387_c3_6 | 7430 | 21533 | 198 | 66 | | | | | |
| CONTIG1689 | 12166512_c1_2 | 7431 | 21534 | 243 | 81 | | | | | |
| CONTIG1696 | 23942152_c1_3 | 7432 | 21535 | 297 | 99 | | | | | |
| CONTIG1697 | 35351586_c2_3 | 7433 | 21536 | 267 | 89 | | | | | |
| CONTIG170 | 22464562_c3_5 | 7434 | 21537 | 201 | 67 | | | | | |
| CONTIG170 | 11835142_c3_6 | 7435 | 21538 | 216 | 72 | | | | | |
| CONTIG1700 | 4742141_c2_2 | 7436 | 21539 | 189 | 63 | | | | | |
| CONTIG1701 | 4726450_f1_1 | 7437 | 21540 | 660 | 220 | | | | | |
| CONTIG1701 | 12523392_c1_4 | 7438 | 21541 | 498 | 166 | | | | | |
| CONTIG1702 | 24786002_f3_3 | 7439 | 21542 | 1053 | 351 | | | | | |
| CONTIG1702 | 35205382_c3_6 | 7440 | 21543 | 357 | 119 | | | | | |
| CONTIG1703 | 1409450_c3_4 | 7441 | 21544 | 198 | 66 | | | | | |
| CONTIG1703 | 13671875_c3_5 | 7442 | 21545 | 354 | 118 | | | | | |
| CONTIG1704 | 10290807_f3_3 | 7443 | 21546 | 183 | 61 | | | | | |
| CONTIG1704 | 15912_c3_5 | 7444 | 21547 | 279 | 93 | | | | | |
| CONTIG1707 | 20345052_f2_1 | 7445 | 21548 | 195 | 65 | | | | | |
| CONTIG1708 | 22287635_f3_8 | 7446 | 21549 | 249 | 83 | | | | | |
| CONTIG1710 | 13859437_f3_1 | 7447 | 21550 | 195 | 65 | | | | | |
| CONTIG1711 | 35440677_f3_1 | 7448 | 21551 | 189 | 63 | | | | | |
| CONTIG1711 | 24100302_f3_3 | 7449 | 21552 | 801 | 267 | | | | | |
| CONTIG1712 | 4975682_f2_5 | 7450 | 21553 | 705 | 235 | | | | | |
| CONTIG1714 | 22767057_c2_2 | 7451 | 21554 | 675 | 225 | | | | | |
| CONTIG1714 | 20345086_c3_4 | 7452 | 21555 | 240 | 80 | | | | | |
| CONTIG1715 | 6835937_f1_1 | 7453 | 21556 | 210 | 70 | | | | | |
| CONTIG1715 | 5879562_f2_5 | 7454 | 21557 | 213 | 71 | | | | | |
| CONTIG1721 | 970180_f2_2 | 7455 | 21558 | 240 | 80 | | | | | |
| CONTIG1722 | 5117250_f3_1 | 7456 | 21559 | 189 | 63 | | | | | |
| CONTIG1722 | 29587882_c2_2 | 7457 | 21560 | 186 | 62 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1723 | 33204686_f3_3 | 7458 | 21561 | 216 | 72 | | | | | |
| CONTIG1723 | 25672091_c1_4 | 7459 | 21562 | 186 | 62 | | | | | |
| CONTIG1724 | 23910878_c2_3 | 7460 | 21563 | 204 | 68 | | | | | |
| CONTIG1725 | 4015950_c2_2 | 7461 | 21564 | 411 | 137 | | | | | |
| CONTIG1726 | 30556707_f3_1 | 7462 | 21565 | 219 | 73 | | | | | |
| CONTIG1726 | 23850655_c3_2 | 7463 | 21566 | 645 | 215 | | | | | |
| CONTIG1728 | 13148479_c3_4 | 7464 | 21567 | 231 | 77 | | | | | |
| CONTIG1730 | 175137_c2_2 | 7465 | 21568 | 252 | 84 | | | | | |
| CONTIG1731 | 189003_c1_5 | 7466 | 21569 | 204 | 68 | | | | | |
| CONTIG1731 | 21523467_c1_6 | 7467 | 21570 | 192 | 64 | | | | | |
| CONTIG1733 | 21757052_f2_1 | 7468 | 21571 | 186 | 62 | | | | | |
| CONTIG1737 | 1992337_c1_4 | 7469 | 21572 | 204 | 68 | | | | | |
| CONTIG1739 | 5265760_f3_3 | 7470 | 21573 | 276 | 92 | | | | | |
| CONTIG1739 | 5287887_c2_4 | 7471 | 21574 | 192 | 64 | | | | | |
| CONTIG1743 | 4063136_c2_4 | 7472 | 21575 | 708 | 236 | | | | | |
| CONTIG1744 | 30172510_f2_4 | 7473 | 21576 | 183 | 61 | | | | | |
| CONTIG1744 | 25995715_f2_5 | 7474 | 21577 | 234 | 78 | | | | | |
| CONTIG1744 | 4197013_c1_8 | 7475 | 21578 | 348 | 116 | | | | | |
| CONTIG1745 | 24423142_c2_4 | 7476 | 21579 | 552 | 184 | | | | | |
| CONTIG1748 | 11971901_c3_3 | 7477 | 21580 | 282 | 94 | | | | | |
| CONTIG1748 | 34194677_c3_4 | 7478 | 21581 | 405 | 135 | | | | | |
| CONTIG1749 | 22378931_c1_2 | 7479 | 21582 | 291 | 97 | | | | | |
| CONTIG1751 | 1206558_f3_1 | 7480 | 21583 | 396 | 132 | | | | | |
| CONTIG1751 | 1_c1_3 | 7481 | 21584 | 345 | 115 | | | | | |
| CONTIG1752 | 29300138_f2_1 | 7482 | 21585 | 186 | 62 | | | | | |
| CONTIG1753 | 33876437_f1_1 | 7483 | 21586 | 684 | 228 | | | | | |
| CONTIG1753 | 23720302_c3_4 | 7484 | 21587 | 447 | 149 | | | | | |
| CONTIG1759 | 210202_c2_2 | 7485 | 21588 | 201 | 67 | | | | | |
| CONTIG176 | 19539000_f1_1 | 7486 | 21589 | 189 | 63 | | | | | |
| CONTIG1761 | 4723313_f1_1 | 7487 | 21590 | 240 | 80 | | | | | |
| CONTIG1763 | 5939068_c1_2 | 7488 | 21591 | 198 | 66 | | | | | |
| CONTIG1765 | 24015750_c3_3 | 7489 | 21592 | 186 | 62 | | | | | |
| CONTIG1766 | 2819525_f2_3 | 7490 | 21593 | 240 | 80 | | | | | |
| CONTIG1767 | 26377213_f2_1 | 7491 | 21594 | 264 | 88 | | | | | |
| CONTIG1767 | 3336502_f2_2 | 7492 | 21595 | 372 | 124 | | | | | |
| CONTIG1768 | 4687531_c1_3 | 7493 | 21596 | 543 | 181 | | | | | |
| CONTIG1769 | 13165627_c2_2 | 7494 | 21597 | 648 | 216 | | | | | |
| CONTIG1769 | 860751_c2_3 | 7495 | 21598 | 264 | 88 | | | | | |
| CONTIG1774 | 26426437_f3_2 | 7496 | 21599 | 1194 | 398 | | | | | |
| CONTIG1775 | 25579766_f3_1 | 7497 | 21600 | 219 | 73 | | | | | |
| CONTIG1776 | 14504552_c2_6 | 7498 | 21601 | 315 | 105 | | | | | |
| CONTIG1777 | 21907276_c3_4 | 7499 | 21602 | 186 | 62 | | | | | |
| CONTIG1780 | 6681587_f3_3 | 7500 | 21603 | 288 | 96 | | | | | |
| CONTIG1780 | 30271881_c1_4 | 7501 | 21604 | 264 | 88 | | | | | |
| CONTIG1782 | 21881451_f1_1 | 7502 | 21605 | 507 | 169 | | | | | |
| CONTIG1782 | 14657513_f1_2 | 7503 | 21606 | 237 | 79 | | | | | |
| CONTIG1785 | 23595283_f3_5 | 7504 | 21607 | 261 | 87 | | | | | |
| CONTIG1785 | 31760052_f1_2 | 7505 | 21608 | 207 | 69 | | | | | |
| CONTIG1786 | 3946900_f1_1 | 7506 | 21609 | 321 | 107 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1786 | 2942212_f2_2 | 7507 | 21610 | 633 | 211 | | | | | |
| CONTIG1787 | 4892186_f3_3 | 7508 | 21611 | 252 | 84 | | | | | |
| CONTIG1789 | 35166002_f2_1 | 7509 | 21612 | 186 | 62 | | | | | |
| CONTIG1790 | 20820781_f3_2 | 7510 | 21613 | 873 | 291 | | | | | |
| CONTIG1790 | 85177_c3_5 | 7511 | 21614 | 195 | 65 | | | | | |
| CONTIG1791 | 4689378_c2_4 | 7512 | 21615 | 672 | 224 | | | | | |
| CONTIG1792 | 4687632_c3_4 | 7513 | 21616 | 276 | 92 | | | | | |
| CONTIG1794 | 22069052_f1_1 | 7514 | 21617 | 210 | 70 | | | | | |
| CONTIG1794 | 5891333_f1_2 | 7515 | 21618 | 186 | 62 | | | | | |
| CONTIG1794 | 1210760_c2_3 | 7516 | 21619 | 207 | 69 | | | | | |
| CONTIG1795 | 25431325_f2_3 | 7517 | 21620 | 207 | 69 | | | | | |
| CONTIG1796 | 4531437_f1_2 | 7518 | 21621 | 255 | 85 | | | | | |
| CONTIG1798 | 22709505_f2_2 | 7519 | 21622 | 261 | 87 | | | | | |
| CONTIG1799 | 13944051_c1_5 | 7520 | 21623 | 213 | 71 | | | | | |
| CONTIG1799 | 4886380_c3_6 | 7521 | 21624 | 1227 | 409 | | | | | |
| CONTIG180 | 13100692_c2_5 | 7522 | 21625 | 306 | 102 | | | | | |
| CONTIG1800 | 40037787_c2_1 | 7523 | 21626 | 759 | 253 | | | | | |
| CONTIG1802 | 511457_f2_1 | 7524 | 21627 | 1143 | 381 | | | | | |
| CONTIG1805 | 9897807_f2_4 | 7525 | 21628 | 216 | 72 | | | | | |
| CONTIG1805 | 7114027_c1_5 | 7526 | 21629 | 852 | 284 | | | | | |
| CONTIG1808 | 10637317_f3_1 | 7527 | 21630 | 477 | 159 | | | | | |
| CONTIG1808 | 14943905_c3_3 | 7528 | 21631 | 480 | 160 | | | | | |
| CONTIG181 | 34179688_c2_3 | 7529 | 21632 | 474 | 158 | | | | | |
| CONTIG1810 | 4353260_f3_5 | 7530 | 21633 | 201 | 67 | | | | | |
| CONTIG1810 | 19766250_c2_7 | 7531 | 21634 | 195 | 65 | | | | | |
| CONTIG1810 | 21650312_c3_9 | 7532 | 21635 | 408 | 136 | | | | | |
| CONTIG1812 | 271952_f3_2 | 7533 | 21636 | 348 | 116 | | | | | |
| CONTIG1813 | 24022762_f3_2 | 7534 | 21637 | 189 | 63 | | | | | |
| CONTIG1813 | 1953175_c1_3 | 7535 | 21638 | 198 | 66 | | | | | |
| CONTIG1814 | 24257786_c2_4 | 7536 | 21639 | 240 | 80 | | | | | |
| CONTIG1814 | 32692188_c3_6 | 7537 | 21640 | 183 | 61 | | | | | |
| CONTIG1816 | 4063915_c2_4 | 7538 | 21641 | 192 | 64 | | | | | |
| CONTIG1817 | 4741377_c1_3 | 7539 | 21642 | 282 | 94 | | | | | |
| CONTIG182 | 2011457_f2_1 | 7540 | 21643 | 612 | 204 | | | | | |
| CONTIG1821 | 23547502_c2_4 | 7541 | 21644 | 735 | 245 | | | | | |
| CONTIG1822 | 7078427_c2_3 | 7542 | 21645 | 315 | 105 | | | | | |
| CONTIG1823 | 35188317_f1_1 | 7543 | 21646 | 540 | 180 | | | | | |
| CONTIG1823 | 22031706_c1_2 | 7544 | 21647 | 207 | 69 | | | | | |
| CONTIG1823 | 390925_c3_4 | 7545 | 21648 | 255 | 85 | | | | | |
| CONTIG1825 | 15867067_f2_3 | 7546 | 21649 | 999 | 333 | | | | | |
| CONTIG1826 | 43943762_c1_2 | 7547 | 21650 | 798 | 266 | | | | | |
| CONTIG1828 | 25423501_f1_1 | 7548 | 21651 | 426 | 142 | | | | | |
| CONTIG1829 | 2166025_f2_1 | 7549 | 21652 | 921 | 307 | | | | | |
| CONTIG1829 | 2997641_c2_3 | 7550 | 21653 | 210 | 70 | | | | | |
| CONTIG1829 | 29532501_c3_4 | 7551 | 21654 | 276 | 92 | | | | | |
| CONTIG183 | 19718875_c3_1 | 7552 | 21655 | 186 | 62 | | | | | |
| CONTIG1830 | 19931265_f1_2 | 7553 | 21656 | 216 | 72 | | | | | |
| CONTIG1832 | 24220277_f2_2 | 7554 | 21657 | 417 | 139 | | | | | |
| CONTIG1835 | 21875325_f3_1 | 7555 | 21658 | 219 | 73 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1837 | 23711638_f3_2 | 7556 | 21659 | 792 | 264 | | | | | |
| CONTIG1838 | 3906253_c2_3 | 7557 | 21660 | 216 | 72 | | | | | |
| CONTIG1838 | 1462875_c3_4 | 7558 | 21661 | 219 | 73 | | | | | |
| CONTIG1839 | 24093812_f2_3 | 7559 | 21662 | 351 | 117 | | | | | |
| CONTIG1839 | 21955362_c2_5 | 7560 | 21663 | 204 | 68 | | | | | |
| CONTIG1841 | 29375312_f2_1 | 7561 | 21664 | 189 | 63 | | | | | |
| CONTIG1844 | 35175385_f2_1 | 7562 | 21665 | 288 | 96 | | | | | |
| CONTIG1844 | 11878885_c3_4 | 7563 | 21666 | 519 | 173 | | | | | |
| CONTIG1845 | 31641965_f2_1 | 7564 | 21667 | 258 | 86 | | | | | |
| CONTIG1845 | 24412812_f3_3 | 7565 | 21668 | 261 | 87 | | | | | |
| CONTIG1846 | 2375812_f2_1 | 7566 | 21669 | 1071 | 357 | | | | | |
| CONTIG1847 | 4969506_c2_6 | 7567 | 21670 | 1257 | 419 | | | | | |
| CONTIG185 | 24697030_c3_3 | 7568 | 21671 | 195 | 65 | | | | | |
| CONTIG1852 | 173192_f2_1 | 7569 | 21672 | 432 | 144 | | | | | |
| CONTIG1852 | 3908162_c3_3 | 7570 | 21673 | 204 | 68 | | | | | |
| CONTIG1856 | 2643062_f1_1 | 7571 | 21674 | 243 | 81 | | | | | |
| CONTIG1856 | 11110037_f1_2 | 7572 | 21675 | 246 | 82 | | | | | |
| CONTIG1858 | 21484713_c1_3 | 7573 | 21676 | 315 | 105 | | | | | |
| CONTIG1858 | 26461567_c3_1 | 7574 | 21677 | 222 | 74 | | | | | |
| CONTIG1860 | 24650941_c2_3 | 7575 | 21678 | 534 | 178 | | | | | |
| CONTIG1862 | 9960316_f1_1 | 7576 | 21679 | 216 | 72 | | | | | |
| CONTIG1863 | 23532187_f1_1 | 7577 | 21680 | 876 | 292 | | | | | |
| CONTIG1864 | 24667828_f1_1 | 7578 | 21681 | 252 | 84 | | | | | |
| CONTIG1866 | 6051555_f2_3 | 7579 | 21682 | 207 | 69 | | | | | |
| CONTIG1866 | 13726557_c2_5 | 7580 | 21683 | 183 | 61 | | | | | |
| CONTIG1867 | 23635881_f2_1 | 7581 | 21684 | 867 | 289 | | | | | |
| CONTIG1868 | 14490927_f3_2 | 7582 | 21685 | 204 | 68 | | | | | |
| CONTIG1868 | 4727192_c1_3 | 7583 | 21686 | 312 | 104 | | | | | |
| CONTIG1868 | 4890680_c3_5 | 7584 | 21687 | 360 | 120 | | | | | |
| CONTIG1869 | 4803550_c3_3 | 7585 | 21688 | 219 | 73 | | | | | |
| CONTIG1875 | 4710051_c3_4 | 7586 | 21689 | 312 | 104 | | | | | |
| CONTIG1878 | 24801886_f1_1 | 7587 | 21690 | 261 | 87 | | | | | |
| CONTIG1878 | 10730000_c3_3 | 7588 | 21691 | 183 | 61 | | | | | |
| CONTIG1879 | 20422577_f1_2 | 7589 | 21692 | 504 | 168 | | | | | |
| CONTIG1879 | 23865887_c2_5 | 7590 | 21693 | 189 | 63 | | | | | |
| CONTIG1880 | 36042130_c2_4 | 7591 | 21694 | 258 | 86 | | | | | |
| CONTIG1882 | 2783177_c1_5 | 7592 | 21695 | 204 | 68 | | | | | |
| CONTIG1882 | 32085452_c2_7 | 7593 | 21696 | 195 | 65 | | | | | |
| CONTIG1884 | 1970075_c3_3 | 7594 | 21697 | 231 | 77 | | | | | |
| CONTIG1887 | 24007161_f2_4 | 7595 | 21698 | 189 | 63 | | | | | |
| CONTIG1887 | 29500375_c2_6 | 7596 | 21699 | 618 | 206 | | | | | |
| CONTIG1889 | 24040887_c2_4 | 7597 | 21700 | 729 | 243 | | | | | |
| CONTIG1889 | 1219663_c3_5 | 7598 | 21701 | 207 | 69 | | | | | |
| CONTIG189 | 21959468_c2_2 | 7599 | 21702 | 585 | 195 | | | | | |
| CONTIG1892 | 4703510_f3_1 | 7600 | 21703 | 1017 | 339 | | | | | |
| CONTIG1893 | 21727187_f2_1 | 7601 | 21704 | 198 | 66 | | | | | |
| CONTIG1893 | 23712642_f2_2 | 7602 | 21705 | 267 | 89 | | | | | |
| CONTIG1894 | 11812676_f2_1 | 7603 | 21706 | 807 | 269 | | | | | |
| CONTIG1894 | 24900300_c3_6 | 7604 | 21707 | 261 | 87 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG1899 | 25562688_f1_1 | 7605 | 21708 | 189 | 63 | | | | | |
| CONTIG1899 | 26464177_c3_4 | 7606 | 21709 | 303 | 101 | | | | | |
| CONTIG190 | 35949186_c1_1 | 7607 | 21710 | 216 | 72 | | | | | |
| CONTIG1900 | 189003_c2_4 | 7608 | 21711 | 198 | 66 | | | | | |
| CONTIG1901 | 23628938_c3_3 | 7609 | 21712 | 381 | 127 | | | | | |
| CONTIG1904 | 207658_f2_2 | 7610 | 21713 | 276 | 92 | | | | | |
| CONTIG1905 | 26761442_f3_3 | 7611 | 21714 | 234 | 78 | | | | | |
| CONTIG1906 | 11220463_f2_2 | 7612 | 21715 | 240 | 80 | | | | | |
| CONTIG1908 | 24022062_f1_1 | 7613 | 21716 | 195 | 65 | | | | | |
| CONTIG1908 | 21500007_c1_2 | 7614 | 21717 | 234 | 78 | | | | | |
| CONTIG1908 | 5172126_c2_3 | 7615 | 21718 | 222 | 74 | | | | | |
| CONTIG1908 | 5321051_c3_6 | 7616 | 21719 | 183 | 61 | | | | | |
| CONTIG1909 | 4820441_f3_1 | 7617 | 21720 | 207 | 69 | | | | | |
| CONTIG1910 | 11885387_c3_5 | 7618 | 21721 | 249 | 83 | | | | | |
| CONTIG1911 | 10635253_f1_1 | 7619 | 21722 | 1113 | 371 | | | | | |
| CONTIG1912 | 81882_c2_1 | 7620 | 21723 | 246 | 82 | | | | | |
| CONTIG1914 | 9806312_f2_4 | 7621 | 21724 | 186 | 62 | | | | | |
| CONTIG1915 | 792057_c1_1 | 7622 | 21725 | 189 | 63 | | | | | |
| CONTIG1919 | 4970962_f1_1 | 7623 | 21726 | 267 | 89 | | | | | |
| CONTIG1919 | 30501892_c2_7 | 7624 | 21727 | 219 | 73 | | | | | |
| CONTIG1920 | 15714052_f2_1 | 7625 | 21728 | 201 | 67 | | | | | |
| CONTIG1921 | 36367183_c3_3 | 7626 | 21729 | 363 | 121 | | | | | |
| CONTIG1925 | 4865950_f1_1 | 7627 | 21730 | 507 | 169 | | | | | |
| CONTIG1925 | 4344128_f2_4 | 7628 | 21731 | 210 | 70 | | | | | |
| CONTIG1925 | 12128135_f3_5 | 7629 | 21732 | 597 | 199 | | | | | |
| CONTIG1929 | 26758388_f1_2 | 7630 | 21733 | 252 | 84 | | | | | |
| CONTIG1929 | 22453138_f1_1 | 7631 | 21734 | 354 | 118 | | | | | |
| CONTIG193 | 20428132_c1_4 | 7632 | 21735 | 867 | 289 | | | | | |
| CONTIG1931 | 10034687_f1_1 | 7633 | 21736 | 204 | 68 | | | | | |
| CONTIG1932 | 24337752_f3_3 | 7634 | 21737 | 237 | 79 | | | | | |
| CONTIG1932 | 16523403_f1_2 | 7635 | 21738 | 243 | 81 | | | | | |
| CONTIG1935 | 10553530_c2_2 | 7636 | 21739 | 1095 | 365 | | | | | |
| CONTIG1937 | 12634575_f3_3 | 7637 | 21740 | 192 | 64 | | | | | |
| CONTIG1938 | 100637_c3_6 | 7638 | 21741 | 513 | 171 | | | | | |
| CONTIG1938 | 4961505_c3_1 | 7639 | 21742 | 321 | 107 | | | | | |
| CONTIG1939 | 36589213_c1_2 | 7640 | 21743 | 255 | 85 | | | | | |
| CONTIG1942 | 24241557_c3_3 | 7641 | 21744 | 207 | 69 | | | | | |
| CONTIG1942 | 12553555_c3_4 | 7642 | 21745 | 240 | 80 | | | | | |
| CONTIG1943 | 12010417_f1_1 | 7643 | 21746 | 441 | 147 | | | | | |
| CONTIG1945 | 13868757_f2_2 | 7644 | 21747 | 192 | 64 | | | | | |
| CONTIG1945 | 4298403_f1_1 | 7645 | 21748 | 237 | 79 | | | | | |
| CONTIG1946 | 9797753_f2_3 | 7646 | 21749 | 249 | 83 | | | | | |
| CONTIG1946 | 24614137_f3_1 | 7647 | 21750 | 201 | 67 | | | | | |
| CONTIG1949 | 6038128_c2_6 | 7648 | 21751 | 723 | 241 | | | | | |
| CONTIG1953 | 1464430_f2_3 | 7649 | 21752 | 531 | 177 | | | | | |
| CONTIG1954 | 35346942_c1_7 | 7650 | 21753 | 207 | 69 | | | | | |
| CONTIG1954 | 22445326_f1_1 | 7651 | 21754 | 405 | 135 | | | | | |
| CONTIG1955 | 2929511_f2_5 | 7652 | 21755 | 312 | 104 | | | | | |
| CONTIG1959 | 4141005_c1_3 | 7653 | 21756 | 210 | 70 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG196 | 23651410_f1_1 | 7654 | 21757 | 558 | 186 | | | | | |
| CONTIG196 | 25601066_c2_4 | 7655 | 21758 | 306 | 102 | | | | | |
| CONTIG1960 | 4694055_c2_7 | 7656 | 21759 | 441 | 147 | | | | | |
| CONTIG1963 | 82502_f1_1 | 7657 | 21760 | 1479 | 493 | | | | | |
| CONTIG1964 | 35196913_c1_2 | 7658 | 21761 | 285 | 95 | | | | | |
| CONTIG1966 | 23925400_f2_2 | 7659 | 21762 | 912 | 304 | | | | | |
| CONTIG1966 | 11719216_f3_3 | 7660 | 21763 | 390 | 130 | | | | | |
| CONTIG1968 | 19562586_c1_3 | 7661 | 21764 | 417 | 139 | | | | | |
| CONTIG1970 | 23600887_c1_2 | 7662 | 21765 | 225 | 75 | | | | | |
| CONTIG1970 | 32627_c2_4 | 7663 | 21766 | 192 | 64 | | | | | |
| CONTIG1971 | 34567840_c2_6 | 7664 | 21767 | 1089 | 363 | | | | | |
| CONTIG1972 | 16220432_c1_4 | 7665 | 21768 | 585 | 195 | | | | | |
| CONTIG1973 | 22275425_f3_1 | 7666 | 21769 | 219 | 73 | | | | | |
| CONTIG1973 | 19628812_c2_3 | 7667 | 21770 | 183 | 61 | | | | | |
| CONTIG1974 | 34614062_c3_7 | 7668 | 21771 | 294 | 98 | | | | | |
| CONTIG1975 | 29801500_f2_2 | 7669 | 21772 | 204 | 68 | | | | | |
| CONTIG1982 | 26438_c2_4 | 7670 | 21773 | 189 | 63 | | | | | |
| CONTIG1983 | 30517700_c1_2 | 7671 | 21774 | 195 | 65 | | | | | |
| CONTIG1983 | 35423410_c1_3 | 7672 | 21775 | 300 | 100 | | | | | |
| CONTIG1985 | 21692875_f1_1 | 7673 | 21776 | 222 | 74 | | | | | |
| CONTIG1986 | 10637757_f1_1 | 7674 | 21777 | 972 | 324 | | | | | |
| CONTIG1986 | 26772175_c3_3 | 7675 | 21778 | 228 | 76 | | | | | |
| CONTIG1987 | 12115943_c1_5 | 7676 | 21779 | 408 | 136 | | | | | |
| CONTIG1990 | 5353467_f3_3 | 7677 | 21780 | 498 | 166 | | | | | |
| CONTIG1991 | 14494061_f2_2 | 7678 | 21781 | 627 | 209 | | | | | |
| CONTIG1992 | 21696938_f1_2 | 7679 | 21782 | 186 | 62 | | | | | |
| CONTIG1994 | 4328311_c1_4 | 7680 | 21783 | 231 | 77 | | | | | |
| CONTIG1994 | 12582927_c2_5 | 7681 | 21784 | 564 | 188 | | | | | |
| CONTIG1995 | 973535_c2_2 | 7682 | 21785 | 246 | 82 | | | | | |
| CONTIG1996 | 3336502_f3_2 | 7683 | 21786 | 372 | 124 | | | | | |
| CONTIG1997 | 860056_f2_2 | 7684 | 21787 | 273 | 91 | | | | | |
| CONTIG1997 | 9772055_f3_6 | 7685 | 21788 | 195 | 65 | | | | | |
| CONTIG1998 | 4729717_f3_3 | 7686 | 21789 | 204 | 68 | | | | | |
| CONTIG1998 | 12284500_c2_6 | 7687 | 21790 | 339 | 113 | | | | | |
| CONTIG1999 | 1312_f3_2 | 7688 | 21791 | 279 | 93 | | | | | |
| CONTIG1999 | 14652127_c3_4 | 7689 | 21792 | 303 | 101 | | | | | |
| CONTIG2 | 5859667_c1_1 | 7690 | 21793 | 294 | 98 | | | | | |
| CONTIG2001 | 20334635_f3_1 | 7691 | 21794 | 249 | 83 | | | | | |
| CONTIG2004 | 34068800_f3_4 | 7692 | 21795 | 567 | 189 | | | | | |
| CONTIG2005 | 29381260_f2_2 | 7693 | 21796 | 321 | 107 | | | | | |
| CONTIG2005 | 34554717_c2_4 | 7694 | 21797 | 276 | 92 | | | | | |
| CONTIG2006 | 24400905_f1_1 | 7695 | 21798 | 339 | 72 | | | | | |
| CONTIG2006 | 19921890_f1_2 | 7696 | 21799 | 210 | 70 | | | | | |
| CONTIG2006 | 12500010_f1_3 | 7697 | 21800 | 186 | 62 | | | | | |
| CONTIG2007 | 21953140_f2_4 | 7698 | 21801 | 255 | 85 | | | | | |
| CONTIG2007 | 21961012_f2_2 | 7699 | 21802 | 1161 | 387 | | | | | |
| CONTIG2009 | 35554062_f2_3 | 7700 | 21803 | 183 | 61 | | | | | |
| CONTIG2009 | 2923508_c3_4 | 7701 | 21804 | 306 | 102 | | | | | |
| CONTIG2012 | 14928292_c1_3 | 7702 | 21805 | 243 | 81 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2015 | 33991062_c1_2 | 7703 | 21806 | 270 | 90 | | | | | |
| CONTIG2017 | 4472813_c2_4 | 7704 | 21807 | 831 | 277 | | | | | |
| CONTIG202 | 2449218_f3_2 | 7705 | 21808 | 510 | 170 | | | | | |
| CONTIG2022 | 893806_c1_2 | 7706 | 21809 | 402 | 134 | | | | | |
| CONTIG2024 | 20968927_c2_3 | 7707 | 21810 | 285 | 95 | | | | | |
| CONTIG2026 | 882093_c1_2 | 7708 | 21811 | 228 | 76 | | | | | |
| CONTIG203 | 36222686_c2_2 | 7709 | 21812 | 201 | 67 | | | | | |
| CONTIG2032 | 5860930_f2_1 | 7710 | 21813 | 198 | 66 | | | | | |
| CONTIG2034 | 29578378_f2_4 | 7711 | 21814 | 183 | 61 | | | | | |
| CONTIG2034 | 25431566_f3_7 | 7712 | 21815 | 276 | 92 | | | | | |
| CONTIG2034 | 1954687_c1_8 | 7713 | 21816 | 891 | 297 | | | | | |
| CONTIG2035 | 5328452_c3_4 | 7714 | 21817 | 477 | 159 | | | | | |
| CONTIG2038 | 19975151_c3_2 | 7715 | 21818 | 603 | 201 | | | | | |
| CONTIG2040 | 94127_f1_1 | 7716 | 21819 | 573 | 191 | | | | | |
| CONTIG2040 | 21522817_c2_3 | 7717 | 21820 | 252 | 84 | | | | | |
| CONTIG2043 | 23673260_c1_2 | 7718 | 21821 | 186 | 62 | | | | | |
| CONTIG2043 | 205191_c2_3 | 7719 | 21822 | 333 | 111 | | | | | |
| CONTIG2047 | 14254500_c3_5 | 7720 | 21823 | 243 | 81 | | | | | |
| CONTIG2049 | 24259687_f3_3 | 7721 | 21824 | 228 | 76 | | | | | |
| CONTIG2050 | 22444752_c2_7 | 7722 | 21825 | 213 | 71 | | | | | |
| CONTIG2051 | 25440636_c2_6 | 7723 | 21826 | 690 | 230 | | | | | |
| CONTIG2052 | 16847338_f2_2 | 7724 | 21827 | 213 | 71 | | | | | |
| CONTIG2052 | 9766903_f3_3 | 7725 | 21828 | 237 | 79 | | | | | |
| CONTIG2054 | 20398525_c2_2 | 7726 | 21829 | 201 | 67 | | | | | |
| CONTIG2055 | 1988135_c3_4 | 7727 | 21830 | 306 | 102 | | | | | |
| CONTIG2055 | 34276090_c3_5 | 7728 | 21831 | 198 | 66 | | | | | |
| CONTIG2057 | 433207_c3_4 | 7729 | 21832 | 789 | 263 | | | | | |
| CONTIG2059 | 9886457_f3_3 | 7730 | 21833 | 276 | 92 | | | | | |
| CONTIG2061 | 3937562_f3_1 | 7731 | 21834 | 180 | 60 | | | | | |
| CONTIG2061 | 35431878_c3_2 | 7732 | 21835 | 207 | 69 | | | | | |
| CONTIG2062 | 32713126_f3_1 | 7733 | 21836 | 1155 | 385 | | | | | |
| CONTIG2065 | 34255028_c1_3 | 7734 | 21837 | 330 | 110 | | | | | |
| CONTIG2069 | 1976661_f2_2 | 7735 | 21838 | 357 | 119 | | | | | |
| CONTIG2071 | 26445132_c3_3 | 7736 | 21839 | 228 | 76 | | | | | |
| CONTIG2072 | 2926500_f1_1 | 7737 | 21840 | 207 | 69 | | | | | |
| CONTIG2072 | 24022927_c1_5 | 7738 | 21841 | 183 | 61 | | | | | |
| CONTIG2073 | 4004436_c1_2 | 7739 | 21842 | 297 | 99 | | | | | |
| CONTIG2074 | 14454451_f3_4 | 7740 | 21843 | 276 | 92 | | | | | |
| CONTIG2074 | 34065686_c1_5 | 7741 | 21844 | 390 | 130 | | | | | |
| CONTIG2075 | 21678763_c1_5 | 7742 | 21845 | 1488 | 496 | | | | | |
| CONTIG2076 | 2553192_c2_3 | 7743 | 21846 | 282 | 94 | | | | | |
| CONTIG2076 | 26173187_c3_4 | 7744 | 21847 | 198 | 66 | | | | | |
| CONTIG2081 | 24886067_c1_6 | 7745 | 21848 | 210 | 70 | | | | | |
| CONTIG2081 | 26445317_c3_9 | 7746 | 21849 | 261 | 87 | | | | | |
| CONTIG2084 | 21955011_f1_1 | 7747 | 21850 | 186 | 62 | | | | | |
| CONTIG2084 | 22895703_f2_2 | 7748 | 21851 | 303 | 101 | | | | | |
| CONTIG2085 | 4022802_f1_1 | 7749 | 21852 | 189 | 63 | | | | | |
| CONTIG2085 | 4459806_f2_3 | 7750 | 21853 | 195 | 65 | | | | | |
| CONTIG2085 | 915633_f2_4 | 7751 | 21854 | 228 | 76 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2087 | 12001630_f3_2 | 7752 | 21855 | 564 | 188 | | | | | |
| CONTIG2087 | 19765711_f3_3 | 7753 | 21856 | 438 | 146 | | | | | |
| CONTIG2087 | 33362800_c3_5 | 7754 | 21857 | 258 | 86 | | | | | |
| CONTIG2088 | 24062512_f2_3 | 7755 | 21858 | 414 | 138 | | | | | |
| CONTIG2092 | 23954010_c2_3 | 7756 | 21859 | 330 | 110 | | | | | |
| CONTIG2093 | 15725817_f1_1 | 7757 | 21860 | 1251 | 417 | | | | | |
| CONTIG2095 | 26610628_c2_3 | 7758 | 21861 | 189 | 63 | | | | | |
| CONTIG2097 | 5288942_f2_1 | 7759 | 21862 | 1158 | 386 | | | | | |
| CONTIG2098 | 20348377_c3_2 | 7760 | 21863 | 738 | 246 | | | | | |
| CONTIG21 | 5995343_c2_1 | 7761 | 21864 | 192 | 64 | | | | | |
| CONTIG2100 | 23593951_c1_1 | 7762 | 21865 | 357 | 119 | | | | | |
| CONTIG2101 | 507005_c2_2 | 7763 | 21866 | 312 | 104 | | | | | |
| CONTIG2102 | 14493963_f1_3 | 7764 | 21867 | 213 | 71 | | | | | |
| CONTIG2104 | 26041327_f1_1 | 7765 | 21868 | 210 | 70 | | | | | |
| CONTIG2104 | 29313527_f1_2 | 7766 | 21869 | 195 | 65 | | | | | |
| CONTIG2104 | 29891305_c1_4 | 7767 | 21870 | 237 | 79 | | | | | |
| CONTIG2106 | 20580453_c2_4 | 7768 | 21871 | 189 | 63 | | | | | |
| CONTIG2106 | 23473380_c3_5 | 7769 | 21872 | 222 | 74 | | | | | |
| CONTIG2108 | 9767515_c1_5 | 7770 | 21873 | 192 | 64 | | | | | |
| CONTIG211 | 23914800_f1_1 | 7771 | 21874 | 303 | 101 | | | | | |
| CONTIG211 | 2628525_f1_2 | 7772 | 21875 | 252 | 84 | | | | | |
| CONTIG2115 | 16432942_c1_3 | 7773 | 21876 | 198 | 66 | | | | | |
| CONTIG2115 | 789715_c1_4 | 7774 | 21877 | 210 | 70 | | | | | |
| CONTIG2116 | 31429762_f3_2 | 7775 | 21878 | 201 | 67 | | | | | |
| CONTIG2116 | 117013_c1_4 | 7776 | 21879 | 276 | 92 | | | | | |
| CONTIG2118 | 22053411_c3_6 | 7777 | 21880 | 186 | 62 | | | | | |
| CONTIG2118 | 1459663_c2_4 | 7778 | 21881 | 195 | 65 | | | | | |
| CONTIG2118 | 6048377_c3_5 | 7779 | 21882 | 252 | 84 | | | | | |
| CONTIG2119 | 25428936_c3_6 | 7780 | 21883 | 1176 | 392 | | | | | |
| CONTIG212 | 34564531_c1_1 | 7781 | 21884 | 372 | 124 | | | | | |
| CONTIG2120 | 14117192_f2_1 | 7782 | 21885 | 486 | 162 | | | | | |
| CONTIG2122 | 33391880_f1_1 | 7783 | 21886 | 213 | 71 | | | | | |
| CONTIG2122 | 26457937_f1_1 | 7784 | 21887 | 249 | 83 | | | | | |
| CONTIG2122 | 9766253_f3_4 | 7785 | 21888 | 222 | 74 | | | | | |
| CONTIG2126 | 20423326_c1_6 | 7786 | 21889 | 198 | 66 | | | | | |
| CONTIG2132 | 23437812_f3_1 | 7787 | 21890 | 528 | 176 | | | | | |
| CONTIG2132 | 24804687_f2_2 | 7788 | 21891 | 246 | 82 | | | | | |
| CONTIG2132 | 2578436_f3_3 | 7789 | 21892 | 375 | 125 | | | | | |
| CONTIG2134 | 4961561_c3_10 | 7790 | 21893 | 183 | 61 | | | | | |
| CONTIG2135 | 885053_c2_4 | 7791 | 21894 | 531 | 177 | | | | | |
| CONTIG2137 | 1953382_f2_3 | 7792 | 21895 | 462 | 154 | | | | | |
| CONTIG2138 | 31299082_f3_6 | 7793 | 21896 | 285 | 95 | | | | | |
| CONTIG2138 | 21492916_f3_2 | 7794 | 21897 | 504 | 168 | | | | | |
| CONTIG2138 | 24486088_f2_1 | 7795 | 21898 | 468 | 156 | | | | | |
| CONTIG2139 | 24019388_f3_2 | 7796 | 21899 | 663 | 221 | | | | | |
| CONTIG2139 | 10188175_f2_1 | 7797 | 21900 | 267 | 89 | | | | | |
| CONTIG2139 | 11722175_f2_2 | 7798 | 21901 | 219 | 73 | | | | | |
| CONTIG2139 | 33785676_f3_3 | 7799 | 21902 | 648 | 216 | | | | | |
| CONTIG2141 | 24297757_c2_3 | 7800 | 21903 | 795 | 265 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2142 | 24416500_f2_2 | 7801 | 21904 | 210 | 70 | | | | | |
| CONTIG2142 | 16416062_f3_4 | 7802 | 21905 | 225 | 75 | | | | | |
| CONTIG2142 | 33330017_c3_5 | 7803 | 21906 | 411 | 137 | | | | | |
| CONTIG2143 | 3942186_f2_2 | 7804 | 21907 | 396 | 132 | | | | | |
| CONTIG2143 | 33210012_f3_3 | 7805 | 21908 | 195 | 65 | | | | | |
| CONTIG2144 | 23480752_c3_3 | 7806 | 21909 | 1029 | 343 | | | | | |
| CONTIG2148 | 1975701_f1_1 | 7807 | 21910 | 237 | 79 | | | | | |
| CONTIG2148 | 785702_f2_1 | 7808 | 21911 | 219 | 73 | | | | | |
| CONTIG2149 | 1953125_c1_2 | 7809 | 21912 | 252 | 84 | | | | | |
| CONTIG2149 | 4109762_f3_3 | 7810 | 21913 | 213 | 71 | | | | | |
| CONTIG2150 | 19724035_c2_4 | 7811 | 21914 | 282 | 94 | | | | | |
| CONTIG2150 | 24306532_c3_4 | 7812 | 21915 | 1257 | 419 | | | | | |
| CONTIG2151 | 29375275_c2_6 | 7813 | 21916 | 183 | 61 | | | | | |
| CONTIG2155 | 31328_c3_8 | 7814 | 21917 | 426 | 142 | | | | | |
| CONTIG2155 | 19725061_f2_2 | 7815 | 21918 | 183 | 61 | | | | | |
| CONTIG2158 | 197177_f3_3 | 7816 | 21919 | 972 | 324 | | | | | |
| CONTIG2158 | 878162_c2_4 | 7817 | 21920 | 186 | 62 | | | | | |
| CONTIG2159 | 25422178_f1_2 | 7818 | 21921 | 192 | 64 | | | | | |
| CONTIG2159 | 24306527_c2_6 | 7819 | 21922 | 825 | 275 | | | | | |
| CONTIG216 | 5956575_c1_1 | 7820 | 21923 | 198 | 66 | | | | | |
| CONTIG2161 | 10724007_c2_3 | 7821 | 21924 | 237 | 79 | | | | | |
| CONTIG2162 | 6776533_f3_1 | 7822 | 21925 | 192 | 64 | | | | | |
| CONTIG2164 | 5086052_f2_1 | 7823 | 21926 | 213 | 71 | | | | | |
| CONTIG2165 | 33603430_c3_2 | 7824 | 21927 | 1023 | 341 | | | | | |
| CONTIG2166 | 4094015_f2_3 | 7825 | 21928 | 216 | 72 | | | | | |
| CONTIG2167 | 14878407_f1_1 | 7826 | 21929 | 510 | 170 | | | | | |
| CONTIG2167 | 26345750_c2_4 | 7827 | 21930 | 588 | 196 | | | | | |
| CONTIG2169 | 23517083_f1_1 | 7828 | 21931 | 471 | 157 | | | | | |
| CONTIG2169 | 23829400_c1_3 | 7829 | 21932 | 348 | 116 | | | | | |
| CONTIG217 | 26613161_f2_1 | 7830 | 21933 | 519 | 173 | | | | | |
| CONTIG2170 | 24399010_f1_2 | 7831 | 21934 | 1125 | 375 | | | | | |
| CONTIG2170 | 24485875_c2_7 | 7832 | 21935 | 369 | 123 | | | | | |
| CONTIG2172 | 48760_f3_3 | 7833 | 21936 | 240 | 80 | | | | | |
| CONTIG2173 | 24470778_f2_1 | 7834 | 21937 | 288 | 96 | | | | | |
| CONTIG2178 | 23522192_c1_3 | 7835 | 21938 | 348 | 116 | | | | | |
| CONTIG2178 | 16582785_c3_5 | 7836 | 21939 | 309 | 103 | | | | | |
| CONTIG2179 | 12300807_f1_2 | 7837 | 21940 | 330 | 110 | | | | | |
| CONTIG2179 | 36128377_f1_3 | 7838 | 21941 | 222 | 74 | | | | | |
| CONTIG218 | 1968937_f3_2 | 7839 | 21942 | 231 | 77 | | | | | |
| CONTIG2180 | 25601503_f3_3 | 7840 | 21943 | 333 | 111 | | | | | |
| CONTIG2180 | 19712_c3_7 | 7841 | 21944 | 201 | 67 | | | | | |
| CONTIG2183 | 3020803_f1_1 | 7842 | 21945 | 360 | 120 | | | | | |
| CONTIG2184 | 26839843_c1_1 | 7843 | 21946 | 192 | 64 | | | | | |
| CONTIG2184 | 5250302_c3_2 | 7844 | 21947 | 201 | 67 | | | | | |
| CONTIG2185 | 36109627_c2_2 | 7845 | 21948 | 1362 | 454 | | | | | |
| CONTIG2186 | 14636337_f2_2 | 7846 | 21949 | 207 | 69 | | | | | |
| CONTIG2187 | 24484687_f1_2 | 7847 | 21950 | 189 | 63 | | | | | |
| CONTIG2188 | 21496056_c3_2 | 7848 | 21951 | 216 | 72 | | | | | |
| CONTIG2194 | 25675936_f3_3 | 7849 | 21952 | 483 | 161 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2195 | 1953175_f2_1 | 7850 | 21953 | 198 | 66 | | | | | |
| CONTIG2195 | 24022762_c1_4 | 7851 | 21954 | 198 | 66 | | | | | |
| CONTIG2196 | 2039582_c1_2 | 7852 | 21955 | 258 | 86 | | | | | |
| CONTIG2199 | 11879628_f1_2 | 7853 | 21956 | 207 | 69 | | | | | |
| CONTIG2199 | 29875627_f3_6 | 7854 | 21957 | 225 | 75 | | | | | |
| CONTIG2199 | 4765887_c1_7 | 7855 | 21958 | 300 | 100 | | | | | |
| CONTIG2200 | 33707062_c1_3 | 7856 | 21959 | 879 | 293 | | | | | |
| CONTIG2201 | 17796083_c3_2 | 7857 | 21960 | 240 | 80 | | | | | |
| CONTIG2202 | 24019382_f1_1 | 7858 | 21961 | 1119 | 373 | | | | | |
| CONTIG2204 | 35429578_c2_9 | 7859 | 21962 | 408 | 136 | | | | | |
| CONTIG2208 | 15633583_f3_4 | 7860 | 21963 | 216 | 72 | | | | | |
| CONTIG2211 | 786550_c3_2 | 7861 | 21964 | 396 | 132 | | | | | |
| CONTIG2211 | 6829787_f1_1 | 7862 | 21965 | 243 | 81 | | | | | |
| CONTIG2211 | 890941_c1_6 | 7863 | 21966 | 192 | 64 | | | | | |
| CONTIG2214 | 15630250_c1_4 | 7864 | 21967 | 192 | 64 | | | | | |
| CONTIG2215 | 1052151_c3_7 | 7865 | 21968 | 261 | 87 | | | | | |
| CONTIG2216 | 12287803_f3_2 | 7866 | 21969 | 198 | 66 | | | | | |
| CONTIG2220 | 7812_c1_1 | 7867 | 21970 | 186 | 62 | | | | | |
| CONTIG2220 | 24297127_c2_2 | 7868 | 21971 | 216 | 72 | | | | | |
| CONTIG2220 | 4803911_c1_2 | 7869 | 21972 | 183 | 61 | | | | | |
| CONTIG2222 | 22454663_f1_1 | 7870 | 21973 | 210 | 70 | | | | | |
| CONTIG2222 | 9957807_f2_3 | 7871 | 21974 | 408 | 136 | | | | | |
| CONTIG2223 | 1223838_f3_2 | 7872 | 21975 | 201 | 67 | | | | | |
| CONTIG2225 | 14159376_c3_4 | 7873 | 21976 | 183 | 61 | | | | | |
| CONTIG2226 | 26697131_f1_1 | 7874 | 21977 | 1251 | 417 | | | | | |
| CONTIG2228 | 26297137_f2_1 | 7875 | 21978 | 228 | 76 | | | | | |
| CONTIG2228 | 2683 6712_f1_1 | 7876 | 21979 | 246 | 82 | | | | | |
| CONTIG223 | 35976557_f2_2 | 7877 | 21980 | 198 | 66 | | | | | |
| CONTIG2233 | 10159531_f2_1 | 7878 | 21981 | 1095 | 365 | | | | | |
| CONTIG2234 | 4860307_c3_9 | 7879 | 21982 | 582 | 194 | | | | | |
| CONTIG2236 | 4975827_c3_2 | 7880 | 21983 | 276 | 92 | | | | | |
| CONTIG2237 | 30176277_f1_1 | 7881 | 21984 | 615 | 205 | | | | | |
| CONTIG2237 | 32142192_f2_2 | 7882 | 21985 | 1434 | 478 | | | | | |
| CONTIG2238 | 33391033_f3_1 | 7883 | 21986 | 228 | 76 | | | | | |
| CONTIG2238 | 1985437_c2_2 | 7884 | 21987 | 189 | 63 | | | | | |
| CONTIG2239 | 26350068_f1_1 | 7885 | 21988 | 237 | 79 | | | | | |
| CONTIG2240 | 4770290_c1_3 | 7886 | 21989 | 330 | 110 | | | | | |
| CONTIG2240 | 4775378_f2_3 | 7887 | 21990 | 276 | 92 | | | | | |
| CONTIG2241 | 16806337_c2_5 | 7888 | 21991 | 321 | 107 | | | | | |
| CONTIG2241 | 35364127_f3_4 | 7889 | 21992 | 192 | 64 | | | | | |
| CONTIG2242 | 35207561_c1_6 | 7890 | 21993 | 234 | 78 | | | | | |
| CONTIG2243 | 4486562_f3_1 | 7891 | 21994 | 651 | 217 | | | | | |
| CONTIG2244 | 12578450_f2_1 | 7892 | 21995 | 1134 | 378 | | | | | |
| CONTIG2244 | 35189407_f1_1 | 7893 | 21996 | 237 | 79 | | | | | |
| CONTIG2244 | 23631875_c1_6 | 7894 | 21997 | 192 | 64 | | | | | |
| CONTIG2247 | 26015953_f3_3 | 7895 | 21998 | 183 | 61 | | | | | |
| CONTIG225 | 29573340_c2_1 | 7896 | 21999 | 306 | 102 | | | | | |
| CONTIG2251 | 24507037_f3_4 | 7897 | 22000 | 255 | 85 | | | | | |
| CONTIG2253 | 4731305_f3_2 | 7898 | 22001 | 225 | 75 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2253 | 9771907_c1_3 | 7899 | 22002 | 756 | 252 | | | | | |
| CONTIG2255 | 29507931_f1_1 | 7900 | 22003 | 225 | 75 | | | | | |
| CONTIG2255 | 14556251_c1_5 | 7901 | 22004 | 189 | 63 | | | | | |
| CONTIG2257 | 24392313_f3_3 | 7902 | 22005 | 228 | 76 | | | | | |
| CONTIG2257 | 33213915_c1_4 | 7903 | 22006 | 312 | 104 | | | | | |
| CONTIG2257 | 787885_c3_6 | 7904 | 22007 | 261 | 87 | | | | | |
| CONTIG2260 | 14958161_c3_4 | 7905 | 22008 | 183 | 61 | | | | | |
| CONTIG2266 | 19696925_f1_1 | 7906 | 22009 | 264 | 88 | | | | | |
| CONTIG2266 | 14068841_c3_4 | 7907 | 22010 | 231 | 77 | | | | | |
| CONTIG2267 | 24393800_f1_1 | 7908 | 22011 | 351 | 117 | | | | | |
| CONTIG2269 | 22301377_f2_2 | 7909 | 22012 | 717 | 239 | | | | | |
| CONTIG2270 | 21718762_c1_3 | 7910 | 22013 | 186 | 62 | | | | | |
| CONTIG2273 | 11_f2_3 | 7911 | 22014 | 234 | 78 | | | | | |
| CONTIG2273 | 20113400_f3_5 | 7912 | 22015 | 201 | 67 | | | | | |
| CONTIG2273 | 20884760_f3_6 | 7913 | 22016 | 273 | 91 | | | | | |
| CONTIG2274 | 31379438_f1_1 | 7914 | 22017 | 315 | 105 | | | | | |
| CONTIG2274 | 24337836_c1_4 | 7915 | 22018 | 186 | 62 | | | | | |
| CONTIG2280 | 166277_c2_7 | 7916 | 22019 | 189 | 63 | | | | | |
| CONTIG2281 | 4694031_f2_2 | 7917 | 22020 | 207 | 69 | | | | | |
| CONTIG2281 | 32688525_c3_4 | 7918 | 22021 | 186 | 62 | | | | | |
| CONTIG2283 | 4739043_c3_5 | 7919 | 22022 | 276 | 92 | | | | | |
| CONTIG2285 | 21515682_f3_1 | 7920 | 22023 | 186 | 62 | | | | | |
| CONTIG2287 | 34070250_f2_1 | 7921 | 22024 | 204 | 68 | | | | | |
| CONTIG2287 | 23600055_f1_1 | 7922 | 22025 | 279 | 93 | | | | | |
| CONTIG2287 | 14140637_f1_2 | 7923 | 22026 | 252 | 84 | | | | | |
| CONTIG2287 | 19689132_f2_3 | 7924 | 22027 | 237 | 79 | | | | | |
| CONTIG2287 | 23600062_c2_7 | 7925 | 22028 | 315 | 105 | | | | | |
| CONTIG2289 | 23492762_c3_8 | 7926 | 22029 | 216 | 72 | | | | | |
| CONTIG2289 | 26442317_f3_4 | 7927 | 22030 | 333 | 111 | | | | | |
| CONTIG2291 | 4725300_c1_6 | 7928 | 22031 | 609 | 203 | | | | | |
| CONTIG2292 | 1173128_f1_1 | 7929 | 22032 | 213 | 71 | | | | | |
| CONTIG2293 | 10734425_f1_1 | 7930 | 22033 | 372 | 124 | | | | | |
| CONTIG2295 | 6719050_c3_5 | 7931 | 22034 | 219 | 73 | | | | | |
| CONTIG2296 | 7314055_f2_2 | 7932 | 22035 | 291 | 97 | | | | | |
| CONTIG2298 | 9788937_f1_1 | 7933 | 22036 | 1263 | 421 | | | | | |
| CONTIG2299 | 24656503_c3_4 | 7934 | 22037 | 654 | 218 | | | | | |
| CONTIG230 | 33694686_c3_3 | 7935 | 22038 | 264 | 88 | | | | | |
| CONTIG2300 | 20709436_f3_1 | 7936 | 22039 | 267 | 89 | | | | | |
| CONTIG2301 | 26848467_c3_5 | 7937 | 22040 | 231 | 77 | | | | | |
| CONTIG2304 | 4773285_f1_1 | 7938 | 22041 | 297 | 99 | | | | | |
| CONTIG2305 | 16839067_c3_3 | 7939 | 22042 | 867 | 289 | | | | | |
| CONTIG2305 | 12162950_f1_1 | 7940 | 22043 | 186 | 62 | | | | | |
| CONTIG2306 | 7638_f2_2 | 7941 | 22044 | 204 | 68 | | | | | |
| CONTIG2306 | 3361075_f2_1 | 7942 | 22045 | 234 | 78 | | | | | |
| CONTIG2306 | 13460067_c1_3 | 7943 | 22046 | 213 | 71 | | | | | |
| CONTIG2307 | 6359626_c3_5 | 7944 | 22047 | 336 | 112 | | | | | |
| CONTIG2309 | 4969442_f2_2 | 7945 | 22048 | 186 | 62 | | | | | |
| CONTIG2309 | 4504703_c1_4 | 7946 | 22049 | 252 | 84 | | | | | |
| CONTIG2309 | 14648438_c2_5 | 7947 | 22050 | 201 | 67 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2309 | 890811_c2_6 | 7948 | 22051 | 624 | 208 | | | | | |
| CONTIG2313 | 24901555_f3_2 | 7949 | 22052 | 222 | 74 | | | | | |
| CONTIG2313 | 15625300_c2_4 | 7950 | 22053 | 333 | 111 | | | | | |
| CONTIG2314 | 603251_f1_1 | 7951 | 22054 | 636 | 212 | | | | | |
| CONTIG2318 | 21489037_c2_5 | 7952 | 22055 | 207 | 69 | | | | | |
| CONTIG2318 | 41537_c3_7 | 7953 | 22056 | 420 | 140 | | | | | |
| CONTIG2319 | 10548755_c3_3 | 7954 | 22057 | 249 | 83 | | | | | |
| CONTIG232 | 32057936_f3_1 | 7955 | 22058 | 501 | 167 | | | | | |
| CONTIG232 | 21912525_c2_4 | 7956 | 22059 | 207 | 69 | | | | | |
| CONTIG2320 | 5080290_f1_1 | 7957 | 22060 | 195 | 65 | | | | | |
| CONTIG2320 | 12584511_c3_4 | 7958 | 22061 | 198 | 66 | | | | | |
| CONTIG2321 | 14633577_f3_3 | 7959 | 22062 | 264 | 88 | | | | | |
| CONTIG2323 | 3752_c2_6 | 7960 | 22063 | 189 | 63 | | | | | |
| CONTIG2324 | 23861683_f3_2 | 7961 | 22064 | 402 | 134 | | | | | |
| CONTIG2326 | 4535066_f3_1 | 7962 | 22065 | 375 | 125 | | | | | |
| CONTIG2328 | 22437562_f3_4 | 7963 | 22066 | 837 | 279 | | | | | |
| CONTIG2328 | 26382938_c1_5 | 7964 | 22067 | 276 | 92 | | | | | |
| CONTIG2329 | 26210813_f2_2 | 7965 | 22068 | 195 | 65 | | | | | |
| CONTIG2330 | 35320812_f3_2 | 7966 | 22069 | 618 | 206 | | | | | |
| CONTIG2336 | 25397052_f2_1 | 7967 | 22070 | 216 | 72 | | | | | |
| CONTIG2336 | 438952_f2_2 | 7968 | 22071 | 186 | 62 | | | | | |
| CONTIG2336 | 6823410_c1_3 | 7969 | 22072 | 861 | 287 | | | | | |
| CONTIG234 | 24823466_c2_4 | 7970 | 22073 | 204 | 68 | | | | | |
| CONTIG2340 | 33984782_f1_1 | 7971 | 22074 | 195 | 65 | | | | | |
| CONTIG2340 | 194631_f3_3 | 7972 | 22075 | 279 | 93 | | | | | |
| CONTIG2341 | 35257050_f3_4 | 7973 | 22076 | 189 | 63 | | | | | |
| CONTIG2343 | 29922650_f2_2 | 7974 | 22077 | 354 | 118 | | | | | |
| CONTIG2346 | 20116286_f3_2 | 7975 | 22078 | 393 | 131 | | | | | |
| CONTIG2347 | 6286_f3_2 | 7976 | 22079 | 321 | 107 | | | | | |
| CONTIG2348 | 32457030_f3_4 | 7977 | 22080 | 438 | 146 | | | | | |
| CONTIG2348 | 34657838_c2_5 | 7978 | 22081 | 273 | 91 | | | | | |
| CONTIG2349 | 13680165_f2_1 | 7979 | 22082 | 231 | 77 | | | | | |
| CONTIG2350 | 4820450_f2_1 | 7980 | 22083 | 663 | 221 | | | | | |
| CONTIG2351 | 8225067_f2_2 | 7981 | 22084 | 237 | 79 | | | | | |
| CONTIG2352 | 29453377_c3_4 | 7982 | 22085 | 357 | 119 | | | | | |
| CONTIG2353 | 33864625_f2_2 | 7983 | 22086 | 270 | 90 | | | | | |
| CONTIG2354 | 21640903_f1_1 | 7984 | 22087 | 456 | 152 | | | | | |
| CONTIG2354 | 1441543_c3_6 | 7985 | 22088 | 432 | 144 | | | | | |
| CONTIG2357 | 15626632_f2_2 | 7986 | 22089 | 255 | 85 | | | | | |
| CONTIG2358 | 4562512_c1_3 | 7987 | 22090 | 570 | 190 | | | | | |
| CONTIG2359 | 22442202_f1_2 | 7988 | 22091 | 288 | 96 | | | | | |
| CONTIG2360 | 4315875_f2_3 | 7989 | 22092 | 597 | 199 | | | | | |
| CONTIG2362 | 27234751_f1_1 | 7990 | 22093 | 276 | 92 | | | | | |
| CONTIG2365 | 7221010_c1_3 | 7991 | 22094 | 318 | 106 | | | | | |
| CONTIG2367 | 20329055_c2_2 | 7992 | 22095 | 606 | 202 | | | | | |
| CONTIG2368 | 26370338_f2_4 | 7993 | 22096 | 216 | 72 | | | | | |
| CONTIG2368 | 26382952_c3_5 | 7994 | 22097 | 495 | 165 | | | | | |
| CONTIG237 | 23910382_c2_2 | 7995 | 22098 | 189 | 63 | | | | | |
| CONTIG2371 | 6098437_c2_4 | 7996 | 22099 | 306 | 102 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2373 | 12993780_f3_1 | 7997 | 22100 | 849 | 283 | | | | | |
| CONTIG2374 | 196875_f3_2 | 7998 | 22101 | 204 | 68 | | | | | |
| CONTIG2375 | 34495328_c3_4 | 7999 | 22102 | 273 | 91 | | | | | |
| CONTIG2375 | 6931552_c3_5 | 8000 | 22103 | 498 | 166 | | | | | |
| CONTIG2378 | 10657587_f2_1 | 8001 | 22104 | 393 | 131 | | | | | |
| CONTIG2381 | 9844058_f2_2 | 8002 | 22105 | 243 | 81 | | | | | |
| CONTIG2381 | 1960888_f3_4 | 8003 | 22106 | 198 | 66 | | | | | |
| CONTIG2381 | 1367142_c1_5 | 8004 | 22107 | 198 | 66 | | | | | |
| CONTIG2382 | 36292_f1_2 | 8005 | 22108 | 231 | 77 | | | | | |
| CONTIG2382 | 21985877_f3_4 | 8006 | 22109 | 369 | 123 | | | | | |
| CONTIG2385 | 6641092_f1_1 | 8007 | 22110 | 189 | 63 | | | | | |
| CONTIG2385 | 36306_f3_2 | 8008 | 22111 | 234 | 78 | | | | | |
| CONTIG2386 | 26384555_f2_1 | 8009 | 22112 | 234 | 78 | | | | | |
| CONTIG2387 | 24648436_f2_2 | 8010 | 22113 | 492 | 164 | | | | | |
| CONTIG2387 | 23835912_f2_3 | 8011 | 22114 | 234 | 78 | | | | | |
| CONTIG2387 | 10650288_c3_5 | 8012 | 22115 | 825 | 275 | | | | | |
| CONTIG2388 | 890937_c1_2 | 8013 | 22116 | 195 | 65 | | | | | |
| CONTIG2389 | 4589530_c3_3 | 8014 | 22117 | 498 | 166 | | | | | |
| CONTIG2389 | 1360712_f2_2 | 8015 | 22118 | 249 | 83 | | | | | |
| CONTIG239 | 23925656_c2_4 | 8016 | 22119 | 243 | 81 | | | | | |
| CONTIG239 | 957530_c3_5 | 8017 | 22120 | 189 | 63 | | | | | |
| CONTIG2393 | 19923765_f3_2 | 8018 | 22121 | 207 | 69 | | | | | |
| CONTIG2394 | 16017512_c3_7 | 8019 | 22122 | 249 | 83 | | | | | |
| CONTIG2395 | 14566592_f3_2 | 8020 | 22123 | 198 | 66 | | | | | |
| CONTIG2396 | 36351400_c1_2 | 8021 | 22124 | 216 | 72 | | | | | |
| CONTIG2397 | 6062825_f1_2 | 8022 | 22125 | 276 | 92 | | | | | |
| CONTIG2397 | 14569436_c3_4 | 8023 | 22126 | 711 | 237 | | | | | |
| CONTIG24 | 22151417_c1_1 | 8024 | 22127 | 192 | 64 | | | | | |
| CONTIG2400 | 3937563_f2_2 | 8025 | 22128 | 492 | 164 | | | | | |
| CONTIG2400 | 34586552_c1_5 | 8026 | 22129 | 228 | 76 | | | | | |
| CONTIG2401 | 21660691_f1_1 | 8027 | 22130 | 228 | 76 | | | | | |
| CONTIG2401 | 10754707_c2_6 | 8028 | 22131 | 381 | 127 | | | | | |
| CONTIG2401 | 34179212_c3_8 | 8029 | 22132 | 189 | 63 | | | | | |
| CONTIG2403 | 24021875_f1_2 | 8030 | 22133 | 210 | 70 | | | | | |
| CONTIG2403 | 26600055_f2_3 | 8031 | 22134 | 189 | 63 | | | | | |
| CONTIG2403 | 2911537_c3_5 | 8032 | 22135 | 312 | 104 | | | | | |
| CONTIG2404 | 4879592_f2_2 | 8033 | 22136 | 258 | 86 | | | | | |
| CONTIG2404 | 25964436_f3_3 | 8034 | 22137 | 273 | 91 | | | | | |
| CONTIG2407 | 23830287_c3_8 | 8035 | 22138 | 246 | 82 | | | | | |
| CONTIG2408 | 12921932_f1_2 | 8036 | 22139 | 204 | 68 | | | | | |
| CONTIG2408 | 22394386_f1_1 | 8037 | 22140 | 963 | 321 | | | | | |
| CONTIG2410 | 24414062_c1_9 | 8038 | 22141 | 186 | 62 | | | | | |
| CONTIG2411 | 6902177_f2_3 | 8039 | 22142 | 189 | 63 | | | | | |
| CONTIG2412 | 25666008_f2_1 | 8040 | 22143 | 285 | 95 | | | | | |
| CONTIG2413 | 24220005_c3_7 | 8041 | 22144 | 243 | 81 | | | | | |
| CONTIG2415 | 23984501_c1_3 | 8042 | 22145 | 207 | 69 | | | | | |
| CONTIG2415 | 36359836_c1_3 | 8043 | 22146 | 483 | 161 | | | | | |
| CONTIG2416 | 835336_c3_4 | 8044 | 22147 | 327 | 109 | | | | | |
| CONTIG2416 | 1990954_c1_4 | 8045 | 22148 | 201 | 67 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2419 | 21485877_f1_1 | 8046 | 22149 | 228 | 76 | | | | | |
| CONTIG2419 | 9977177_f2_3 | 8047 | 22150 | 264 | 88 | | | | | |
| CONTIG242 | 22350052_f2_2 | 8048 | 22151 | 480 | 160 | | | | | |
| CONTIG2423 | 23914561_f1_1 | 8049 | 22152 | 192 | 64 | | | | | |
| CONTIG2423 | 35188825_f3_3 | 8050 | 22153 | 201 | 67 | | | | | |
| CONTIG2424 | 828188_f3_1 | 8051 | 22154 | 315 | 105 | | | | | |
| CONTIG2425 | 33257692_f1_1 | 8052 | 22155 | 183 | 61 | | | | | |
| CONTIG2425 | 157535_f3_3 | 8053 | 22156 | 195 | 65 | | | | | |
| CONTIG2425 | 78557_c2_4 | 8054 | 22157 | 198 | 66 | | | | | |
| CONTIG2428 | 22362750_f2_2 | 8055 | 22158 | 285 | 95 | | | | | |
| CONTIG2429 | 21914680_f2_1 | 8056 | 22159 | 750 | 250 | | | | | |
| CONTIG2429 | 116262_f2_2 | 8057 | 22160 | 702 | 234 | | | | | |
| CONTIG2430 | 34586067_c1_2 | 8058 | 22161 | 186 | 62 | | | | | |
| CONTIG2431 | 979656_c2_4 | 8059 | 22162 | 186 | 62 | | | | | |
| CONTIG2438 | 9922578_c2_3 | 8060 | 22163 | 279 | 93 | | | | | |
| CONTIG2439 | 14631513_f3_1 | 8061 | 22164 | 198 | 66 | | | | | |
| CONTIG2439 | 23573462_c3_3 | 8062 | 22165 | 183 | 61 | | | | | |
| CONTIG244 | 16988412_f1_1 | 8063 | 22166 | 225 | 75 | | | | | |
| CONTIG244 | 4698752_c2_3 | 8064 | 22167 | 234 | 78 | | | | | |
| CONTIG2440 | 4194677_f1_1 | 8065 | 22168 | 255 | 85 | | | | | |
| CONTIG2440 | 1047000_f1_2 | 8066 | 22169 | 192 | 64 | | | | | |
| CONTIG2440 | 101412_f1_3 | 8067 | 22170 | 318 | 106 | | | | | |
| CONTIG2440 | 14647125_f2_4 | 8068 | 22171 | 234 | 78 | | | | | |
| CONTIG2440 | 35392568_f3_5 | 8069 | 22172 | 213 | 71 | | | | | |
| CONTIG2441 | 13790888_c2_2 | 8070 | 22173 | 1314 | 438 | | | | | |
| CONTIG2442 | 9938876_f1_2 | 8071 | 22174 | 252 | 84 | | | | | |
| CONTIG2442 | 23929038_f2_3 | 8072 | 22175 | 348 | 116 | | | | | |
| CONTIG2442 | 2913808_f2_4 | 8073 | 22176 | 243 | 81 | | | | | |
| CONTIG2443 | 9878428_c3_4 | 8074 | 22177 | 519 | 173 | | | | | |
| CONTIG2450 | 16988963_f2_3 | 8075 | 22178 | 201 | 67 | | | | | |
| CONTIG2450 | 211056_c2_7 | 8076 | 22179 | 219 | 73 | | | | | |
| CONTIG2453 | 24615637_c3_4 | 8077 | 22180 | 471 | 157 | | | | | |
| CONTIG2454 | 5274187_f1_1 | 8078 | 22181 | 192 | 64 | | | | | |
| CONTIG2454 | 15812882_f2_2 | 8079 | 22182 | 201 | 67 | | | | | |
| CONTIG2455 | 14535885_c2_7 | 8080 | 22183 | 309 | 103 | | | | | |
| CONTIG2457 | 21642031_f1_1 | 8081 | 22184 | 213 | 71 | | | | | |
| CONTIG2459 | 33391925_c1_5 | 8082 | 22185 | 201 | 67 | | | | | |
| CONTIG2459 | 1177342_c3_6 | 8083 | 22186 | 207 | 69 | | | | | |
| CONTIG2462 | 24656575_f1_1 | 8084 | 22187 | 279 | 93 | | | | | |
| CONTIG2463 | 422327_f1_2 | 8085 | 22188 | 198 | 66 | | | | | |
| CONTIG2466 | 22851442_f1_1 | 8086 | 22189 | 273 | 91 | | | | | |
| CONTIG2467 | 31835938_f3_2 | 8087 | 22190 | 408 | 136 | | | | | |
| CONTIG2468 | 30095413_f3_5 | 8088 | 22191 | 267 | 89 | | | | | |
| CONTIG2469 | 29376630_c1_4 | 8089 | 22192 | 210 | 70 | | | | | |
| CONTIG2470 | 976512_c3_7 | 8090 | 22193 | 222 | 74 | | | | | |
| CONTIG2471 | 34003150_f1_1 | 8091 | 22194 | 183 | 61 | | | | | |
| CONTIG2471 | 14632786_f2_3 | 8092 | 22195 | 408 | 136 | | | | | |
| CONTIG2475 | 24104700_f2_1 | 8093 | 22196 | 267 | 89 | | | | | |
| CONTIG2475 | 25478428_c3_2 | 8094 | 22197 | 270 | 90 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2478 | 36220191_f3_4 | 8095 | 22198 | 519 | 173 | | | | | |
| CONTIG2479 | 26562692_f3_1 | 8096 | 22199 | 225 | 75 | | | | | |
| CONTIG2480 | 25431702_f1_1 | 8097 | 22200 | 207 | 69 | | | | | |
| CONTIG2481 | 25595452_f3_4 | 8098 | 22201 | 366 | 122 | | | | | |
| CONTIG2482 | 19939660_c3_3 | 8099 | 22202 | 210 | 70 | | | | | |
| CONTIG2483 | 30125302_c3_5 | 8100 | 22203 | 231 | 77 | | | | | |
| CONTIG2485 | 234702_c2_3 | 8101 | 22204 | 408 | 136 | | | | | |
| CONTIG2487 | 19584388_f3_1 | 8102 | 22205 | 183 | 61 | | | | | |
| CONTIG2488 | 35182776_f2_1 | 8103 | 22206 | 594 | 198 | | | | | |
| CONTIG2489 | 4066011_c3_8 | 8104 | 22207 | 213 | 71 | | | | | |
| CONTIG249 | 1063387_f3_1 | 8105 | 22208 | 198 | 66 | | | | | |
| CONTIG2490 | 34006301_c1_7 | 8106 | 22209 | 378 | 126 | | | | | |
| CONTIG2490 | 35345077_c1_8 | 8107 | 22210 | 279 | 93 | | | | | |
| CONTIG2491 | 798377_f3_5 | 8108 | 22211 | 216 | 72 | | | | | |
| CONTIG2491 | 11838887_f3_6 | 8109 | 22212 | 249 | 83 | | | | | |
| CONTIG2493 | 24615762_c1_5 | 8110 | 22213 | 267 | 89 | | | | | |
| CONTIG2493 | 9789837_c2_6 | 8111 | 22214 | 1164 | 388 | | | | | |
| CONTIG2493 | 23862783_c3_8 | 8112 | 22215 | 531 | 177 | | | | | |
| CONTIG2494 | 22392678_f2_2 | 8113 | 22216 | 237 | 79 | | | | | |
| CONTIG2494 | 10581502_f3_3 | 8114 | 22217 | 198 | 66 | | | | | |
| CONTIG2494 | 14648412_c1_4 | 8115 | 22218 | 312 | 104 | | | | | |
| CONTIG2496 | 266078_c2_6 | 8116 | 22219 | 429 | 143 | | | | | |
| CONTIG2497 | 4494000_f1_1 | 8117 | 22220 | 1185 | 395 | | | | | |
| CONTIG2498 | 36334687_f3_3 | 8118 | 22221 | 183 | 61 | | | | | |
| CONTIG2498 | 19531336_f3_3 | 8119 | 22222 | 216 | 72 | | | | | |
| CONTIG2499 | 6098437_c2_5 | 8120 | 22223 | 306 | 102 | | | | | |
| CONTIG2499 | 24256527_c2_5 | 8121 | 22224 | 984 | 328 | | | | | |
| CONTIG250 | 4317037_c2_1 | 8122 | 22225 | 378 | 126 | | | | | |
| CONTIG2500 | 5251260_f2_2 | 8123 | 22226 | 594 | 198 | | | | | |
| CONTIG2500 | 990632_f3_3 | 8124 | 22227 | 186 | 62 | | | | | |
| CONTIG2501 | 35179812_c1_5 | 8125 | 22228 | 279 | 93 | | | | | |
| CONTIG2502 | 3312_f3_2 | 8126 | 22229 | 252 | 84 | | | | | |
| CONTIG2505 | 20735952_c3_5 | 8127 | 22230 | 285 | 95 | | | | | |
| CONTIG2507 | 1172037_f1_1 | 8128 | 22231 | 204 | 68 | | | | | |
| CONTIG2509 | 14635052_c1_4 | 8129 | 22232 | 291 | 97 | | | | | |
| CONTIG2510 | 26602340_c2_8 | 8130 | 22233 | 186 | 62 | | | | | |
| CONTIG2511 | 24667911_f2_2 | 8131 | 22234 | 282 | 94 | | | | | |
| CONTIG2512 | 35678817_f2_1 | 8132 | 22235 | 321 | 107 | | | | | |
| CONTIG2513 | 625130_f3_2 | 8133 | 22236 | 282 | 94 | | | | | |
| CONTIG2514 | 23992932_f3_2 | 8134 | 22237 | 183 | 61 | | | | | |
| CONTIG2516 | 24414088_c3_3 | 8135 | 22238 | 270 | 90 | | | | | |
| CONTIG2518 | 32132790_c1_3 | 8136 | 22239 | 270 | 90 | | | | | |
| CONTIG2518 | 11719052_c3_5 | 8137 | 22240 | 414 | 138 | | | | | |
| CONTIG2519 | 24414062_f1_1 | 8138 | 22241 | 534 | 178 | | | | | |
| CONTIG2519 | 24412963_f3_2 | 8139 | 22242 | 186 | 62 | | | | | |
| CONTIG2519 | 24823425_c2_5 | 8140 | 22243 | 897 | 299 | | | | | |
| CONTIG2520 | 2645192_f3_1 | 8141 | 22244 | 246 | 82 | | | | | |
| CONTIG2521 | 19542162_c1_6 | 8142 | 22245 | 183 | 61 | | | | | |
| CONTIG2523 | 35740700_f1_1 | 8143 | 22246 | 186 | 62 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2529 | 875017_f1_1 | 8144 | 22247 | 228 | 76 | | | | | |
| CONTIG2531 | 1359392_f1_2 | 8145 | 22248 | 186 | 62 | | | | | |
| CONTIG2531 | 34455288_f3_4 | 8146 | 22249 | 183 | 61 | | | | | |
| CONTIG2532 | 867141_f2_1 | 8147 | 22250 | 513 | 171 | | | | | |
| CONTIG2535 | 22835758_f3_4 | 8148 | 22251 | 201 | 67 | | | | | |
| CONTIG2539 | 4800751_f3_2 | 8149 | 22252 | 363 | 121 | | | | | |
| CONTIG2539 | 12194551_c1_3 | 8150 | 22253 | 312 | 104 | | | | | |
| CONTIG254 | 578155_f2_1 | 8151 | 22254 | 504 | 168 | | | | | |
| CONTIG2540 | 4023577_f3_1 | 8152 | 22255 | 183 | 61 | | | | | |
| CONTIG2541 | 4220965_f3_1 | 8153 | 22256 | 222 | 74 | | | | | |
| CONTIG2542 | 2611517_c2_6 | 8154 | 22257 | 234 | 78 | | | | | |
| CONTIG2543 | 976593_c2_4 | 8155 | 22258 | 183 | 61 | | | | | |
| CONTIG2546 | 6255_f3_5 | 8156 | 22259 | 183 | 61 | | | | | |
| CONTIG2546 | 16883540_c1_6 | 8157 | 22260 | 849 | 283 | | | | | |
| CONTIG2547 | 34189702_c2_4 | 8158 | 22261 | 576 | 192 | | | | | |
| CONTIG2547 | 13834637_c3_5 | 8159 | 22262 | 195 | 65 | | | | | |
| CONTIG2548 | 19728382_c1_5 | 8160 | 22263 | 312 | 104 | | | | | |
| CONTIG2557 | 12783542_c1_4 | 8161 | 22264 | 192 | 64 | | | | | |
| CONTIG2559 | 26380391_f3_1 | 8162 | 22265 | 1818 | 606 | | | | | |
| CONTIG2560 | 1035162_f3_1 | 8163 | 22266 | 381 | 127 | | | | | |
| CONTIG2560 | 4884537_f1_1 | 8164 | 22267 | 186 | 62 | | | | | |
| CONTIG2560 | 397800_f3_3 | 8165 | 22268 | 348 | 116 | | | | | |
| CONTIG2562 | 2069627_c3_5 | 8166 | 22269 | 249 | 83 | | | | | |
| CONTIG2563 | 26259681_c1_7 | 8167 | 22270 | 561 | 187 | | | | | |
| CONTIG2565 | 4867327_c1_4 | 8168 | 22271 | 252 | 84 | | | | | |
| CONTIG2565 | 24252312_f2_1 | 8169 | 22272 | 297 | 99 | | | | | |
| CONTIG2566 | 19535152_f3_3 | 8170 | 22273 | 198 | 66 | | | | | |
| CONTIG2567 | 24421875_c1_3 | 8171 | 22274 | 711 | 237 | | | | | |
| CONTIG2567 | 24344126_f1_1 | 8172 | 22275 | 219 | 73 | | | | | |
| CONTIG2572 | 4188150_f2_2 | 8173 | 22276 | 810 | 270 | | | | | |
| CONTIG2572 | 36051257_f2_3 | 8174 | 22277 | 1344 | 448 | | | | | |
| CONTIG2572 | 2344002_c1_4 | 8175 | 22278 | 210 | 70 | | | | | |
| CONTIG2574 | 2220693_c1_7 | 8176 | 22279 | 264 | 88 | | | | | |
| CONTIG2576 | 33362631_c1_5 | 8177 | 22280 | 300 | 100 | | | | | |
| CONTIG2576 | 26594050_f1_2 | 8178 | 22281 | 225 | 75 | | | | | |
| CONTIG2577 | 4298162_c2_3 | 8179 | 22282 | 330 | 110 | | | | | |
| CONTIG2577 | 5948961_f1_1 | 8180 | 22283 | 264 | 88 | | | | | |
| CONTIG2578 | 4307182_c1_2 | 8181 | 22284 | 483 | 161 | | | | | |
| CONTIG2578 | 24495442_c3_6 | 8182 | 22285 | 186 | 62 | | | | | |
| CONTIG2579 | 15668_f3_2 | 8183 | 22286 | 291 | 97 | | | | | |
| CONTIG2579 | 12587805_f3_4 | 8184 | 22287 | 249 | 83 | | | | | |
| CONTIG2579 | 19548501_c3_6 | 8185 | 22288 | 195 | 65 | | | | | |
| CONTIG2580 | 10011687_f3_4 | 8186 | 22289 | 279 | 93 | | | | | |
| CONTIG2581 | 1445137_c2_6 | 8187 | 22290 | 852 | 284 | | | | | |
| CONTIG2583 | 24609786_c1_3 | 8188 | 22291 | 264 | 88 | | | | | |
| CONTIG2584 | 22750637_f1_1 | 8189 | 22292 | 399 | 133 | | | | | |
| CONTIG2584 | 32537502_f3_3 | 8190 | 22293 | 195 | 65 | | | | | |
| CONTIG2584 | 961567_f3_4 | 8191 | 22294 | 342 | 114 | | | | | |
| CONTIG2584 | 24392180_c1_6 | 8192 | 22295 | 240 | 80 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2588 | 14585392_f3_2 | 8193 | 22296 | 192 | 64 | | | | | |
| CONTIG2591 | 6834637_c2_2 | 8194 | 22297 | 942 | 314 | | | | | |
| CONTIG2592 | 4957842_f2_4 | 8195 | 22298 | 186 | 62 | | | | | |
| CONTIG2592 | 12312910_c2_9 | 8196 | 22299 | 249 | 83 | | | | | |
| CONTIG2592 | 13756450_c3_10 | 8197 | 22300 | 471 | 157 | | | | | |
| CONTIG2593 | 5364012_f2_1 | 8198 | 22301 | 240 | 80 | | | | | |
| CONTIG2593 | 4190932_c2_3 | 8199 | 22302 | 201 | 67 | | | | | |
| CONTIG2595 | 20319406_f1_1 | 8200 | 22303 | 210 | 70 | | | | | |
| CONTIG2595 | 4938275_c1_3 | 8201 | 22304 | 183 | 61 | | | | | |
| CONTIG2596 | 22004425_f1_1 | 8202 | 22305 | 1140 | 380 | | | | | |
| CONTIG2596 | 14506905_f3_4 | 8203 | 22306 | 276 | 92 | | | | | |
| CONTIG2597 | 6645252_c3_5 | 8204 | 22307 | 294 | 98 | | | | | |
| CONTIG26 | 25585899_c1_2 | 8205 | 22308 | 279 | 93 | | | | | |
| CONTIG2601 | 21515925_f1_1 | 8206 | 22309 | 495 | 165 | | | | | |
| CONTIG2603 | 24413937_f1_1 | 8207 | 22310 | 219 | 73 | | | | | |
| CONTIG2605 | 12696057_f1_1 | 8208 | 22311 | 246 | 82 | | | | | |
| CONTIG2605 | 26502_f1_2 | 8209 | 22312 | 834 | 278 | | | | | |
| CONTIG2607 | 262_c1_4 | 8210 | 22313 | 198 | 66 | | | | | |
| CONTIG2607 | 30351635_c2_5 | 8211 | 22314 | 195 | 65 | | | | | |
| CONTIG2608 | 23632140_f1_1 | 8212 | 22315 | 183 | 61 | | | | | |
| CONTIG2610 | 29375260_c2_2 | 8213 | 22316 | 189 | 63 | | | | | |
| CONTIG2611 | 6147593_f2_1 | 8214 | 22317 | 225 | 75 | | | | | |
| CONTIG2611 | 25431700_f2_2 | 8215 | 22318 | 186 | 62 | | | | | |
| CONTIG2611 | 24414090_f3_3 | 8216 | 22319 | 258 | 86 | | | | | |
| CONTIG2611 | 34179577_c1_4 | 8217 | 22320 | 231 | 77 | | | | | |
| CONTIG2612 | 29953411_c2_3 | 8218 | 22321 | 285 | 95 | | | | | |
| CONTIG2612 | 6328301_c3_4 | 8219 | 22322 | 357 | 119 | | | | | |
| CONTIG2613 | 2000377_c1_5 | 8220 | 22323 | 276 | 92 | | | | | |
| CONTIG2614 | 5900078_c2_6 | 8221 | 22324 | 579 | 193 | | | | | |
| CONTIG2614 | 34551557_c3_7 | 8222 | 22325 | 720 | 240 | | | | | |
| CONTIG2617 | 22117191_f3_3 | 8223 | 22326 | 279 | 93 | | | | | |
| CONTIG2618 | 15056507_f2_3 | 8224 | 22327 | 489 | 163 | | | | | |
| CONTIG2618 | 9892510_c1_6 | 8225 | 22328 | 264 | 88 | | | | | |
| CONTIG2620 | 1209662_f1_1 | 8226 | 22329 | 411 | 137 | | | | | |
| CONTIG2623 | 4187777_f1_1 | 8227 | 22330 | 189 | 63 | | | | | |
| CONTIG2623 | 24323300_c3_8 | 8228 | 22331 | 279 | 93 | | | | | |
| CONTIG2629 | 26854636_f1_1 | 8229 | 22332 | 231 | 77 | | | | | |
| CONTIG2629 | 24307075_c3_5 | 8230 | 22333 | 1476 | 492 | | | | | |
| CONTIG263 | 15897181_f2_1 | 8231 | 22334 | 183 | 61 | | | | | |
| CONTIG263 | 33284376_c2_2 | 8232 | 22335 | 270 | 90 | | | | | |
| CONTIG2634 | 31772500_f3_2 | 8233 | 22336 | 567 | 189 | | | | | |
| CONTIG2634 | 4735377_f3_3 | 8234 | 22337 | 456 | 152 | | | | | |
| CONTIG2636 | 19843_f2_2 | 8235 | 22338 | 1671 | 557 | | | | | |
| CONTIG2636 | 32136625_c1_6 | 8236 | 22339 | 339 | 113 | | | | | |
| CONTIG2637 | 14540750_f3_2 | 8237 | 22340 | 246 | 82 | | | | | |
| CONTIG2638 | 22448767_c1_3 | 8238 | 22341 | 267 | 89 | | | | | |
| CONTIG2639 | 30346001_f1_1 | 8239 | 22342 | 192 | 64 | | | | | |
| CONTIG2639 | 21642527_c2_5 | 8240 | 22343 | 306 | 102 | | | | | |
| CONTIG2641 | 24235962_f2_2 | 8241 | 22344 | 228 | 76 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2641 | 15742187_c1_4 | 8242 | 22345 | 240 | 80 | | | | | |
| CONTIG2642 | 4892805_f1_1 | 8243 | 22346 | 225 | 75 | | | | | |
| CONTIG2643 | 21490928_f3_1 | 8244 | 22347 | 234 | 78 | | | | | |
| CONTIG2645 | 24492800_c3_5 | 8245 | 22348 | 234 | 78 | | | | | |
| CONTIG2646 | 179010_c1_4 | 8246 | 22349 | 339 | 113 | | | | | |
| CONTIG2647 | 29304032_f1_1 | 8247 | 22350 | 186 | 62 | | | | | |
| CONTIG2647 | 10752257_f3_2 | 8248 | 22351 | 201 | 67 | | | | | |
| CONTIG265 | 2813177_c2_2 | 8249 | 22352 | 540 | 180 | | | | | |
| CONTIG2650 | 4016966_f3_3 | 8250 | 22353 | 228 | 76 | | | | | |
| CONTIG2651 | 4507883_f2_2 | 8251 | 22354 | 201 | 67 | | | | | |
| CONTIG2654 | 9937505_c2_2 | 8252 | 22355 | 609 | 203 | | | | | |
| CONTIG2655 | 5906628_f2_1 | 8253 | 22356 | 279 | 93 | | | | | |
| CONTIG2658 | 24486561_f1_2 | 8254 | 22357 | 264 | 88 | | | | | |
| CONTIG2660 | 24064182_f2_2 | 8255 | 22358 | 267 | 89 | | | | | |
| CONTIG266 | 22352160_c3_3 | 8256 | 22359 | 315 | 105 | | | | | |
| CONTIG2660 | 9980442_f1_1 | 8257 | 22360 | 192 | 64 | | | | | |
| CONTIG2660 | 10038428_c2_3 | 8258 | 22361 | 300 | 100 | | | | | |
| CONTIG2661 | 1417502_f2_2 | 8259 | 22362 | 225 | 75 | | | | | |
| CONTIG2661 | 34024193_f3_4 | 8260 | 22363 | 207 | 69 | | | | | |
| CONTIG2661 | 6660917_c2_6 | 8261 | 22364 | 207 | 69 | | | | | |
| CONTIG2662 | 25406332_c2_5 | 8262 | 22365 | 603 | 201 | | | | | |
| CONTIG2662 | 23616337_c2_6 | 8263 | 22366 | 285 | 95 | | | | | |
| CONTIG2663 | 35553150_c1_7 | 8264 | 22367 | 639 | 213 | | | | | |
| CONTIG2664 | 16484760_f3_4 | 8265 | 22368 | 930 | 310 | | | | | |
| CONTIG2665 | 29548427_f2_1 | 8266 | 22369 | 636 | 212 | | | | | |
| CONTIG2665 | 14460951_c2_2 | 8267 | 22370 | 228 | 76 | | | | | |
| CONTIG2666 | 12897187_f1_1 | 8268 | 22371 | 189 | 63 | | | | | |
| CONTIG2667 | 5312827_c3_5 | 8269 | 22372 | 186 | 62 | | | | | |
| CONTIG2668 | 56532_f2_3 | 8270 | 22373 | 237 | 79 | | | | | |
| CONTIG2668 | 4881555_c1_5 | 8271 | 22374 | 195 | 65 | | | | | |
| CONTIG2668 | 24632907_c1_7 | 8272 | 22375 | 198 | 66 | | | | | |
| CONTIG2668 | 25585788_c3_8 | 8273 | 22376 | 219 | 73 | | | | | |
| CONTIG2669 | 24265632_f2_3 | 8274 | 22377 | 234 | 78 | | | | | |
| CONTIG267 | 34020907_f3_2 | 8275 | 22378 | 258 | 86 | | | | | |
| CONTIG2671 | 33985425_c3_4 | 8276 | 22379 | 186 | 62 | | | | | |
| CONTIG2673 | 23437925_f2_2 | 8277 | 22380 | 312 | 104 | | | | | |
| CONTIG2682 | 980000_c3_6 | 8278 | 22381 | 204 | 68 | | | | | |
| CONTIG2683 | 4117177_f1_1 | 8279 | 22382 | 1452 | 484 | | | | | |
| CONTIG2683 | 163425_c3_5 | 8280 | 22383 | 189 | 63 | | | | | |
| CONTIG2684 | 6679702_c3_6 | 8281 | 22384 | 192 | 64 | | | | | |
| CONTIG2685 | 479791_f3_3 | 8282 | 22385 | 609 | 203 | | | | | |
| CONTIG2687 | 10760092_f2_1 | 8283 | 22386 | 462 | 154 | | | | | |
| CONTIG2688 | 34275377_c3_8 | 8284 | 22387 | 300 | 100 | | | | | |
| CONTIG2689 | 33251510_f3_2 | 8285 | 22388 | 201 | 67 | | | | | |
| CONTIG2689 | 6728462_c1_3 | 8286 | 22389 | 285 | 95 | | | | | |
| CONTIG2690 | 178806_c2_4 | 8287 | 22390 | 198 | 66 | | | | | |
| CONTIG2691 | 26594028_f1_1 | 8288 | 22391 | 444 | 148 | | | | | |
| CONTIG2692 | 2848750_f1_1 | 8289 | 22392 | 204 | 68 | | | | | |
| CONTIG2693 | 2434305_f1_1 | 8290 | 22393 | 894 | 298 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2693 | 21757703_c1_2 | 8291 | 22394 | 402 | 134 | | | | | |
| CONTIG2695 | 14650015_c1_6 | 8292 | 22395 | 480 | 160 | | | | | |
| CONTIG2695 | 13941000_c2_9 | 8293 | 22396 | 282 | 94 | | | | | |
| CONTIG2697 | 181283_f1_3 | 8294 | 22397 | 225 | 75 | | | | | |
| CONTIG2697 | 4797015_f3_4 | 8295 | 22398 | 387 | 129 | | | | | |
| CONTIG2697 | 14242155_c3_7 | 8296 | 22399 | 219 | 73 | | | | | |
| CONTIG270 | 954437_c2_1 | 8297 | 22400 | 261 | 87 | | | | | |
| CONTIG2700 | 24303137_f3_1 | 8298 | 22401 | 222 | 74 | | | | | |
| CONTIG2701 | 4117752_c1_1 | 8299 | 22402 | 183 | 61 | | | | | |
| CONTIG2703 | 10322255_f2_3 | 8300 | 22403 | 255 | 85 | | | | | |
| CONTIG2703 | 957750_c3_5 | 8301 | 22404 | 1239 | 413 | | | | | |
| CONTIG2705 | 25410300_f1_1 | 8302 | 22405 | 198 | 66 | | | | | |
| CONTIG2707 | 25392877_f1_1 | 8303 | 22406 | 234 | 78 | | | | | |
| CONTIG2707 | 4725325_c2_5 | 8304 | 22407 | 207 | 69 | | | | | |
| CONTIG2712 | 2906305_c2_3 | 8305 | 22408 | 564 | 188 | | | | | |
| CONTIG2712 | 5969130_c3_4 | 8306 | 22409 | 243 | 81 | | | | | |
| CONTIG2715 | 23945192_f2_1 | 8307 | 22410 | 189 | 63 | | | | | |
| CONTIG2715 | 21760327_c2_5 | 8308 | 22411 | 201 | 67 | | | | | |
| CONTIG2717 | 992187_c3_4 | 8309 | 22412 | 237 | 79 | | | | | |
| CONTIG2718 | 24641580_c1_3 | 8310 | 22413 | 267 | 89 | | | | | |
| CONTIG2718 | 26251930_c1_4 | 8311 | 22414 | 294 | 98 | | | | | |
| CONTIG272 | 87550_f2_3 | 8312 | 22415 | 285 | 95 | | | | | |
| CONTIG2723 | 12679561_c3_1 | 8313 | 22416 | 189 | 63 | | | | | |
| CONTIG2724 | 31520002_f1_1 | 8314 | 22417 | 354 | 118 | | | | | |
| CONTIG2725 | 25506912_f1_1 | 8315 | 22418 | 207 | 69 | | | | | |
| CONTIG2725 | 33398456_c2_3 | 8316 | 22419 | 252 | 84 | | | | | |
| CONTIG2728 | 24495391_f2_2 | 8317 | 22420 | 480 | 160 | | | | | |
| CONTIG2728 | 972627_f2_3 | 8318 | 22421 | 633 | 211 | | | | | |
| CONTIG2728 | 25601505_c1_6 | 8319 | 22422 | 261 | 87 | | | | | |
| CONTIG2728 | 180152_c3_8 | 8320 | 22423 | 207 | 69 | | | | | |
| CONTIG2730 | 1984437_f1_5 | 8321 | 22424 | 243 | 81 | | | | | |
| CONTIG2730 | 4875200_c3_7 | 8322 | 22425 | 240 | 80 | | | | | |
| CONTIG2734 | 35348375_f3_3 | 8323 | 22426 | 249 | 83 | | | | | |
| CONTIG2736 | 6847537_f2_2 | 8324 | 22427 | 228 | 76 | | | | | |
| CONTIG2736 | 24806260_c2_4 | 8325 | 22428 | 234 | 78 | | | | | |
| CONTIG2737 | 187752_c3_5 | 8326 | 22429 | 300 | 100 | | | | | |
| CONTIG2739 | 35830158_f2_1 | 8327 | 22430 | 282 | 94 | | | | | |
| CONTIG2740 | 34171942_f2_1 | 8328 | 22431 | 1290 | 430 | | | | | |
| CONTIG2742 | 3925377_c1_4 | 8329 | 22432 | 288 | 96 | | | | | |
| CONTIG2742 | 4391937_c3_5 | 8330 | 22433 | 255 | 85 | | | | | |
| CONTIG2743 | 11929032_c3_1 | 8331 | 22434 | 1032 | 344 | | | | | |
| CONTIG2745 | 24023515_c1_3 | 8332 | 22435 | 201 | 67 | | | | | |
| CONTIG2746 | 6759652_f3_6 | 8333 | 22436 | 1230 | 410 | | | | | |
| CONTIG2746 | 23907925_f3_7 | 8334 | 22437 | 216 | 72 | | | | | |
| CONTIG2746 | 4977250_c3_10 | 8335 | 22438 | 273 | 91 | | | | | |
| CONTIG2748 | 23473575_f3_5 | 8336 | 22439 | 204 | 68 | | | | | |
| CONTIG2749 | 30207652_f2_2 | 8337 | 22440 | 183 | 61 | | | | | |
| CONTIG2749 | 9808215_c2_6 | 8338 | 22441 | 186 | 62 | | | | | |
| CONTIG2750 | 3204567_f1_1 | 8339 | 22442 | 1428 | 476 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2751 | 3400_f2_2 | 8340 | 22443 | 213 | 71 | | | | | |
| CONTIG2751 | 20320886_c1_5 | 8341 | 22444 | 210 | 70 | | | | | |
| CONTIG2753 | 547200_c1_3 | 8342 | 22445 | 201 | 67 | | | | | |
| CONTIG2754 | 6125402_c2_3 | 8343 | 22446 | 186 | 62 | | | | | |
| CONTIG2756 | 25582056_f2_1 | 8344 | 22447 | 201 | 67 | | | | | |
| CONTIG2756 | 36601503_c3_4 | 8345 | 22448 | 270 | 90 | | | | | |
| CONTIG2757 | 23868800_c1_4 | 8346 | 22449 | 741 | 247 | | | | | |
| CONTIG2758 | 4063377_f2_1 | 8347 | 22450 | 504 | 168 | | | | | |
| CONTIG2761 | 10058137_c3_3 | 8348 | 22451 | 219 | 73 | | | | | |
| CONTIG2762 | 1220056_c1_3 | 8349 | 22452 | 264 | 88 | | | | | |
| CONTIG2764 | 22160028_f2_5 | 8350 | 22453 | 375 | 125 | | | | | |
| CONTIG2764 | 12381718_c1_9 | 8351 | 22454 | 183 | 61 | | | | | |
| CONTIG2765 | 14652300_f3_1 | 8352 | 22455 | 213 | 71 | | | | | |
| CONTIG2766 | 33210752_f3_3 | 8353 | 22456 | 354 | 118 | | | | | |
| CONTIG2766 | 392275_c1_4 | 8354 | 22457 | 282 | 94 | | | | | |
| CONTIG2768 | 29489550_c1_2 | 8355 | 22458 | 213 | 71 | | | | | |
| CONTIG2768 | 4023577_c1_3 | 8356 | 22459 | 183 | 61 | | | | | |
| CONTIG2769 | 189001_c3_4 | 8357 | 22460 | 264 | 88 | | | | | |
| CONTIG2770 | 13867211_c2_1 | 8358 | 22461 | 261 | 87 | | | | | |
| CONTIG2770 | 4197917_c3_1 | 8359 | 22462 | 222 | 74 | | | | | |
| CONTIG2771 | 24617250_c1_4 | 8360 | 22463 | 183 | 61 | | | | | |
| CONTIG2771 | 22707561_c2_5 | 8361 | 22464 | 717 | 239 | | | | | |
| CONTIG2772 | 35798263_f3_2 | 8362 | 22465 | 405 | 135 | | | | | |
| CONTIG2772 | 782818_c1_4 | 8363 | 22466 | 201 | 67 | | | | | |
| CONTIG2773 | 2166340_f2_2 | 8364 | 22467 | 501 | 167 | | | | | |
| CONTIG2773 | 971968_c2_3 | 8365 | 22468 | 939 | 313 | | | | | |
| CONTIG2775 | 2478180_c1_3 | 8366 | 22469 | 243 | 81 | | | | | |
| CONTIG2776 | 24219206_f1_3 | 8367 | 22470 | 213 | 71 | | | | | |
| CONTIG2778 | 4882205_f2_2 | 8368 | 22471 | 363 | 121 | | | | | |
| CONTIG2778 | 6850425_f3_4 | 8369 | 22472 | 258 | 86 | | | | | |
| CONTIG278 | 34412805_f2_1 | 8370 | 22473 | 207 | 69 | | | | | |
| CONTIG2786 | 13864555_f3_1 | 8371 | 22474 | 687 | 229 | | | | | |
| CONTIG2787 | 24399093_f2_2 | 8372 | 22475 | 204 | 68 | | | | | |
| CONTIG2788 | 1992262_f2_2 | 8373 | 22476 | 237 | 79 | | | | | |
| CONTIG2788 | 4533402_c1_5 | 8374 | 22477 | 270 | 90 | | | | | |
| CONTIG2789 | 24226675_f1_1 | 8375 | 22478 | 252 | 84 | | | | | |
| CONTIG2790 | 14489681_f2_2 | 8376 | 22479 | 291 | 97 | | | | | |
| CONTIG2790 | 33469056_c2_5 | 8377 | 22480 | 282 | 94 | | | | | |
| CONTIG2792 | 24492252_f3_4 | 8378 | 22481 | 612 | 204 | | | | | |
| CONTIG2792 | 24424055_c3_6 | 8379 | 22482 | 303 | 101 | | | | | |
| CONTIG2793 | 25563888_f2_2 | 8380 | 22483 | 192 | 64 | | | | | |
| CONTIG2793 | 10626530_f2_4 | 8381 | 22484 | 639 | 213 | | | | | |
| CONTIG2796 | 5975336_f3_3 | 8382 | 22485 | 219 | 73 | | | | | |
| CONTIG2796 | 21532817_c2_6 | 8383 | 22486 | 246 | 82 | | | | | |
| CONTIG2799 | 2813177_c3_5 | 8384 | 22487 | 753 | 251 | | | | | |
| CONTIG2801 | 24876955_c2_12 | 8385 | 22488 | 540 | 180 | | | | | |
| CONTIG2803 | 35736627_f3_2 | 8386 | 22489 | 330 | 110 | | | | | |
| CONTIG2803 | 26448562_f3_3 | 8387 | 22490 | 198 | 66 | | | | | |
| CONTIG2803 | 11725001_c2_6 | 8388 | 22491 | 192 | 64 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2807 | 5126450_f1_1 | 8389 | 22492 | 291 | 97 | | | | | |
| CONTIG2807 | 24786265_f3_2 | 8390 | 22493 | 183 | 61 | | | | | |
| CONTIG2810 | 29772135_c1_2 | 8391 | 22494 | 186 | 62 | | | | | |
| CONTIG2813 | 1173763_f2_2 | 8392 | 22495 | 213 | 71 | | | | | |
| CONTIG2814 | 9797505_f1_1 | 8393 | 22496 | 333 | 111 | | | | | |
| CONTIG2816 | 2343801_c1_7 | 8394 | 22497 | 201 | 67 | | | | | |
| CONTIG2817 | 24892187_f2_1 | 8395 | 22498 | 1713 | 571 | | | | | |
| CONTIG2818 | 24429561_f2_1 | 8396 | 22499 | 1743 | 581 | | | | | |
| CONTIG2819 | 23851415_f1_1 | 8397 | 22500 | 198 | 66 | | | | | |
| CONTIG282 | 2164763_c2_2 | 8398 | 22501 | 486 | 162 | | | | | |
| CONTIG2820 | 10831531_f3_2 | 8399 | 22502 | 282 | 94 | | | | | |
| CONTIG2820 | 24253878_c1_5 | 8400 | 22503 | 222 | 74 | | | | | |
| CONTIG2821 | 24023411_c2_3 | 8401 | 22504 | 1632 | 544 | | | | | |
| CONTIG2823 | 24257887_f1_2 | 8402 | 22505 | 186 | 62 | | | | | |
| CONTIG2825 | 24023262_c1_1 | 8403 | 22506 | 219 | 73 | | | | | |
| CONTIG2828 | 15783540_f1_1 | 8404 | 22507 | 189 | 63 | | | | | |
| CONTIG2829 | 2131260_f2_3 | 8405 | 22508 | 279 | 93 | | | | | |
| CONTIG2830 | 869802_c3_5 | 8406 | 22509 | 183 | 61 | | | | | |
| CONTIG2832 | 10057318_f1_1 | 8407 | 22510 | 834 | 278 | | | | | |
| CONTIG2832 | 4890638_c1_2 | 8408 | 22511 | 285 | 95 | | | | | |
| CONTIG2832 | 25581410_c2_4 | 8409 | 22512 | 225 | 75 | | | | | |
| CONTIG2833 | 22312555_c2_2 | 8410 | 22513 | 225 | 75 | | | | | |
| CONTIG2834 | 29328182_c3_4 | 8411 | 22514 | 186 | 62 | | | | | |
| CONTIG2836 | 19573300_c3_2 | 8412 | 22515 | 258 | 86 | | | | | |
| CONTIG2836 | 14457751_c3_3 | 8413 | 22516 | 198 | 66 | | | | | |
| CONTIG2839 | 9775303_f3_3 | 8414 | 22517 | 216 | 72 | | | | | |
| CONTIG2840 | 23923912_c2_4 | 8415 | 22518 | 228 | 76 | | | | | |
| CONTIG2844 | 24491252_f3_2 | 8416 | 22519 | 417 | 139 | | | | | |
| CONTIG2844 | 24416500_c2_4 | 8417 | 22520 | 210 | 70 | | | | | |
| CONTIG2849 | 30192162_f1_1 | 8418 | 22521 | 198 | 66 | | | | | |
| CONTIG2849 | 20751328_f1_2 | 8419 | 22522 | 189 | 63 | | | | | |
| CONTIG2849 | 20973136_f3_4 | 8420 | 22523 | 192 | 64 | | | | | |
| CONTIG2849 | 11914187_c1_5 | 8421 | 22524 | 261 | 87 | | | | | |
| CONTIG2850 | 34179687_c3_7 | 8422 | 22525 | 207 | 69 | | | | | |
| CONTIG2850 | 4718800_c1_4 | 8423 | 22526 | 333 | 111 | | | | | |
| CONTIG2853 | 6900025_c2_6 | 8424 | 22527 | 1317 | 439 | | | | | |
| CONTIG2854 | 13679143_f2_1 | 8425 | 22528 | 579 | 193 | | | | | |
| CONTIG2854 | 12_c2_4 | 8426 | 22529 | 198 | 66 | | | | | |
| CONTIG2855 | 3907158_c1_3 | 8427 | 22530 | 687 | 229 | | | | | |
| CONTIG2858 | 10803202_c2_6 | 8428 | 22531 | 234 | 78 | | | | | |
| CONTIG2859 | 22203_f3_2 | 8429 | 22532 | 765 | 255 | | | | | |
| CONTIG2860 | 10937875_f3_1 | 8430 | 22533 | 1140 | 380 | | | | | |
| CONTIG2862 | 3912775_f3_1 | 8431 | 22534 | 270 | 90 | | | | | |
| CONTIG2863 | 9956252_c1_2 | 8432 | 22535 | 231 | 77 | | | | | |
| CONTIG2864 | 24426592_c2_6 | 8433 | 22536 | 207 | 69 | | | | | |
| CONTIG2866 | 4727287_f2_1 | 8434 | 22537 | 201 | 67 | | | | | |
| CONTIG2866 | 7085952_c3_4 | 8435 | 22538 | 249 | 83 | | | | | |
| CONTIG2867 | 23830465_c3_6 | 8436 | 22539 | 231 | 77 | | | | | |
| CONTIG2869 | 972125_c1_5 | 8437 | 22540 | 273 | 91 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2869 | 6812750_c3_8 | 8438 | 22541 | 222 | 74 | | | | | |
| CONTIG2871 | 1989037_f1_1 | 8439 | 22542 | 198 | 66 | | | | | |
| CONTIG2873 | 10235137_f1_1 | 8440 | 22543 | 234 | 78 | | | | | |
| CONTIG2873 | 19693812_f2_4 | 8441 | 22544 | 189 | 63 | | | | | |
| CONTIG2874 | 626453_c1_3 | 8442 | 22545 | 324 | 108 | | | | | |
| CONTIG2874 | 29548525_c3_6 | 8443 | 22546 | 510 | 170 | | | | | |
| CONTIG2876 | 23515677_f1_1 | 8444 | 22547 | 306 | 102 | | | | | |
| CONTIG2876 | 23710015_c2_5 | 8445 | 22548 | 186 | 62 | | | | | |
| CONTIG2877 | 859688_c1_1 | 8446 | 22549 | 810 | 270 | | | | | |
| CONTIG2881 | 14843827_f2_3 | 8447 | 22550 | 291 | 97 | | | | | |
| CONTIG2882 | 21523551_f1_3 | 8448 | 22551 | 228 | 76 | | | | | |
| CONTIG2884 | 30355063_c1_4 | 8449 | 22552 | 306 | 102 | | | | | |
| CONTIG2884 | 21489807_c2_6 | 8450 | 22553 | 393 | 131 | | | | | |
| CONTIG2886 | 6766887_f1_1 | 8451 | 22554 | 237 | 79 | | | | | |
| CONTIG2887 | 4946002_c3_4 | 8452 | 22555 | 333 | 111 | | | | | |
| CONTIG2888 | 36386702_f1_2 | 8453 | 22556 | 231 | 77 | | | | | |
| CONTIG2888 | 11756675_f2_3 | 8454 | 22557 | 192 | 64 | | | | | |
| CONTIG2888 | 11720902_c3_8 | 8455 | 22558 | 204 | 68 | | | | | |
| CONTIG2889 | 25447552_c2_3 | 8456 | 22559 | 306 | 102 | | | | | |
| CONTIG2889 | 23625086_c2_4 | 8457 | 22560 | 213 | 71 | | | | | |
| CONTIG289 | 9975758_f2_2 | 8458 | 22561 | 261 | 87 | | | | | |
| CONTIG289 | 549053_c2_3 | 8459 | 22562 | 192 | 64 | | | | | |
| CONTIG2893 | 10547067_c2_4 | 8460 | 22563 | 189 | 63 | | | | | |
| CONTIG2894 | 22444375_c2_3 | 8461 | 22564 | 306 | 102 | | | | | |
| CONTIG2896 | 14563762_f1_1 | 8462 | 22565 | 201 | 67 | | | | | |
| CONTIG2896 | 24413437_c3_4 | 8463 | 22566 | 243 | 81 | | | | | |
| CONTIG2897 | 25585911_f2_4 | 8464 | 22567 | 249 | 83 | | | | | |
| CONTIG2899 | 24253207_c1_6 | 8465 | 22568 | 423 | 141 | | | | | |
| CONTIG2900 | 21922127_f1_1 | 8466 | 22569 | 201 | 67 | | | | | |
| CONTIG2900 | 34116042_c3_5 | 8467 | 22570 | 336 | 112 | | | | | |
| CONTIG2902 | 9884712_f3_4 | 8468 | 22571 | 387 | 129 | | | | | |
| CONTIG2905 | 4864066_f1_2 | 8469 | 22572 | 216 | 72 | | | | | |
| CONTIG2905 | 14565956_f2_3 | 8470 | 22573 | 222 | 74 | | | | | |
| CONTIG2906 | 21517340_c1_4 | 8471 | 22574 | 189 | 63 | | | | | |
| CONTIG2909 | 25423300_f1_1 | 8472 | 22575 | 216 | 72 | | | | | |
| CONTIG2909 | 1954542_c2_5 | 8473 | 22576 | 192 | 64 | | | | | |
| CONTIG291 | 25423837_c2_4 | 8474 | 22577 | 297 | 99 | | | | | |
| CONTIG2913 | 31910001_f3_4 | 8475 | 22578 | 1077 | 359 | | | | | |
| CONTIG2914 | 4710902_f2_3 | 8476 | 22579 | 1350 | 450 | | | | | |
| CONTIG2915 | 24410912_f2_1 | 8477 | 22580 | 216 | 72 | | | | | |
| CONTIG2915 | 5366075_f3_2 | 8478 | 22581 | 432 | 144 | | | | | |
| CONTIG2916 | 1203430_c3_4 | 8479 | 22582 | 579 | 193 | | | | | |
| CONTIG2917 | 35345437_f3_3 | 8480 | 22583 | 192 | 64 | | | | | |
| CONTIG2917 | 24020186_f3_2 | 8481 | 22584 | 816 | 272 | | | | | |
| CONTIG2920 | 26773550_f3_3 | 8482 | 22585 | 186 | 62 | | | | | |
| CONTIG2920 | 35209458_c2_6 | 8483 | 22586 | 279 | 93 | | | | | |
| CONTIG2921 | 4711530_c1_2 | 8484 | 22587 | 198 | 66 | | | | | |
| CONTIG2925 | 35632836_c3_5 | 8485 | 22588 | 213 | 71 | | | | | |
| CONTIG2927 | 14572182_f2_1 | 8486 | 22589 | 450 | 150 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2928 | 24647188_f1_2 | 8487 | 22590 | 201 | 67 | | | | | |
| CONTIG2929 | 2438918_f1_1 | 8488 | 22591 | 345 | 115 | | | | | |
| CONTIG2929 | 21642187_f2_2 | 8489 | 22592 | 198 | 66 | | | | | |
| CONTIG2930 | 23907528_f3_1 | 8490 | 22593 | 258 | 86 | | | | | |
| CONTIG2930 | 9944751_f3_2 | 8491 | 22594 | 294 | 98 | | | | | |
| CONTIG2932 | 10320337_c2_5 | 8492 | 22595 | 219 | 73 | | | | | |
| CONTIG2932 | 13775307_f2_4 | 8493 | 22596 | 537 | 179 | | | | | |
| CONTIG2933 | 4032650_c3_2 | 8494 | 22597 | 315 | 105 | | | | | |
| CONTIG2934 | 14558257_c3_3 | 8495 | 22598 | 321 | 107 | | | | | |
| CONTIG2935 | 4068752_f3_4 | 8496 | 22599 | 243 | 81 | | | | | |
| CONTIG2935 | 5914177_c3_6 | 8497 | 22600 | 252 | 84 | | | | | |
| CONTIG2936 | 204050_f1_2 | 8498 | 22601 | 240 | 80 | | | | | |
| CONTIG2936 | 2031382_f3_6 | 8499 | 22602 | 210 | 70 | | | | | |
| CONTIG2937 | 19542302_f1_1 | 8500 | 22603 | 405 | 135 | | | | | |
| CONTIG2938 | 1432318_f1_1 | 8501 | 22604 | 1182 | 394 | | | | | |
| CONTIG294 | 32245331_c1_5 | 8502 | 22605 | 261 | 87 | | | | | |
| CONTIG2940 | 39649033_c1_6 | 8503 | 22606 | 183 | 61 | | | | | |
| CONTIG2940 | 29304513_c1_7 | 8504 | 22607 | 219 | 73 | | | | | |
| CONTIG2941 | 19720630_f3_4 | 8505 | 22608 | 321 | 107 | | | | | |
| CONTIG2943 | 24272300_f1_1 | 8506 | 22609 | 1647 | 549 | | | | | |
| CONTIG2944 | 9819555_f1_1 | 8507 | 22610 | 366 | 122 | | | | | |
| CONTIG2944 | 214030_f2_2 | 8508 | 22611 | 282 | 94 | | | | | |
| CONTIG2944 | 11875925_c2_4 | 8509 | 22612 | 228 | 76 | | | | | |
| CONTIG2945 | 29958550_f1_1 | 8510 | 22613 | 1449 | 483 | | | | | |
| CONTIG2949 | 4710342_f3_3 | 8511 | 22614 | 348 | 116 | | | | | |
| CONTIG2951 | 15859462_f2_1 | 8512 | 22615 | 207 | 69 | | | | | |
| CONTIG2951 | 4800257_c1_1 | 8513 | 22616 | 516 | 172 | | | | | |
| CONTIG2953 | 46950649_c1_5 | 8514 | 22617 | 246 | 82 | | | | | |
| CONTIG2953 | 14297137_f2_2 | 8515 | 22618 | 213 | 71 | | | | | |
| CONTIG2953 | 5916266_f2_3 | 8516 | 22619 | 282 | 94 | | | | | |
| CONTIG2953 | 34241387_f3_4 | 8517 | 22620 | 207 | 69 | | | | | |
| CONTIG2953 | 13678425_c2_6 | 8518 | 22621 | 210 | 70 | | | | | |
| CONTIG2956 | 9881952_f2_1 | 8519 | 22622 | 201 | 67 | | | | | |
| CONTIG2956 | 6033188_c2_3 | 8520 | 22623 | 198 | 66 | | | | | |
| CONTIG2957 | 1288127_c1_5 | 8521 | 22624 | 387 | 129 | | | | | |
| CONTIG2959 | 25399066_f2_4 | 8522 | 22625 | 225 | 75 | | | | | |
| CONTIG2959 | 437575_c1_5 | 8523 | 22626 | 390 | 130 | | | | | |
| CONTIG296 | 860877_c3_1 | 8524 | 22627 | 282 | 94 | | | | | |
| CONTIG296 | 14491557_c3_2 | 8525 | 22628 | 231 | 77 | | | | | |
| CONTIG2960 | 1070401_f1_2 | 8526 | 22629 | 264 | 88 | | | | | |
| CONTIG2961 | 25437813_c3_10 | 8527 | 22630 | 243 | 81 | | | | | |
| CONTIG2963 | 1990752_f2_2 | 8528 | 22631 | 246 | 82 | | | | | |
| CONTIG2963 | 11876527_c1_4 | 8529 | 22632 | 267 | 89 | | | | | |
| CONTIG2966 | 26589432_f2_3 | 8530 | 22633 | 192 | 64 | | | | | |
| CONTIG2966 | 4069088_c1_8 | 8531 | 22634 | 210 | 70 | | | | | |
| CONTIG2967 | 23522785_f2_1 | 8532 | 22635 | 384 | 128 | | | | | |
| CONTIG2967 | 5088942_f2_2 | 8533 | 22636 | 189 | 63 | | | | | |
| CONTIG2967 | 16801562_c2_4 | 8534 | 22637 | 201 | 67 | | | | | |
| CONTIG2967 | 21675781_c2_5 | 8535 | 22638 | 222 | 74 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG2970 | 13870950_f3_2 | 8536 | 22639 | 219 | 73 | | | | | |
| CONTIG2970 | 36330037_c3_5 | 8537 | 22640 | 228 | 76 | | | | | |
| CONTIG2970 | 13103382_c3_6 | 8538 | 22641 | 381 | 127 | | | | | |
| CONTIG2973 | 968877_c2_3 | 8539 | 22642 | 273 | 91 | | | | | |
| CONTIG2973 | 13673192_c3_7 | 8540 | 22643 | 186 | 62 | | | | | |
| CONTIG2974 | 625635_c2_10 | 8541 | 22644 | 411 | 137 | | | | | |
| CONTIG2974 | 3128177_c3_12 | 8542 | 22645 | 213 | 71 | | | | | |
| CONTIG2975 | 4797792_f2_2 | 8543 | 22646 | 408 | 136 | | | | | |
| CONTIG2975 | 14882877_f2_3 | 8544 | 22647 | 891 | 297 | | | | | |
| CONTIG2976 | 12899438_f1_1 | 8545 | 22648 | 276 | 92 | | | | | |
| CONTIG2977 | 24848137_f2_1 | 8546 | 22649 | 291 | 97 | | | | | |
| CONTIG2977 | 3945437_f3_2 | 8547 | 22650 | 369 | 123 | | | | | |
| CONTIG2977 | 15652_c2_7 | 8548 | 22651 | 207 | 69 | | | | | |
| CONTIG2978 | 2187588_f1_2 | 8549 | 22652 | 246 | 82 | | | | | |
| CONTIG2978 | 29508437_f3_3 | 8550 | 22653 | 186 | 62 | | | | | |
| CONTIG2978 | 4898442_c1_5 | 8551 | 22654 | 183 | 61 | | | | | |
| CONTIG2979 | 36214762_f1_1 | 8552 | 22655 | 183 | 61 | | | | | |
| CONTIG2979 | 23885192_f2_2 | 8553 | 22656 | 432 | 144 | | | | | |
| CONTIG298 | 24822557_c1_4 | 8554 | 22657 | 216 | 72 | | | | | |
| CONTIG2982 | 4495687_c1_5 | 8555 | 22658 | 213 | 71 | | | | | |
| CONTIG2982 | 4772582_c1_6 | 8556 | 22659 | 387 | 129 | | | | | |
| CONTIG2982 | 24300006_c3_9 | 8557 | 22660 | 213 | 71 | | | | | |
| CONTIG2982 | 1985782_f3_10 | 8558 | 22661 | 204 | 68 | | | | | |
| CONTIG2983 | 12617153_f2_1 | 8559 | 22662 | 372 | 124 | | | | | |
| CONTIG2986 | 6150040_c1_4 | 8560 | 22663 | 279 | 93 | | | | | |
| CONTIG2986 | 9844687_c3_8 | 8561 | 22664 | 204 | 68 | | | | | |
| CONTIG2988 | 23839125_f3_7 | 8562 | 22665 | 249 | 83 | | | | | |
| CONTIG2988 | 7284530_f1_1 | 8563 | 22666 | 213 | 71 | | | | | |
| CONTIG299 | 12300932_f1_1 | 8564 | 22667 | 282 | 94 | | | | | |
| CONTIG2990 | 5906703_f2_2 | 8565 | 22668 | 279 | 93 | | | | | |
| CONTIG2990 | 25424125_f3_5 | 8566 | 22669 | 312 | 104 | | | | | |
| CONTIG2990 | 35204693_c2_6 | 8567 | 22670 | 198 | 66 | | | | | |
| CONTIG2990 | 1992328_c3_7 | 8568 | 22671 | 234 | 78 | | | | | |
| CONTIG2991 | 3939077_c3_8 | 8569 | 22672 | 228 | 76 | | | | | |
| CONTIG2991 | 23947261_f2_1 | 8570 | 22673 | 240 | 80 | | | | | |
| CONTIG2992 | 32210786_f2_2 | 8571 | 22674 | 189 | 63 | | | | | |
| CONTIG2992 | 2364307_c1_5 | 8572 | 22675 | 249 | 83 | | | | | |
| CONTIG2993 | 32675341_f3_3 | 8573 | 22676 | 498 | 166 | | | | | |
| CONTIG2993 | 4103827_f3_4 | 8574 | 22677 | 195 | 65 | | | | | |
| CONTIG2995 | 16000_f1_3 | 8575 | 22678 | 192 | 64 | | | | | |
| CONTIG2995 | 2929807_f1_4 | 8576 | 22679 | 249 | 83 | | | | | |
| CONTIG2996 | 23917257_c1_3 | 8577 | 22680 | 219 | 73 | | | | | |
| CONTIG2996 | 1362688_c1_4 | 8578 | 22681 | 252 | 84 | | | | | |
| CONTIG2996 | 36531550_c2_5 | 8579 | 22682 | 234 | 78 | | | | | |
| CONTIG2997 | 6103387_c1_2 | 8580 | 22683 | 237 | 79 | | | | | |
| CONTIG2999 | 22447212_f1_1 | 8581 | 22684 | 219 | 73 | | | | | |
| CONTIG2999 | 24800812_f2_2 | 8582 | 22685 | 225 | 75 | | | | | |
| CONTIG2999 | 5975282_f2_3 | 8583 | 22686 | 249 | 83 | | | | | |
| CONTIG2999 | 23601011_c1_4 | 8584 | 22687 | 198 | 66 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3 | 2375055_c2_1 | 8585 | 22688 | 213 | 71 | | | | | |
| CONTIG3 | 24648377_c3_2 | 8586 | 22689 | 261 | 87 | | | | | |
| CONTIG30 | 30662635_f1_1 | 8587 | 22690 | 222 | 74 | | | | | |
| CONTIG30 | 22365931_f3_2 | 8588 | 22691 | 219 | 73 | | | | | |
| CONTIG300 | 23634450_f2_1 | 8589 | 22692 | 198 | 66 | | | | | |
| CONTIG300 | 6250305_f3_2 | 8590 | 22693 | 222 | 74 | | | | | |
| CONTIG300 | 11736316_f2_3 | 8591 | 22694 | 324 | 108 | | | | | |
| CONTIG3000 | 3985000_f3_4 | 8592 | 22695 | 708 | 236 | | | | | |
| CONTIG3002 | 6062758_c2_5 | 8593 | 22696 | 228 | 76 | | | | | |
| CONTIG3003 | 1381432_f1_1 | 8594 | 22697 | 195 | 65 | | | | | |
| CONTIG3005 | 4742252_f3_3 | 8595 | 22698 | 219 | 73 | | | | | |
| CONTIG3005 | 24390687_c3_5 | 8596 | 22699 | 276 | 92 | | | | | |
| CONTIG3005 | 10976587_c3_6 | 8597 | 22700 | 189 | 63 | | | | | |
| CONTIG3006 | 19735277_f2_1 | 8598 | 22701 | 294 | 98 | | | | | |
| CONTIG301 | 22457938_c1_3 | 8599 | 22702 | 189 | 63 | | | | | |
| CONTIG3010 | 29461081_c1_6 | 8600 | 22703 | 225 | 75 | | | | | |
| CONTIG3011 | 22692256_c2_7 | 8601 | 22704 | 183 | 61 | | | | | |
| CONTIG3011 | 24025012_c3_9 | 8602 | 22705 | 237 | 79 | | | | | |
| CONTIG3013 | 35176650_f1_2 | 8603 | 22706 | 192 | 64 | | | | | |
| CONTIG3013 | 6897215_f3_6 | 8604 | 22707 | 603 | 201 | | | | | |
| CONTIG3019 | 23995252_c3_4 | 8605 | 22708 | 225 | 75 | | | | | |
| CONTIG302 | 2051426_c3_2 | 8606 | 22709 | 210 | 70 | | | | | |
| CONTIG3021 | 10578430_c3_4 | 8607 | 22710 | 1659 | 553 | | | | | |
| CONTIG3022 | 437692_f1_1 | 8608 | 22711 | 252 | 84 | | | | | |
| CONTIG3022 | 5084625_f3_5 | 8609 | 22712 | 201 | 67 | | | | | |
| CONTIG3022 | 32226562_c1_7 | 8610 | 22713 | 198 | 66 | | | | | |
| CONTIG3022 | 55312_c2_8 | 8611 | 22714 | 300 | 100 | | | | | |
| CONTIG3022 | 25864057_c3_10 | 8612 | 22715 | 666 | 222 | | | | | |
| CONTIG3023 | 82632_cl_2 | 8613 | 22716 | 294 | 98 | | | | | |
| CONTIG3024 | 4742901_f1_1 | 8614 | 22717 | 195 | 65 | | | | | |
| CONTIG3027 | 6814056_c1_2 | 8615 | 22718 | 234 | 78 | | | | | |
| CONTIG303 | 194425_f3_1 | 8616 | 22719 | 252 | 84 | | | | | |
| CONTIG303 | 4096875_c3_2 | 8617 | 22720 | 450 | 150 | | | | | |
| CONTIG3030 | 16207711_f2_2 | 8618 | 22721 | 240 | 80 | | | | | |
| CONTIG3030 | 2506875_c3_6 | 8619 | 22722 | 327 | 109 | | | | | |
| CONTIG3031 | 10282513_c1_4 | 8620 | 22723 | 204 | 68 | | | | | |
| CONTIG3031 | 10350631_c2_7 | 8621 | 22724 | 186 | 62 | | | | | |
| CONTIG3031 | 14229192_c3_8 | 8622 | 22725 | 228 | 76 | | | | | |
| CONTIG3032 | 2366639_c3_9 | 8623 | 22726 | 222 | 74 | | | | | |
| CONTIG3032 | 3605462_f1_1 | 8624 | 22727 | 222 | 74 | | | | | |
| CONTIG3032 | 1984842_f2_2 | 8625 | 22728 | 816 | 272 | | | | | |
| CONTIG3035 | 24617250_f1_1 | 8626 | 22729 | 285 | 95 | | | | | |
| CONTIG3038 | 4298338_c3_4 | 8627 | 22730 | 435 | 145 | | | | | |
| CONTIG3040 | 35818775_f1_1 | 8628 | 22731 | 249 | 83 | | | | | |
| CONTIG3041 | 21775688_f1_1 | 8629 | 22732 | 204 | 68 | | | | | |
| CONTIG3041 | 24414043_c2_7 | 8630 | 22733 | 216 | 72 | | | | | |
| CONTIG3042 | 10640632_c2_1 | 8631 | 22734 | 249 | 83 | | | | | |
| CONTIG3042 | 36617200_c2_2 | 8632 | 22735 | 195 | 65 | | | | | |
| CONTIG3043 | 12126285_c2_11 | 8633 | 22736 | 576 | 192 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3045 | 25426255_f2_3 | 8634 | 22737 | 249 | 83 | | | | | |
| CONTIG3045 | 12301536_c3_6 | 8635 | 22738 | 192 | 64 | | | | | |
| CONTIG3046 | 34095536_f1_3 | 8636 | 22739 | 216 | 72 | | | | | |
| CONTIG3046 | 2535878_f1_4 | 8637 | 22740 | 204 | 68 | | | | | |
| CONTIG3046 | 23626503_f3_6 | 8638 | 22741 | 204 | 68 | | | | | |
| CONTIG3046 | 14640932_f3_8 | 8639 | 22742 | 300 | 100 | | | | | |
| CONTIG3047 | 6829525_c2_1 | 8640 | 22743 | 222 | 74 | | | | | |
| CONTIG3049 | 22439007_f2_1 | 8641 | 22744 | 765 | 255 | | | | | |
| CONTIG305 | 26348442_c3_1 | 8642 | 22745 | 186 | 62 | | | | | |
| CONTIG3050 | 4098385_c1_4 | 8643 | 22746 | 285 | 95 | | | | | |
| CONTIG3050 | 24406932_c3_6 | 8644 | 22747 | 225 | 75 | | | | | |
| CONTIG3050 | 195127_c3_7 | 8645 | 22748 | 720 | 240 | | | | | |
| CONTIG3053 | 157763_f2_3 | 8646 | 22749 | 195 | 65 | | | | | |
| CONTIG3053 | 24414688_c2_4 | 8647 | 22750 | 192 | 64 | | | | | |
| CONTIG3053 | 22036662_c2_6 | 8648 | 22751 | 183 | 61 | | | | | |
| CONTIG3056 | 19554788_f1_1 | 8649 | 22752 | 234 | 78 | | | | | |
| CONTIG3058 | 25425767_c2_5 | 8650 | 22753 | 207 | 69 | | | | | |
| CONTIG3059 | 4725262_f3_5 | 8651 | 22754 | 222 | 74 | | | | | |
| CONTIG3059 | 32110067_c1_6 | 8652 | 22755 | 195 | 65 | | | | | |
| CONTIG306 | 16054712_c1_1 | 8653 | 22756 | 426 | 142 | | | | | |
| CONTIG3060 | 32084755_f1_1 | 8654 | 22757 | 201 | 67 | | | | | |
| CONTIG3061 | 23547130_f3_3 | 8655 | 22758 | 195 | 65 | | | | | |
| CONTIG3062 | 36601712_f1_1 | 8656 | 22759 | 228 | 76 | | | | | |
| CONTIG3063 | 22066556_c3_7 | 8657 | 22760 | 234 | 78 | | | | | |
| CONTIG3068 | 14143767_f2_2 | 8658 | 22761 | 891 | 297 | | | | | |
| CONTIG307 | 36042515_f3_2 | 8659 | 22762 | 192 | 64 | | | | | |
| CONTIG3071 | 19687627_f3_2 | 8660 | 22763 | 189 | 63 | | | | | |
| CONTIG3072 | 10054562_c1_5 | 8661 | 22764 | 225 | 75 | | | | | |
| CONTIG3076 | 6094191_c1_2 | 8662 | 22765 | 204 | 68 | | | | | |
| CONTIG3076 | 35166002_c3_4 | 8663 | 22766 | 186 | 62 | | | | | |
| CONTIG3078 | 974038_f2_3 | 8664 | 22767 | 189 | 63 | | | | | |
| CONTIG3078 | 14453405_c3_7 | 8665 | 22768 | 294 | 98 | | | | | |
| CONTIG3080 | 31281306_c3_7 | 8666 | 22769 | 255 | 85 | | | | | |
| CONTIG3083 | 10833567_f1_1 | 8667 | 22770 | 207 | 69 | | | | | |
| CONTIG3083 | 272877_f1_2 | 8668 | 22771 | 744 | 248 | | | | | |
| CONTIG3083 | 16291703_c2_6 | 8669 | 22772 | 621 | 207 | | | | | |
| CONTIG3085 | 4062750_c1_3 | 8670 | 22773 | 261 | 87 | | | | | |
| CONTIG3086 | 14554750_c3_8 | 8671 | 22774 | 246 | 82 | | | | | |
| CONTIG3087 | 22273425_f1_1 | 8672 | 22775 | 222 | 74 | | | | | |
| CONTIG3087 | 26187963_f2_2 | 8673 | 22776 | 249 | 83 | | | | | |
| CONTIG309 | 21679640_c3_2 | 8674 | 22777 | 216 | 72 | | | | | |
| CONTIG3090 | 1298316_f1_1 | 8675 | 22778 | 780 | 260 | | | | | |
| CONTIG3092 | 1198276_f1_1 | 8676 | 22779 | 204 | 68 | | | | | |
| CONTIG3092 | 12691937_c1_4 | 8677 | 22780 | 207 | 69 | | | | | |
| CONTIG3092 | 23913888_c2_6 | 8678 | 22781 | 255 | 85 | | | | | |
| CONTIG3093 | 20709712_f1_2 | 8679 | 22782 | 255 | 85 | | | | | |
| CONTIG3094 | 24413312_f1_1 | 8680 | 22783 | 186 | 62 | | | | | |
| CONTIG3094 | 22832952_f1_2 | 8681 | 22784 | 1008 | 336 | | | | | |
| CONTIG3094 | 3165813_f2_5 | 8682 | 22785 | 399 | 133 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3095 | 433332_f3_3 | 8683 | 22786 | 1032 | 344 | | | | | |
| CONTIG3097 | 13679590_c3_4 | 8684 | 22787 | 237 | 79 | | | | | |
| CONTIG3098 | 25397150_f3_2 | 8685 | 22788 | 234 | 78 | | | | | |
| CONTIG3099 | 23600427_f3_5 | 8686 | 22789 | 528 | 176 | | | | | |
| CONTIG3099 | 22363281_c2_6 | 8687 | 22790 | 240 | 80 | | | | | |
| CONTIG310 | 11173430_f3_1 | 8688 | 22791 | 231 | 77 | | | | | |
| CONTIG3102 | 4535066_c2_2 | 8689 | 22792 | 222 | 74 | | | | | |
| CONTIG3104 | 4460881_f1_2 | 8690 | 22793 | 186 | 62 | | | | | |
| CONTIG3104 | 1074012_f3_5 | 8691 | 22794 | 426 | 142 | | | | | |
| CONTIG3105 | 4097008_f3_6 | 8692 | 22795 | 324 | 108 | | | | | |
| CONTIG3106 | 26290938_f1_2 | 8693 | 22796 | 195 | 65 | | | | | |
| CONTIG3106 | 29688750_c1_9 | 8694 | 22797 | 369 | 123 | | | | | |
| CONTIG3108 | 12694102_f1_1 | 8695 | 22798 | 489 | 163 | | | | | |
| CONTIG3108 | 4535066_f1_2 | 8696 | 22799 | 243 | 81 | | | | | |
| CONTIG3108 | 9769002_f1_3 | 8697 | 22800 | 213 | 71 | | | | | |
| CONTIG3108 | 6642006_f3_4 | 8698 | 22801 | 201 | 67 | | | | | |
| CONTIG3109 | 24019686_f3_2 | 8699 | 22802 | 465 | 155 | | | | | |
| CONTIG3109 | 10831387_c3_5 | 8700 | 22803 | 474 | 158 | | | | | |
| CONTIG3110 | 20507192_c1_2 | 8701 | 22804 | 189 | 63 | | | | | |
| CONTIG3110 | 34163962_f2_3 | 8702 | 22805 | 477 | 159 | | | | | |
| CONTIG3110 | 156250_f3_6 | 8703 | 22806 | 213 | 71 | | | | | |
| CONTIG3111 | 21914206_f1_1 | 8704 | 22807 | 186 | 62 | | | | | |
| CONTIG3112 | 4955080_c3_5 | 8705 | 22808 | 591 | 197 | | | | | |
| CONTIG3113 | 13789032_f3_2 | 8706 | 22809 | 891 | 297 | | | | | |
| CONTIG3115 | 957502_f2_1 | 8707 | 22810 | 201 | 67 | | | | | |
| CONTIG3116 | 15784441_f3_3 | 8708 | 22811 | 384 | 128 | | | | | |
| CONTIG3117 | 16797136_c3_8 | 8709 | 22812 | 603 | 201 | | | | | |
| CONTIG3118 | 33714388_c2_2 | 8710 | 22813 | 201 | 67 | | | | | |
| CONTIG3120 | 25423302_c3_2 | 8711 | 22814 | 576 | 192 | | | | | |
| CONTIG3121 | 3939385_f1_1 | 8712 | 22815 | 321 | 107 | | | | | |
| CONTIG3121 | 9788937_f3_9 | 8713 | 22816 | 300 | 100 | | | | | |
| CONTIG3121 | 24426692_f3_10 | 8714 | 22817 | 279 | 93 | | | | | |
| CONTIG3121 | 4801436_f3_11 | 8715 | 22818 | 858 | 286 | | | | | |
| CONTIG3121 | 4957928_c3_13 | 8716 | 22819 | 285 | 95 | | | | | |
| CONTIG3123 | 2166652_f1_1 | 8717 | 22820 | 543 | 181 | | | | | |
| CONTIG3123 | 24431642_f2_2 | 8718 | 22821 | 210 | 70 | | | | | |
| CONTIG3123 | 7047512_c3_5 | 8719 | 22822 | 213 | 71 | | | | | |
| CONTIG3124 | 1260062_c2_5 | 8720 | 22823 | 1461 | 487 | | | | | |
| CONTIG3125 | 36040788_f3_3 | 8721 | 22824 | 312 | 104 | | | | | |
| CONTIG3125 | 19542550_c3_9 | 8722 | 22825 | 183 | 61 | | | | | |
| CONTIG3126 | 10976527_f1_1 | 8723 | 22826 | 636 | 212 | | | | | |
| CONTIG3127 | 6741260_f3_1 | 8724 | 22827 | 225 | 75 | | | | | |
| CONTIG3128 | 10000313_c3_3 | 8725 | 22828 | 576 | 192 | | | | | |
| CONTIG3130 | 22657162_f2_2 | 8726 | 22829 | 195 | 65 | | | | | |
| CONTIG3130 | 547010_c1_3 | 8727 | 22830 | 198 | 66 | | | | | |
| CONTIG3130 | 24220001_c3_6 | 8728 | 22831 | 324 | 108 | | | | | |
| CONTIG3131 | 2915892_f2_2 | 8729 | 22832 | 219 | 73 | | | | | |
| CONTIG3131 | 31901952_c3_3 | 8730 | 22833 | 192 | 64 | | | | | |
| CONTIG3134 | 2345281_f2_2 | 8731 | 22834 | 1068 | 356 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3134 | 24650130_f3_3 | 8732 | 22835 | 264 | 88 | | | | | |
| CONTIG3134 | 24332176_c1_5 | 8733 | 22836 | 195 | 65 | | | | | |
| CONTIG3137 | 16253840_c3_6 | 8734 | 22837 | 1320 | 440 | | | | | |
| CONTIG3138 | 26600777_f2_1 | 8735 | 22838 | 186 | 62 | | | | | |
| CONTIG3139 | 12516512_f3_3 | 8736 | 22839 | 204 | 68 | | | | | |
| CONTIG314 | 35422253_f2_1 | 8737 | 22840 | 234 | 78 | | | | | |
| CONTIG314 | 15709636_f2_2 | 8738 | 22841 | 222 | 74 | | | | | |
| CONTIG3141 | 116300_c2_6 | 8739 | 22842 | 282 | 94 | | | | | |
| CONTIG3142 | 15100027_c1_4 | 8740 | 22843 | 384 | 128 | | | | | |
| CONTIG3146 | 22661076_f2_1 | 8741 | 22844 | 258 | 86 | | | | | |
| CONTIG3146 | 29478785_c1_2 | 8742 | 22845 | 240 | 80 | | | | | |
| CONTIG3146 | 34180300_c2_3 | 8743 | 22846 | 243 | 81 | | | | | |
| CONTIG3147 | 5937512_f3_5 | 8744 | 22847 | 195 | 65 | | | | | |
| CONTIG3148 | 2597817_c2_6 | 8745 | 22848 | 279 | 93 | | | | | |
| CONTIG3148 | 3937761_c3_7 | 8746 | 22849 | 303 | 101 | | | | | |
| CONTIG3149 | 16620305_f3_1 | 8747 | 22850 | 249 | 83 | | | | | |
| CONTIG315 | 16803817_c2_1 | 8748 | 22851 | 186 | 62 | | | | | |
| CONTIG3150 | 19729640_f2_2 | 8749 | 22852 | 318 | 106 | | | | | |
| CONTIG3150 | 13006503_f2_3 | 8750 | 22853 | 186 | 62 | | | | | |
| CONTIG3150 | 22828136_f3_4 | 8751 | 22854 | 264 | 88 | | | | | |
| CONTIG3150 | 24238593_c3_7 | 8752 | 22855 | 195 | 65 | | | | | |
| CONTIG3150 | 20329638_c3_8 | 8753 | 22856 | 207 | 69 | | | | | |
| CONTIG3151 | 4459705_c2_6 | 8754 | 22857 | 195 | 65 | | | | | |
| CONTIG3151 | 23476718_c3_9 | 8755 | 22858 | 636 | 212 | | | | | |
| CONTIG3152 | 21643775_f1_1 | 8756 | 22859 | 189 | 63 | | | | | |
| CONTIG3153 | 4687950_c3_4 | 8757 | 22860 | 219 | 73 | | | | | |
| CONTIG3154 | 1067693_f1_1 | 8758 | 22861 | 342 | 114 | | | | | |
| CONTIG3154 | 26351686_f1_2 | 8759 | 22862 | 210 | 70 | | | | | |
| CONTIG3154 | 6742042_c1_3 | 8760 | 22863 | 240 | 80 | | | | | |
| CONTIG3155 | 23944152_f2_3 | 8761 | 22864 | 186 | 62 | | | | | |
| CONTIG3155 | 562760_c2_4 | 8762 | 22865 | 192 | 64 | | | | | |
| CONTIG3156 | 2929542_c2_4 | 8763 | 22866 | 225 | 75 | | | | | |
| CONTIG3157 | 14648442_c2_6 | 8764 | 22867 | 408 | 136 | | | | | |
| CONTIG3157 | 9945932_c3_7 | 8765 | 22868 | 204 | 68 | | | | | |
| CONTIG3158 | 29539510_f1_1 | 8766 | 22869 | 264 | 88 | | | | | |
| CONTIG3158 | 838575_f2_3 | 8767 | 22870 | 267 | 89 | | | | | |
| CONTIG3158 | 10938377_f3_5 | 8768 | 22871 | 195 | 65 | | | | | |
| CONTIG316 | 16803817_c2_1 | 8769 | 22872 | 186 | 62 | | | | | |
| CONTIG3160 | 16806392_f1_1 | 8770 | 22873 | 201 | 67 | | | | | |
| CONTIG3160 | 13961557_f1_2 | 8771 | 22874 | 285 | 95 | | | | | |
| CONTIG3161 | 24492187_c3_3 | 8772 | 22875 | 318 | 106 | | | | | |
| CONTIG3162 | 821090_f1_1 | 8773 | 22876 | 588 | 196 | | | | | |
| CONTIG3162 | 4019631_f2_2 | 8774 | 22877 | 339 | 113 | | | | | |
| CONTIG3162 | 24220316_c3_3 | 8775 | 22878 | 201 | 67 | | | | | |
| CONTIG3164 | 4115680_c3_6 | 8776 | 22879 | 354 | 118 | | | | | |
| CONTIG3165 | 33397581_c2_1 | 8777 | 22880 | 2001 | 667 | | | | | |
| CONTIG3167 | 26646887_c2_6 | 8778 | 22881 | 279 | 93 | | | | | |
| CONTIG317 | 5320152_c1_2 | 8779 | 22882 | 183 | 61 | | | | | |
| CONTIG3170 | 24392556_f3_1 | 8780 | 22883 | 216 | 72 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3172 | 1382778_f3_3 | 8781 | 22884 | 240 | 80 | | | | | |
| CONTIG3172 | 23625830_c1_6 | 8782 | 22885 | 186 | 62 | | | | | |
| CONTIG3174 | 22461562_f3_1 | 8783 | 22886 | 219 | 73 | | | | | |
| CONTIG3175 | 24492135_f3_2 | 8784 | 22887 | 225 | 75 | | | | | |
| CONTIG3176 | 35392200_c3_5 | 8785 | 22888 | 444 | 148 | | | | | |
| CONTIG3180 | 14629655_c1_7 | 8786 | 22889 | 228 | 76 | | | | | |
| CONTIG3180 | 4808507_c1_8 | 8787 | 22890 | 270 | 90 | | | | | |
| CONTIG3180 | 26283378_c3_16 | 8788 | 22891 | 255 | 85 | | | | | |
| CONTIG3181 | 4790962_c1_4 | 8789 | 22892 | 471 | 157 | | | | | |
| CONTIG3182 | 7314050_f3_4 | 8790 | 22893 | 321 | 107 | | | | | |
| CONTIG3184 | 24334687_c2_8 | 8791 | 22894 | 192 | 64 | | | | | |
| CONTIG3185 | 20409687_f2_2 | 8792 | 22895 | 267 | 89 | | | | | |
| CONTIG3185 | 3142175_c1_3 | 8793 | 22896 | 309 | 103 | | | | | |
| CONTIG3186 | 3937533_c3_5 | 8794 | 22897 | 189 | 63 | | | | | |
| CONTIG3186 | 12937788_f3_1 | 8795 | 22898 | 237 | 79 | | | | | |
| CONTIG3187 | 26213875_f3_4 | 8796 | 22899 | 240 | 80 | | | | | |
| CONTIG3188 | 24494127_f1_1 | 8797 | 22900 | 567 | 189 | | | | | |
| CONTIG3188 | 14941002_f3_2 | 8798 | 22901 | 570 | 190 | | | | | |
| CONTIG319 | 41666651_f3_1 | 8799 | 22902 | 288 | 96 | | | | | |
| CONTIG3190 | 9928753_c1_6 | 8800 | 22903 | 396 | 132 | | | | | |
| CONTIG3193 | 2988902_c3_8 | 8801 | 22904 | 591 | 197 | | | | | |
| CONTIG3194 | 782535_f1_2 | 8802 | 22905 | 222 | 74 | | | | | |
| CONTIG3195 | 22117162_c3_1 | 8803 | 22906 | 243 | 81 | | | | | |
| CONTIG3196 | 22461063_c1_6 | 8804 | 22907 | 234 | 78 | | | | | |
| CONTIG3199 | 34406700_f1_1 | 8805 | 22908 | 186 | 62 | | | | | |
| CONTIG3199 | 2820377_f1_2 | 8806 | 22909 | 234 | 78 | | | | | |
| CONTIG3199 | 25942308_c2_8 | 8807 | 22910 | 693 | 231 | | | | | |
| CONTIG32 | 22948767_f1_1 | 8808 | 22911 | 270 | 90 | | | | | |
| CONTIG3200 | 3990763_f2_3 | 8809 | 22912 | 327 | 109 | | | | | |
| CONTIG3201 | 10751967_f2_1 | 8810 | 22913 | 363 | 121 | | | | | |
| CONTIG3201 | 26376078_c3_9 | 8811 | 22914 | 438 | 146 | | | | | |
| CONTIG3202 | 25397187_f3_1 | 8812 | 22915 | 225 | 75 | | | | | |
| CONTIG3203 | 14223750_c1_2 | 8813 | 22916 | 1152 | 384 | | | | | |
| CONTIG3203 | 34179756_c3_3 | 8814 | 22917 | 210 | 70 | | | | | |
| CONTIG3204 | 33461626_c3_5 | 8815 | 22918 | 204 | 68 | | | | | |
| CONTIG3209 | 29488537_f3_2 | 8816 | 22919 | 213 | 71 | | | | | |
| CONTIG3211 | 4297215_c1_7 | 8817 | 22920 | 1485 | 495 | | | | | |
| CONTIG3212 | 24789037_f3_3 | 8818 | 22921 | 285 | 95 | | | | | |
| CONTIG3213 | 16053375_c1_2 | 8819 | 22922 | 252 | 84 | | | | | |
| CONTIG3218 | 6647762_c1_5 | 8820 | 22923 | 222 | 74 | | | | | |
| CONTIG3218 | 26755280_c1_7 | 8821 | 22924 | 435 | 145 | | | | | |
| CONTIG3218 | 36448452_c2_8 | 8822 | 22925 | 201 | 67 | | | | | |
| CONTIG3219 | 25395662_f1_1 | 8823 | 22926 | 201 | 67 | | | | | |
| CONTIG3219 | 10031510_c3_8 | 8824 | 22927 | 585 | 195 | | | | | |
| CONTIG322 | 14564567_f2_1 | 8825 | 22928 | 714 | 238 | | | | | |
| CONTIG3220 | 24015680_c2_4 | 8826 | 22929 | 231 | 77 | | | | | |
| CONTIG3222 | 26822293_f3_7 | 8827 | 22930 | 201 | 67 | | | | | |
| CONTIG3222 | 34198462_c3_11 | 8828 | 22931 | 354 | 118 | | | | | |
| CONTIG3225 | 5993802_f3_2 | 8829 | 22932 | 240 | 80 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3227 | 10190906_c1_3 | 8830 | 22933 | 240 | 80 | | | | | |
| CONTIG3227 | 23603463_c2_7 | 8831 | 22934 | 225 | 75 | | | | | |
| CONTIG3228 | 1441332_f1_1 | 8832 | 22935 | 288 | 96 | | | | | |
| CONTIG3228 | 3956537_f1_2 | 8833 | 22936 | 267 | 89 | | | | | |
| CONTIG3229 | 31295207_c3_7 | 8834 | 22937 | 207 | 69 | | | | | |
| CONTIG3230 | 25423885_f1_1 | 8835 | 22938 | 312 | 104 | | | | | |
| CONTIG3230 | 157500_f1_2 | 8836 | 22939 | 525 | 175 | | | | | |
| CONTIG3230 | 4692152_f2_3 | 8837 | 22940 | 237 | 79 | | | | | |
| CONTIG3230 | 594175_f3_4 | 8838 | 22941 | 246 | 82 | | | | | |
| CONTIG3230 | 29533140_c3_6 | 8839 | 22942 | 324 | 108 | | | | | |
| CONTIG3231 | 22657635_f1_1 | 8840 | 22943 | 720 | 240 | | | | | |
| CONTIG3235 | 25556255_c3_4 | 8841 | 22944 | 189 | 63 | | | | | |
| CONTIG3235 | 30707575_c3_5 | 8842 | 22945 | 183 | 61 | | | | | |
| CONTIG3237 | 21618957_f1_1 | 8843 | 22946 | 309 | 103 | | | | | |
| CONTIG3238 | 24490927_f2_2 | 8844 | 22947 | 225 | 75 | | | | | |
| CONTIG3238 | 16209750_f3_3 | 8845 | 22948 | 189 | 63 | | | | | |
| CONTIG3239 | 34464018_f2_3 | 8846 | 22949 | 186 | 62 | | | | | |
| CONTIG3240 | 34033450_f2_2 | 8847 | 22950 | 201 | 67 | | | | | |
| CONTIG3240 | 34572068_f2_3 | 8848 | 22951 | 201 | 67 | | | | | |
| CONTIG3240 | 34064378_f3_4 | 8849 | 22952 | 261 | 87 | | | | | |
| CONTIG3240 | 6645012_c2_6 | 8850 | 22953 | 204 | 68 | | | | | |
| CONTIG3240 | 2132807_c3_7 | 8851 | 22954 | 492 | 164 | | | | | |
| CONTIG3242 | 9944505_f3_2 | 8852 | 22955 | 648 | 216 | | | | | |
| CONTIG3243 | 6048402_c2_3 | 8853 | 22956 | 279 | 93 | | | | | |
| CONTIG3244 | 22308161_f1_1 | 8854 | 22957 | 567 | 189 | | | | | |
| CONTIG3246 | 20444002_f3_1 | 8855 | 22958 | 210 | 70 | | | | | |
| CONTIG3247 | 25938966_f3_1 | 8856 | 22959 | 354 | 118 | | | | | |
| CONTIG3247 | 14586580_f3_2 | 8857 | 22960 | 309 | 103 | | | | | |
| CONTIG3248 | 4818878_c2_6 | 8858 | 22961 | 669 | 223 | | | | | |
| CONTIG3249 | 24804681_f2_2 | 8859 | 22962 | 219 | 73 | | | | | |
| CONTIG325 | 24098875_f3_2 | 8860 | 22963 | 519 | 173 | | | | | |
| CONTIG3250 | 1456275_f1_1 | 8861 | 22964 | 204 | 68 | | | | | |
| CONTIG3250 | 33994057_c1_3 | 8862 | 22965 | 378 | 126 | | | | | |
| CONTIG3250 | 4192163_c2_5 | 8863 | 22966 | 264 | 88 | | | | | |
| CONTIG3251 | 24070342_f2_2 | 8864 | 22967 | 183 | 61 | | | | | |
| CONTIG3252 | 20489501_c1_5 | 8865 | 22968 | 201 | 67 | | | | | |
| CONTIG3253 | 26366262_c3_6 | 8866 | 22969 | 231 | 77 | | | | | |
| CONTIG3254 | 393760_f1_1 | 8867 | 22970 | 201 | 67 | | | | | |
| CONTIG3255 | 13867937_c2_4 | 8868 | 22971 | 744 | 248 | | | | | |
| CONTIG3256 | 1204643_f3_3 | 8869 | 22972 | 216 | 72 | | | | | |
| CONTIG3259 | 24324062_c2_6 | 8870 | 22973 | 717 | 239 | | | | | |
| CONTIG3259 | 26209702_c3_7 | 8871 | 22974 | 291 | 97 | | | | | |
| CONTIG3260 | 34620313_f2_1 | 8872 | 22975 | 186 | 62 | | | | | |
| CONTIG3261 | 9953811_c1_3 | 8873 | 22976 | 453 | 151 | | | | | |
| CONTIG3261 | 25562885_c3_5 | 8874 | 22977 | 288 | 96 | | | | | |
| CONTIG3262 | 243830_f1_3 | 8875 | 22978 | 201 | 67 | | | | | |
| CONTIG3263 | 14221962_f3_1 | 8876 | 22979 | 204 | 68 | | | | | |
| CONTIG3264 | 3365937_c2_5 | 8877 | 22980 | 1683 | 561 | | | | | |
| CONTIG3266 | 3126912_c1_1 | 8878 | 22981 | 225 | 75 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3266 | 6760300_c1_3 | 8879 | 22982 | 252 | 84 | | | | | |
| CONTIG3268 | 32205055_c2_6 | 8880 | 22983 | 207 | 69 | | | | | |
| CONTIG3270 | 24095687_f1_1 | 8881 | 22984 | 519 | 173 | | | | | |
| CONTIG3270 | 26253563_f3_3 | 8882 | 22985 | 333 | 111 | | | | | |
| CONTIG3270 | 26564010_c2_6 | 8883 | 22986 | 753 | 251 | | | | | |
| CONTIG3271 | 10751637_f1_1 | 8884 | 22987 | 189 | 63 | | | | | |
| CONTIG3271 | 14859680_f2_2 | 8885 | 22988 | 1149 | 383 | | | | | |
| CONTIG3272 | 3585312_c2_3 | 8886 | 22989 | 183 | 61 | | | | | |
| CONTIG3272 | 4875002_c2_4 | 8887 | 22990 | 183 | 61 | | | | | |
| CONTIG3272 | 32227312_c3_5 | 8888 | 22991 | 222 | 74 | | | | | |
| CONTIG3274 | 9765636_f3_5 | 8889 | 22992 | 288 | 96 | | | | | |
| CONTIG3276 | 6755465_f3_2 | 8890 | 22993 | 1707 | 569 | | | | | |
| CONTIG3278 | 4394531_f1_1 | 8891 | 22994 | 192 | 64 | | | | | |
| CONTIG3278 | 1179042_c3_5 | 8892 | 22995 | 192 | 64 | | | | | |
| CONTIG3279 | 20520311_f3_3 | 8893 | 22996 | 195 | 65 | | | | | |
| CONTIG3280 | 13945257_f3_5 | 8894 | 22997 | 183 | 61 | | | | | |
| CONTIG3281 | 4453762_f3_3 | 8895 | 22998 | 243 | 81 | | | | | |
| CONTIG3281 | 820131_c2_4 | 8896 | 22999 | 1170 | 390 | | | | | |
| CONTIG3282 | 7866225_c1_6 | 8897 | 23000 | 204 | 68 | | | | | |
| CONTIG3282 | 15038911_c1_7 | 8898 | 23001 | 231 | 77 | | | | | |
| CONTIG3284 | 2211827_f1_1 | 8899 | 23002 | 186 | 62 | | | | | |
| CONTIG3285 | 29501677_f2_3 | 8900 | 23003 | 216 | 72 | | | | | |
| CONTIG3285 | 5969017_c2_6 | 8901 | 23004 | 201 | 67 | | | | | |
| CONTIG3285 | 22928518_c3_8 | 8902 | 23005 | 183 | 61 | | | | | |
| CONTIG3286 | 35360256_f1_2 | 8903 | 23006 | 192 | 64 | | | | | |
| CONTIG3286 | 19689125_f1_3 | 8904 | 23007 | 396 | 132 | | | | | |
| CONTIG3286 | 4532817_f3_4 | 8905 | 23008 | 228 | 76 | | | | | |
| CONTIG3288 | 822135_c1_1 | 8906 | 23009 | 1107 | 369 | | | | | |
| CONTIG3288 | 819436_c3_3 | 8907 | 23010 | 210 | 70 | | | | | |
| CONTIG3290 | 6835887_c3_3 | 8908 | 23011 | 1176 | 392 | | | | | |
| CONTIG3291 | 4116658_f2_2 | 8909 | 23012 | 339 | 113 | | | | | |
| CONTIG3293 | 1346910_f2_1 | 8910 | 23013 | 1680 | 560 | | | | | |
| CONTIG3294 | 9885830_f3_2 | 8911 | 23014 | 279 | 93 | | | | | |
| CONTIG3296 | 391925_c2_7 | 8912 | 23015 | 189 | 63 | | | | | |
| CONTIG3297 | 24801063_c1_7 | 8913 | 23016 | 279 | 93 | | | | | |
| CONTIG3298 | 1409657_c2_2 | 8914 | 23017 | 879 | 293 | | | | | |
| CONTIG3299 | 30089638_f3_3 | 8915 | 23018 | 183 | 61 | | | | | |
| CONTIG3300 | 4771937_c1_6 | 8916 | 23019 | 240 | 80 | | | | | |
| CONTIG3301 | 4142508_c3_3 | 8917 | 23020 | 861 | 287 | | | | | |
| CONTIG3303 | 22900762_f1_1 | 8918 | 23021 | 201 | 67 | | | | | |
| CONTIG3305 | 5972127_f2_3 | 8919 | 23022 | 228 | 76 | | | | | |
| CONTIG3305 | 35429578_f3_4 | 8920 | 23023 | 354 | 118 | | | | | |
| CONTIG3306 | 4711657_c3_10 | 8921 | 23024 | 210 | 70 | | | | | |
| CONTIG3306 | 3306375_c1_3 | 8922 | 23025 | 213 | 71 | | | | | |
| CONTIG3307 | 25423561_c1_4 | 8923 | 23026 | 2064 | 688 | | | | | |
| CONTIG3309 | 2494793_f2_1 | 8924 | 23027 | 228 | 76 | | | | | |
| CONTIG331 | 16970461_c3_1 | 8925 | 23028 | 585 | 195 | | | | | |
| CONTIG3310 | 35156540_c2_6 | 8926 | 23029 | 357 | 119 | | | | | |
| CONTIG3311 | 29688750_f3_6 | 8927 | 23030 | 369 | 123 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3313 | 58557_c1_8 | 8928 | 23031 | 216 | 72 | | | | | |
| CONTIG3314 | 960336_f1_1 | 8929 | 23032 | 201 | 67 | | | | | |
| CONTIG3314 | 2636927_c1_6 | 8930 | 23033 | 234 | 78 | | | | | |
| CONTIG3314 | 4189077_c2_10 | 8931 | 23034 | 1188 | 396 | | | | | |
| CONTIG3316 | 30556530_c1_2 | 8932 | 23035 | 702 | 234 | | | | | |
| CONTIG3317 | 36111013_f1_1 | 8933 | 23036 | 201 | 67 | | | | | |
| CONTIG3317 | 33859576_f3_5 | 8934 | 23037 | 267 | 89 | | | | | |
| CONTIG3318 | 792137_f3_4 | 8935 | 23038 | 387 | 129 | | | | | |
| CONTIG3319 | 6735133_f2_1 | 8936 | 23039 | 1386 | 462 | | | | | |
| CONTIG332 | 10830193_f1_1 | 8937 | 23040 | 303 | 101 | | | | | |
| CONTIG3320 | 29558215_c3_5 | 8938 | 23041 | 225 | 75 | | | | | |
| CONTIG3321 | 6834385_f1_2 | 8939 | 23042 | 204 | 68 | | | | | |
| CONTIG3321 | 11727325_c1_3 | 8940 | 23043 | 207 | 69 | | | | | |
| CONTIG3322 | 1990652_f2_2 | 8941 | 23044 | 216 | 72 | | | | | |
| CONTIG3324 | 35948255_c2_5 | 8942 | 23045 | 186 | 62 | | | | | |
| CONTIG3325 | 1368832_f1_1 | 8943 | 23046 | 390 | 130 | | | | | |
| CONTIG3325 | 31343892_f1_2 | 8944 | 23047 | 204 | 68 | | | | | |
| CONTIG3325 | 13861555_f2_5 | 8945 | 23048 | 204 | 68 | | | | | |
| CONTIG3325 | 34173155_f2_6 | 8946 | 23049 | 336 | 112 | | | | | |
| CONTIG3326 | 23440840_f1_1 | 8947 | 23050 | 252 | 84 | | | | | |
| CONTIG3326 | 9970428_f2_2 | 8948 | 23051 | 198 | 66 | | | | | |
| CONTIG3326 | 16444452_f2_4 | 8949 | 23052 | 186 | 62 | | | | | |
| CONTIG3327 | 33502750_f1_1 | 8950 | 23053 | 984 | 328 | | | | | |
| CONTIG3328 | 23672193_f1_1 | 8951 | 23054 | 246 | 82 | | | | | |
| CONTIG3329 | 1288452_c3_5 | 8952 | 23055 | 759 | 253 | | | | | |
| CONTIG3331 | 391257_f1_1 | 8953 | 23056 | 273 | 91 | | | | | |
| CONTIG3331 | 13832790_f1_2 | 8954 | 23057 | 201 | 67 | | | | | |
| CONTIG3331 | 2033207_c3_5 | 8955 | 23058 | 192 | 64 | | | | | |
| CONTIG3331 | 6681326_c3_6 | 8956 | 23059 | 498 | 166 | | | | | |
| CONTIG3332 | 4745462_f2_2 | 8957 | 23060 | 198 | 66 | | | | | |
| CONTIG3332 | 26382942_c3_8 | 8958 | 23061 | 228 | 76 | | | | | |
| CONTIG3334 | 19645050_f3_2 | 8959 | 23062 | 210 | 70 | | | | | |
| CONTIG3334 | 24648432_c1_2 | 8960 | 23063 | 561 | 187 | | | | | |
| CONTIG3336 | 80377_c3_5 | 8961 | 23064 | 318 | 106 | | | | | |
| CONTIG3336 | 5867277_f1_1 | 8962 | 23065 | 480 | 160 | | | | | |
| CONTIG3337 | 4304650_f3_3 | 8963 | 23066 | 351 | 117 | | | | | |
| CONTIG3337 | 14250285_f2_1 | 8964 | 23067 | 1185 | 395 | | | | | |
| CONTIG3338 | 4336556_f3_2 | 8965 | 23068 | 1662 | 554 | | | | | |
| CONTIG3338 | 4094052_c1_3 | 8966 | 23069 | 264 | 88 | | | | | |
| CONTIG3338 | 9970678_c3_5 | 8967 | 23070 | 255 | 85 | | | | | |
| CONTIG3339 | 24022257_f2_2 | 8968 | 23071 | 456 | 152 | | | | | |
| CONTIG3341 | 804686_c1_3 | 8969 | 23072 | 495 | 165 | | | | | |
| CONTIG3342 | 14537901_c3_9 | 8970 | 23073 | 333 | 111 | | | | | |
| CONTIG3343 | 157790_f1_1 | 8971 | 23074 | 648 | 216 | | | | | |
| CONTIG3343 | 35322153_c1_2 | 8972 | 23075 | 207 | 69 | | | | | |
| CONTIG3344 | 25398442_f2_2 | 8973 | 23076 | 186 | 62 | | | | | |
| CONTIG3346 | 582800_c3_4 | 8974 | 23077 | 267 | 89 | | | | | |
| CONTIG3347 | 14640812_f3_5 | 8975 | 23078 | 189 | 63 | | | | | |
| CONTIG3347 | 16525262_f3_6 | 8976 | 23079 | 1269 | 423 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3350 | 23906392_f1_2 | 8977 | 23080 | 267 | 89 | | | | | |
| CONTIG3350 | 4413436_f2_4 | 8978 | 23081 | 432 | 144 | | | | | |
| CONTIG3350 | 23476002_f3_5 | 8979 | 23082 | 186 | 62 | | | | | |
| CONTIG3350 | 4172517_c1_7 | 8980 | 23083 | 192 | 64 | | | | | |
| CONTIG3350 | 39805_c3_8 | 8981 | 23084 | 186 | 62 | | | | | |
| CONTIG3351 | 24408432_c3_4 | 8982 | 23085 | 195 | 65 | | | | | |
| CONTIG3351 | 813875_c3_5 | 8983 | 23086 | 195 | 65 | | | | | |
| CONTIG3352 | 49976_c3_4 | 8984 | 23087 | 507 | 169 | | | | | |
| CONTIG3354 | 4703876_f3_5 | 8985 | 23088 | 186 | 62 | | | | | |
| CONTIG3355 | 23989186_c1_2 | 8986 | 23089 | 858 | 286 | | | | | |
| CONTIG3356 | 17311_c2_6 | 8987 | 23090 | 1743 | 581 | | | | | |
| CONTIG3357 | 6851688_c3_5 | 8988 | 23091 | 246 | 82 | | | | | |
| CONTIG3358 | 35422942_c3_4 | 8989 | 23092 | 1239 | 413 | | | | | |
| CONTIG3359 | 36621096_c3_10 | 8990 | 23093 | 1065 | 355 | | | | | |
| CONTIG3360 | 35159378_f3_4 | 8991 | 23094 | 672 | 224 | | | | | |
| CONTIG3361 | 12377337_c1_3 | 8992 | 23095 | 186 | 62 | | | | | |
| CONTIG3362 | 23469553_f3_6 | 8993 | 23096 | 618 | 206 | | | | | |
| CONTIG3362 | 19625163_c1_7 | 8994 | 23097 | 1158 | 386 | | | | | |
| CONTIG3363 | 1250_f3_8 | 8995 | 23098 | 183 | 61 | | | | | |
| CONTIG3363 | 1406282_f3_9 | 8996 | 23099 | 207 | 69 | | | | | |
| CONTIG3365 | 7062827_c1_1 | 8997 | 23100 | 282 | 94 | | | | | |
| CONTIG3365 | 24399056_c3_2 | 8998 | 23101 | 255 | 85 | | | | | |
| CONTIG3365 | 12540877_c3_4 | 8999 | 23102 | 210 | 70 | | | | | |
| CONTIG3366 | 10351064_c1_4 | 9000 | 23103 | 234 | 78 | | | | | |
| CONTIG3366 | 7226387_c3_8 | 9001 | 23104 | 195 | 65 | | | | | |
| CONTIG3367 | 23675265_f3_6 | 9002 | 23105 | 240 | 80 | | | | | |
| CONTIG3368 | 14727287_c2_4 | 9003 | 23106 | 660 | 220 | | | | | |
| CONTIG3369 | 2391916_f2_2 | 9004 | 23107 | 234 | 78 | | | | | |
| CONTIG3370 | 13065655_f3_1 | 9005 | 23108 | 210 | 70 | | | | | |
| CONTIG337 | 5265877_c3_5 | 9006 | 23109 | 192 | 64 | | | | | |
| CONTIG337 | 24782752_f3_5 | 9007 | 23110 | 219 | 73 | | | | | |
| CONTIG3370 | 250692_c3_7 | 9008 | 23111 | 186 | 62 | | | | | |
| CONTIG3372 | 812635_c1_6 | 9009 | 23112 | 195 | 65 | | | | | |
| CONTIG3372 | 2374028_c1_7 | 9010 | 23113 | 231 | 77 | | | | | |
| CONTIG3372 | 2376403_c3_9 | 9011 | 23114 | 213 | 71 | | | | | |
| CONTIG3373 | 14069386_f2_2 | 9012 | 23115 | 321 | 107 | | | | | |
| CONTIG3376 | 26765750_c2_3 | 9013 | 23116 | 345 | 115 | | | | | |
| CONTIG3376 | 4334427_c3_7 | 9014 | 23117 | 246 | 82 | | | | | |
| CONTIG3378 | 20526382_f3_2 | 9015 | 23118 | 1659 | 553 | | | | | |
| CONTIG3378 | 19570952_c1_3 | 9016 | 23119 | 291 | 97 | | | | | |
| CONTIG3379 | 19569430_f3_3 | 9017 | 23120 | 219 | 73 | | | | | |
| CONTIG338 | 6432_f2_2 | 9018 | 23121 | 363 | 121 | | | | | |
| CONTIG3380 | 187957_f2_2 | 9019 | 23122 | 192 | 64 | | | | | |
| CONTIG3382 | 25595387_c3_7 | 9020 | 23123 | 222 | 74 | | | | | |
| CONTIG3383 | 4351532_c1_3 | 9021 | 23124 | 396 | 132 | | | | | |
| CONTIG3389 | 13725137_f2_1 | 9022 | 23125 | 384 | 128 | | | | | |
| CONTIG339 | 4307625_f2_2 | 9023 | 23126 | 189 | 63 | | | | | |
| CONTIG3391 | 21676562_f1_1 | 9024 | 23127 | 249 | 83 | | | | | |
| CONTIG3391 | 36119552_f2_3 | 9025 | 23128 | 204 | 68 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3391 | 16101501_f3_4 | 9026 | 23129 | 201 | 67 | | | | | |
| CONTIG3392 | 12203126_f1_1 | 9027 | 23130 | 222 | 74 | | | | | |
| CONTIG3392 | 26445257_f3_3 | 9028 | 23131 | 1413 | 471 | | | | | |
| CONTIG3394 | 5890877_f2_3 | 9029 | 23132 | 336 | 112 | | | | | |
| CONTIG3394 | 23472552_f2_4 | 9030 | 23133 | 186 | 62 | | | | | |
| CONTIG3394 | 3177_f2_5 | 9031 | 23134 | 297 | 99 | | | | | |
| CONTIG3395 | 24316530_f3_3 | 9032 | 23135 | 231 | 77 | | | | | |
| CONTIG3395 | 2531627_c2_7 | 9033 | 23136 | 255 | 85 | | | | | |
| CONTIG3396 | 6048182_f1_1 | 9034 | 23137 | 1908 | 636 | | | | | |
| CONTIG3397 | 12931313_f1_2 | 9035 | 23138 | 498 | 166 | | | | | |
| CONTIG3398 | 23828567_f1_1 | 9036 | 23139 | 327 | 109 | | | | | |
| CONTIG3398 | 29734633_f3_3 | 9037 | 23140 | 900 | 300 | | | | | |
| CONTIG3398 | 788942_c2_5 | 9038 | 23141 | 639 | 213 | | | | | |
| CONTIG3398 | 10196877_c3_6 | 9039 | 23142 | 660 | 220 | | | | | |
| CONTIG3399 | 20049127_c1_4 | 9040 | 23143 | 336 | 112 | | | | | |
| CONTIG34 | 2236657_c1_2 | 9041 | 23144 | 522 | 174 | | | | | |
| CONTIG340 | 24417203_f1_1 | 9042 | 23145 | 240 | 80 | | | | | |
| CONTIG340 | 4789632_f2_2 | 9043 | 23146 | 186 | 62 | | | | | |
| CONTIG3400 | 33781562_c2_6 | 9044 | 23147 | 204 | 68 | | | | | |
| CONTIG3400 | 5878125_c3_9 | 9045 | 23148 | 192 | 64 | | | | | |
| CONTIG3401 | 4885913_f1_1 | 9046 | 23149 | 216 | 72 | | | | | |
| CONTIG3401 | 22343762_c2_4 | 9047 | 23150 | 186 | 62 | | | | | |
| CONTIG3402 | 21493932_f2_4 | 9048 | 23151 | 477 | 159 | | | | | |
| CONTIG3402 | 24252186_f3_2 | 9049 | 23152 | 237 | 79 | | | | | |
| CONTIG3405 | 15820262_f3_4 | 9050 | 23153 | 246 | 82 | | | | | |
| CONTIG3406 | 5116262_f3_4 | 9051 | 23154 | 192 | 64 | | | | | |
| CONTIG3406 | 25423406_c2_8 | 9052 | 23155 | 201 | 67 | | | | | |
| CONTIG3408 | 23673450_c1_7 | 9053 | 23156 | 195 | 65 | | | | | |
| CONTIG3409 | 4531507_c2_3 | 9054 | 23157 | 558 | 186 | | | | | |
| CONTIG3410 | 25547932_f1_1 | 9055 | 23158 | 324 | 108 | | | | | |
| CONTIG3410 | 24503192_f3_7 | 9056 | 23159 | 279 | 93 | | | | | |
| CONTIG3410 | 21663135_c3_13 | 9057 | 23160 | 186 | 62 | | | | | |
| CONTIG3411 | 813762_f1_1 | 9058 | 23161 | 219 | 73 | | | | | |
| CONTIG3411 | 23945132_c1_6 | 9059 | 23162 | 279 | 93 | | | | | |
| CONTIG3412 | 1385813_f2_2 | 9060 | 23163 | 264 | 88 | | | | | |
| CONTIG3414 | 23866411_f1_1 | 9061 | 23164 | 402 | 134 | | | | | |
| CONTIG3414 | 17040877_f2_2 | 9062 | 23165 | 186 | 62 | | | | | |
| CONTIG3416 | 24885965_c1_8 | 9063 | 23166 | 333 | 111 | | | | | |
| CONTIG3416 | 35718762_c2_9 | 9064 | 23167 | 201 | 67 | | | | | |
| CONTIG3417 | 21761015_f1_1 | 9065 | 23168 | 252 | 84 | | | | | |
| CONTIG3417 | 16906915_f3_2 | 9066 | 23169 | 192 | 64 | | | | | |
| CONTIG3417 | 29866292_c3_5 | 9067 | 23170 | 198 | 66 | | | | | |
| CONTIG3418 | 235265_c3_3 | 9068 | 23171 | 294 | 98 | | | | | |
| CONTIG3419 | 33252018_f2_3 | 9069 | 23172 | 189 | 63 | | | | | |
| CONTIG3419 | 4303531_f2_4 | 9070 | 23173 | 339 | 113 | | | | | |
| CONTIG3420 | 35255176_c1_3 | 9071 | 23174 | 186 | 62 | | | | | |
| CONTIG3422 | 23479566_f3_2 | 9072 | 23175 | 264 | 88 | | | | | |
| CONTIG3423 | 29736250_f1_1 | 9073 | 23176 | 222 | 74 | | | | | |
| CONTIG3423 | 5270436_c1_6 | 9074 | 23177 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3423 | 33395312_c3_8 | 9075 | 23178 | 216 | 72 | | | | | |
| CONTIG3424 | 24491061_c2_4 | 9076 | 23179 | 192 | 64 | | | | | |
| CONTIG343 | 13750317_f1_1 | 9077 | 23180 | 495 | 165 | | | | | |
| CONTIG340 | 4789632_f2_2 | 9043 | 23146 | 186 | 62 | | | | | |
| CONTIG3400 | 33781562_c2_6 | 9044 | 23147 | 204 | 68 | | | | | |
| CONTIG3400 | 5878125_c3_9 | 9045 | 23148 | 192 | 64 | | | | | |
| CONTIG3401 | 4885913_f1_1 | 9046 | 23149 | 216 | 72 | | | | | |
| CONTIG3401 | 22343762_c2_4 | 9047 | 23150 | 186 | 62 | | | | | |
| CONTIG3402 | 21493932_f2_4 | 9048 | 23151 | 477 | 159 | | | | | |
| CONTIG3404 | 24252186_f3_2 | 9049 | 23152 | 237 | 79 | | | | | |
| CONTIG3405 | 15820262_f3_4 | 9050 | 23153 | 246 | 82 | | | | | |
| CONTIG3406 | 5116262_f3_4 | 9051 | 23154 | 192 | 64 | | | | | |
| CONTIG3406 | 25423406_c2_8 | 9052 | 23155 | 201 | 67 | | | | | |
| CONTIG3408 | 23673450_c1_7 | 9053 | 23156 | 195 | 65 | | | | | |
| CONTIG3409 | 4531507_c2_3 | 9054 | 23157 | 558 | 186 | | | | | |
| CONTIG3410 | 25547932_f1_1 | 9055 | 23158 | 324 | 108 | | | | | |
| CONTIG3410 | 24503192_f3_7 | 9056 | 23159 | 279 | 93 | | | | | |
| CONTIG3410 | 21663135_c3_13 | 9057 | 23160 | 186 | 62 | | | | | |
| CONTIG3411 | 813762_f1_1 | 9058 | 23161 | 219 | 73 | | | | | |
| CONTIG3411 | 23945132_c1_6 | 9059 | 23162 | 279 | 93 | | | | | |
| CONTIG3412 | 1385813_f2_2 | 9060 | 23163 | 264 | 88 | | | | | |
| CONTIG3414 | 23866411_f1_1 | 9061 | 23164 | 402 | 134 | | | | | |
| CONTIG3414 | 17040877_f2_2 | 9062 | 23165 | 186 | 62 | | | | | |
| CONTIG3414 | 24885965_c1_8 | 9063 | 23166 | 333 | 111 | | | | | |
| CONTIG3416 | 35718762_c2_9 | 9064 | 23167 | 201 | 67 | | | | | |
| CONTIG3417 | 21761015_f1_1 | 9065 | 23168 | 252 | 84 | | | | | |
| CONTIG3417 | 16906915_f3_2 | 9066 | 23169 | 192 | 64 | | | | | |
| CONTIG3417 | 29866292_c3_5 | 9067 | 23170 | 198 | 66 | | | | | |
| CONTIG3418 | 235265_c3_3 | 9068 | 23171 | 294 | 98 | | | | | |
| CONTIG3419 | 33252018_f2_3 | 9069 | 23172 | 189 | 63 | | | | | |
| CONTIG3419 | 4303531_f2_4 | 9070 | 23173 | 339 | 113 | | | | | |
| CONTIG3420 | 35255176_c1_3 | 9071 | 23174 | 186 | 62 | | | | | |
| CONTIG3422 | 23479566_f3_2 | 9072 | 23175 | 264 | 88 | | | | | |
| CONTIG3423 | 29736250_f1_1 | 9073 | 23176 | 222 | 74 | | | | | |
| CONTIG3423 | 5270436_c1_6 | 9074 | 23177 | 189 | 63 | | | | | |
| CONTIG3423 | 33395312_c3_8 | 9075 | 23178 | 216 | 72 | | | | | |
| CONTIG3424 | 24491061_c2_4 | 9076 | 23179 | 192 | 64 | | | | | |
| CONTIG343 | 13750317_f1_1 | 9077 | 23180 | 495 | 165 | | | | | |
| CONTIG3431 | 4176678_c2_4 | 9078 | 23181 | 285 | 95 | | | | | |
| CONTIG3431 | 54775_c1_2 | 9079 | 23182 | 1170 | 390 | | | | | |
| CONTIG3431 | 4100817_c3_4 | 9080 | 23183 | 198 | 66 | | | | | |
| CONTIG3431 | 898261_c3_5 | 9081 | 23184 | 255 | 85 | | | | | |
| CONTIG3432 | 24414056_c1_10 | 9082 | 23185 | 204 | 68 | | | | | |
| CONTIG3433 | 2913930_f2_1 | 9083 | 23186 | 219 | 73 | | | | | |
| CONTIG3435 | 25469653_c3_2 | 9084 | 23187 | 1671 | 557 | | | | | |
| CONTIG3436 | 35162837_c1_5 | 9085 | 23188 | 192 | 64 | | | | | |
| CONTIG3436 | 34022717_c1_6 | 9086 | 23189 | 279 | 93 | | | | | |
| CONTIG3438 | 7057025_f2_1 | 9087 | 23190 | 561 | 187 | | | | | |
| CONTIG344 | 10196957_f3_1 | 9088 | 23191 | 321 | 107 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3440 | 14742187_c3_10 | 9089 | 23192 | 732 | 244 | | | | | |
| CONTIG3442 | 19533312_c1_4 | 9090 | 23193 | 183 | 61 | | | | | |
| CONTIG3442 | 19937876_c3_5 | 9091 | 23194 | 489 | 163 | | | | | |
| CONTIG3443 | 14878436_c3_4 | 9092 | 23195 | 309 | 103 | | | | | |
| CONTIG3444 | 12212777_f1_2 | 9093 | 23196 | 228 | 76 | | | | | |
| CONTIG3444 | 6050717_f3_5 | 9094 | 23197 | 942 | 314 | | | | | |
| CONTIG3445 | 10828550_f3_2 | 9095 | 23198 | 282 | 94 | | | | | |
| CONTIG3445 | 25993837_f1_1 | 9096 | 23199 | 336 | 112 | | | | | |
| CONTIG3447 | 3132692_f2_2 | 9097 | 23200 | 2100 | 700 | | | | | |
| CONTIG3447 | 6814078_f3_7 | 9098 | 23201 | 726 | 242 | | | | | |
| CONTIG3449 | 34464410_c3_1 | 9099 | 23202 | 333 | 111 | | | | | |
| CONTIG3450 | 24507276_c1_3 | 9100 | 23203 | 891 | 297 | | | | | |
| CONTIG3452 | 1446050_c1_5 | 9101 | 23204 | 621 | 207 | | | | | |
| CONTIG3454 | 32537662_f1_1 | 9102 | 23205 | 195 | 65 | | | | | |
| CONTIG3454 | 4882811_f2_3 | 9103 | 23206 | 255 | 85 | | | | | |
| CONTIG3454 | 19734441_c1_5 | 9104 | 23207 | 195 | 65 | | | | | |
| CONTIG3455 | 22664567_c2_5 | 9105 | 23208 | 1326 | 442 | | | | | |
| CONTIG3457 | 4095313_f2_5 | 9106 | 23209 | 528 | 176 | | | | | |
| CONTIG3457 | 14063912_c1_11 | 9107 | 23210 | 780 | 260 | | | | | |
| CONTIG3458 | 21881592_c1_8 | 9108 | 23211 | 585 | 195 | | | | | |
| CONTIG3461 | 22946885_f1_1 | 9109 | 23212 | 192 | 64 | | | | | |
| CONTIG3461 | 970327_c3_13 | 9110 | 23213 | 504 | 168 | | | | | |
| CONTIG3464 | 32664032_f2_2 | 9111 | 23214 | 189 | 63 | | | | | |
| CONTIG3464 | 23469050_f3_3 | 9112 | 23215 | 222 | 74 | | | | | |
| CONTIG3464 | 10978462_c2_7 | 9113 | 23216 | 756 | 252 | | | | | |
| CONTIG3466 | 29454825_c2_2 | 9114 | 23217 | 231 | 77 | | | | | |
| CONTIG3467 | 3438513_f3_1 | 9115 | 23218 | 219 | 73 | | | | | |
| CONTIG3467 | 1381257_c3_4 | 9116 | 23219 | 237 | 79 | | | | | |
| CONTIG3468 | 444135_c2_7 | 9117 | 23220 | 186 | 62 | | | | | |
| CONTIG3468 | 9800817_c3_8 | 9118 | 23221 | 195 | 65 | | | | | |
| CONTIG3469 | 21687825_f3_3 | 9119 | 23222 | 198 | 66 | | | | | |
| CONTIG3470 | 4895010_c2_6 | 9120 | 23223 | 330 | 110 | | | | | |
| CONTIG3471 | 22554712_f3_3 | 9121 | 23224 | 201 | 67 | | | | | |
| CONTIG3473 | 16595900_c2_4 | 9122 | 23225 | 903 | 301 | | | | | |
| CONTIG3476 | 398502_f1_2 | 9123 | 23226 | 249 | 83 | | | | | |
| CONTIG3476 | 4312510_f2_3 | 9124 | 23227 | 201 | 67 | | | | | |
| CONTIG3476 | 25425651_f2_5 | 9125 | 23228 | 891 | 297 | | | | | |
| CONTIG3476 | 16039665_c3_7 | 9126 | 23229 | 186 | 62 | | | | | |
| CONTIG3477 | 5941937_f1_1 | 9127 | 23230 | 186 | 62 | | | | | |
| CONTIG3479 | 4298302_c2_9 | 9128 | 23231 | 225 | 75 | | | | | |
| CONTIG348 | 21675977_f3_3 | 9129 | 23232 | 258 | 86 | | | | | |
| CONTIG3481 | 33398535_f2_3 | 9130 | 23233 | 234 | 78 | | | | | |
| CONTIG3481 | 5194640_c1_4 | 9131 | 23234 | 600 | 200 | | | | | |
| CONTIG3481 | 9843750_c3_6 | 9132 | 23235 | 669 | 223 | | | | | |
| CONTIG3483 | 10970305_f2_2 | 9133 | 23236 | 1149 | 383 | | | | | |
| CONTIG3484 | 16446961_f1_1 | 9134 | 23237 | 204 | 68 | | | | | |
| CONTIG3484 | 4882826_f1_2 | 9135 | 23238 | 186 | 62 | | | | | |
| CONTIG3484 | 4901577_f2_4 | 9136 | 23239 | 195 | 65 | | | | | |
| CONTIG3484 | 23953550_c1_5 | 9137 | 23240 | 201 | 67 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3484 | 26564212_c3_8 | 9138 | 23241 | 201 | 67 | | | | | |
| CONTIG3485 | 3322163_c2_3 | 9139 | 23242 | 894 | 298 | | | | | |
| CONTIG3487 | 400075_f2_2 | 9140 | 23243 | 213 | 71 | | | | | |
| CONTIG3487 | 31453450_f3_3 | 9141 | 23244 | 240 | 80 | | | | | |
| CONTIG3488 | 3989050_f2_2 | 9142 | 23245 | 183 | 61 | | | | | |
| CONTIG3488 | 1964127_c3_5 | 9143 | 23246 | 219 | 73 | | | | | |
| CONTIG3489 | 23928375_f3_3 | 9144 | 23247 | 231 | 77 | | | | | |
| CONTIG3490 | 567311_f1_2 | 9145 | 23248 | 309 | 103 | | | | | |
| CONTIG3492 | 12110777_f1_1 | 9146 | 23249 | 237 | 79 | | | | | |
| CONTIG3492 | 24709461_f3_5 | 9147 | 23250 | 396 | 132 | | | | | |
| CONTIG3492 | 1353153_c2_6 | 9148 | 23251 | 210 | 70 | | | | | |
| CONTIG3493 | 5861062_f2_1 | 9149 | 23252 | 288 | 96 | | | | | |
| CONTIG3493 | 14625252_c3_6 | 9150 | 23253 | 207 | 69 | | | | | |
| CONTIG3494 | 2454702_f1_3 | 9151 | 23254 | 213 | 71 | | | | | |
| CONTIG3494 | 29507800_f2_4 | 9152 | 23255 | 1167 | 389 | | | | | |
| CONTIG3494 | 29879715_f2_5 | 9153 | 23256 | 264 | 88 | | | | | |
| CONTIG3495 | 13941876_f1_2 | 9154 | 23257 | 660 | 220 | | | | | |
| CONTIG3495 | 5319205_f2_3 | 9155 | 23258 | 243 | 81 | | | | | |
| CONTIG3495 | 16677042_c2_6 | 9156 | 23259 | 186 | 62 | | | | | |
| CONTIG3496 | 5985880_c3_6 | 9157 | 23260 | 198 | 66 | | | | | |
| CONTIG3497 | 24901562_f3_4 | 9158 | 23261 | 189 | 63 | | | | | |
| CONTIG3497 | 9939775_f3_5 | 9159 | 23262 | 231 | 77 | | | | | |
| CONTIG3498 | 6831590_c2_10 | 9160 | 23263 | 720 | 240 | | | | | |
| CONTIG3498 | 14735908_f3_1 | 9161 | 23264 | 219 | 73 | | | | | |
| CONTIG350 | 42192_c1_9 | 9162 | 23265 | 264 | 88 | | | | | |
| CONTIG3500 | 25679637_c1_10 | 9163 | 23266 | 192 | 64 | | | | | |
| CONTIG3500 | 5080392_c3_15 | 9164 | 23267 | 216 | 72 | | | | | |
| CONTIG3501 | 1260_c2_4 | 9165 | 23268 | 267 | 89 | | | | | |
| CONTIG3501 | 26751507_c3_5 | 9166 | 23269 | 534 | 178 | | | | | |
| CONTIG3502 | 16179038_f1_1 | 9167 | 23270 | 363 | 121 | | | | | |
| CONTIG3502 | 29410688_f3_2 | 9168 | 23271 | 306 | 102 | | | | | |
| CONTIG3502 | 1564782_c2_4 | 9169 | 23272 | 255 | 85 | | | | | |
| CONTIG3502 | 20600755_c3_5 | 9170 | 23273 | 237 | 79 | | | | | |
| CONTIG3503 | 31251510_c3_6 | 9171 | 23274 | 243 | 81 | | | | | |
| CONTIG3503 | 1178175_f2_2 | 9172 | 23275 | 225 | 75 | | | | | |
| CONTIG3503 | 22281427_c2_4 | 9173 | 23276 | 1368 | 456 | | | | | |
| CONTIG3507 | 14178787_c2_4 | 9174 | 23277 | 264 | 88 | | | | | |
| CONTIG3508 | 3937925_f2_2 | 9175 | 23278 | 204 | 68 | | | | | |
| CONTIG3508 | 23907675_f2_4 | 9176 | 23279 | 195 | 65 | | | | | |
| CONTIG3508 | 9765650_c3_7 | 9177 | 23280 | 198 | 66 | | | | | |
| CONTIG3509 | 87510_f2_4 | 9178 | 23281 | 246 | 82 | | | | | |
| CONTIG3509 | 24241000_c1_6 | 9179 | 23282 | 234 | 78 | | | | | |
| CONTIG351 | 22268751_c3_2 | 9180 | 23283 | 237 | 79 | | | | | |
| CONTIG3512 | 26690933_f3_5 | 9181 | 23284 | 255 | 85 | | | | | |
| CONTIG3513 | 36503931_f3_4 | 9182 | 23285 | 360 | 120 | | | | | |
| CONTIG3513 | 23992640_f3_5 | 9183 | 23286 | 219 | 73 | | | | | |
| CONTIG3513 | 15079412_c1_6 | 9184 | 23287 | 198 | 66 | | | | | |
| CONTIG3513 | 20488843_c2_8 | 9185 | 23288 | 1260 | 420 | | | | | |
| CONTIG3514 | 33472953_f3_2 | 9186 | 23289 | | | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3516 | 29335937_f1_4 | 9187 | 23290 | 243 | 81 | | | | | |
| CONTIG3516 | 20017067_f3_5 | 9188 | 23291 | 264 | 88 | | | | | |
| CONTIG3518 | 21566262_f1_1 | 9189 | 23292 | 219 | 73 | | | | | |
| CONTIG3519 | 24015938_c3_7 | 9190 | 23293 | 198 | 66 | | | | | |
| CONTIG352 | 25578900_c3_2 | 9191 | 23294 | 369 | 123 | | | | | |
| CONTIG3520 | 12598437_c1_6 | 9192 | 23295 | 1374 | 458 | | | | | |
| CONTIG3520 | 22890637_c3_9 | 9193 | 23296 | 630 | 210 | | | | | |
| CONTIG3522 | 24609450_c3_7 | 9194 | 23297 | 1380 | 460 | | | | | |
| CONTIG3525 | 15627178_f3_6 | 9195 | 23298 | 393 | 131 | | | | | |
| CONTIG3525 | 12632277_c2_9 | 9196 | 23299 | 183 | 61 | | | | | |
| CONTIG3528 | 6290638_f2_4 | 9197 | 23300 | 198 | 66 | | | | | |
| CONTIG3529 | 9928812_f3_1 | 9198 | 23301 | 219 | 73 | | | | | |
| CONTIG3530 | 10553132_c2_5 | 9199 | 23302 | 183 | 61 | | | | | |
| CONTIG3531 | 2481807_f3_2 | 9200 | 23303 | 192 | 64 | | | | | |
| CONTIG3534 | 35336718_c2_3 | 9201 | 23304 | 210 | 70 | | | | | |
| CONTIG3536 | 16796918_f2_2 | 9202 | 23305 | 309 | 103 | | | | | |
| CONTIG3537 | 6647665_c1_3 | 9203 | 23306 | 192 | 64 | | | | | |
| CONTIG3538 | 11900015_c1_4 | 9204 | 23307 | 195 | 65 | | | | | |
| CONTIG3539 | 24225437_c1_7 | 9205 | 23308 | 201 | 67 | | | | | |
| CONTIG354 | 23475012_c2_2 | 9206 | 23309 | 372 | 124 | | | | | |
| CONTIG3540 | 3943762_f1_4 | 9207 | 23310 | 198 | 66 | | | | | |
| CONTIG3540 | 32212751_f3_6 | 9208 | 23311 | 708 | 236 | | | | | |
| CONTIG3540 | 174041_c2_8 | 9209 | 23312 | 234 | 78 | | | | | |
| CONTIG3545 | 21520255_f3_6 | 9210 | 23313 | 612 | 204 | | | | | |
| CONTIG3545 | 32319555_c3_9 | 9211 | 23314 | 195 | 65 | | | | | |
| CONTIG3546 | 24808128_f3_3 | 9212 | 23315 | 291 | 97 | | | | | |
| CONTIG3546 | 14562928_c2_8 | 9213 | 23316 | 198 | 66 | | | | | |
| CONTIG3548 | 26776681_f2_3 | 9214 | 23317 | 234 | 78 | | | | | |
| CONTIG3548 | 600702_c2_9 | 9215 | 23318 | 195 | 65 | | | | | |
| CONTIG355 | 26343950_f1_1 | 9216 | 23319 | 213 | 71 | | | | | |
| CONTIG3551 | 25580010_f1_1 | 9217 | 23320 | 237 | 79 | | | | | |
| CONTIG3551 | 23437575_c2_6 | 9218 | 23321 | 1230 | 410 | | | | | |
| CONTIG3552 | 13720930_c2_5 | 9219 | 23322 | 189 | 63 | | | | | |
| CONTIG3552 | 1417502_c3_7 | 9220 | 23323 | 225 | 75 | | | | | |
| CONTIG3553 | 29578450_f1_1 | 9221 | 23324 | 246 | 82 | | | | | |
| CONTIG3553 | 4024063_f1_3 | 9222 | 23325 | 207 | 69 | | | | | |
| CONTIG3553 | 3912681_f2_8 | 9223 | 23326 | 726 | 242 | | | | | |
| CONTIG3553 | 14845313_f3_9 | 9224 | 23327 | 249 | 83 | | | | | |
| CONTIG3553 | 584717_c1_14 | 9225 | 23328 | 186 | 62 | | | | | |
| CONTIG3553 | 30115840_c3_17 | 9226 | 23329 | 213 | 71 | | | | | |
| CONTIG3553 | 3921900_c3_18 | 9227 | 23330 | 237 | 79 | | | | | |
| CONTIG3554 | 6058466_f3_3 | 9228 | 23331 | 1014 | 338 | | | | | |
| CONTIG3554 | 31877001_c1_5 | 9229 | 23332 | 207 | 69 | | | | | |
| CONTIG3556 | 26613300_c2_3 | 9230 | 23333 | 204 | 68 | | | | | |
| CONTIG3557 | 10962801_f2_1 | 9231 | 23334 | 687 | 229 | | | | | |
| CONTIG3557 | 12617151_f2_3 | 9232 | 23335 | 216 | 72 | | | | | |
| CONTIG3558 | 5084776_f1_2 | 9233 | 23336 | 204 | 68 | | | | | |
| CONTIG3559 | 31726635_f2_2 | 9234 | 23337 | 258 | 86 | | | | | |
| CONTIG3559 | 24633428_c3_4 | 9235 | 23338 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG356 | 2849050_f3_2 | 9236 | 23339 | 282 | 94 | | | | | |
| CONTIG356 | 33707012_c3_5 | 9237 | 23340 | 225 | 75 | | | | | |
| CONTIG3561 | 21525450_f1_1 | 9238 | 23341 | 234 | 78 | | | | | |
| CONTIG3562 | 9924035_f3_3 | 9239 | 23342 | 327 | 109 | | | | | |
| CONTIG3562 | 16601702_c1_5 | 9240 | 23343 | 189 | 63 | | | | | |
| CONTIG3563 | 24422250_f1_1 | 9241 | 23344 | 201 | 67 | | | | | |
| CONTIG3563 | 1053550_f2_5 | 9242 | 23345 | 294 | 98 | | | | | |
| CONTIG3563 | 897307_f3_6 | 9243 | 23346 | 183 | 61 | | | | | |
| CONTIG3563 | 5898300_c3_11 | 9244 | 23347 | 753 | 251 | | | | | |
| CONTIG3563 | 24329181_c3_13 | 9245 | 23348 | 216 | 72 | | | | | |
| CONTIG3565 | 19564668_c1_6 | 9246 | 23349 | 519 | 173 | | | | | |
| CONTIG3565 | 24100055_c2_7 | 9247 | 23350 | 468 | 156 | | | | | |
| CONTIG3566 | 2424052_f2_5 | 9248 | 23351 | 183 | 61 | | | | | |
| CONTIG3567 | 1415955_f3_1 | 9249 | 23352 | 219 | 73 | | | | | |
| CONTIG3567 | 899086_f3_2 | 9250 | 23353 | 201 | 67 | | | | | |
| CONTIG357 | 4101013_c2_1 | 9251 | 23354 | 762 | 254 | | | | | |
| CONTIG3572 | 175327_f1_1 | 9252 | 23355 | 222 | 74 | | | | | |
| CONTIG3572 | 868885_c1_3 | 9253 | 23356 | 216 | 72 | | | | | |
| CONTIG3573 | 1225015_c2_5 | 9254 | 23357 | 195 | 65 | | | | | |
| CONTIG3574 | 30173381_f1_1 | 9255 | 23358 | 261 | 87 | | | | | |
| CONTIG3576 | 12504807_f1_1 | 9256 | 23359 | 846 | 282 | | | | | |
| CONTIG3577 | 30703432_f1_1 | 9257 | 23360 | 213 | 71 | | | | | |
| CONTIG3579 | 4781505_f1_1 | 9258 | 23361 | 216 | 72 | | | | | |
| CONTIG3579 | 805425_f2_3 | 9259 | 23362 | 201 | 67 | | | | | |
| CONTIG3581 | 25426563_c3_7 | 9260 | 23363 | 1566 | 522 | | | | | |
| CONTIG3583 | 2225827_f1_1 | 9261 | 23364 | 705 | 235 | | | | | |
| CONTIG3583 | 29969386_c1_7 | 9262 | 23365 | 303 | 101 | | | | | |
| CONTIG3584 | 22008450_f2_4 | 9263 | 23366 | 222 | 74 | | | | | |
| CONTIG3584 | 25595388_c3_9 | 9264 | 23367 | 192 | 64 | | | | | |
| CONTIG3585 | 23640913_f1_2 | 9265 | 23368 | 195 | 65 | | | | | |
| CONTIG3585 | 4062752_f2_3 | 9266 | 23369 | 204 | 68 | | | | | |
| CONTIG3585 | 24414090_f3_5 | 9267 | 23370 | 258 | 86 | | | | | |
| CONTIG3585 | 6678811_c1_7 | 9268 | 23371 | 312 | 104 | | | | | |
| CONTIG3586 | 19688805_c2_10 | 9269 | 23372 | 198 | 66 | | | | | |
| CONTIG3586 | 1378135_c3_11 | 9270 | 23373 | 183 | 61 | | | | | |
| CONTIG3587 | 20984678_f1_1 | 9271 | 23374 | 1812 | 604 | | | | | |
| CONTIG3587 | 24500290_f3_5 | 9272 | 23375 | 267 | 89 | | | | | |
| CONTIG3588 | 20320942_f3_6 | 9273 | 23376 | 222 | 74 | | | | | |
| CONTIG3589 | 23480027_f2_2 | 9274 | 23377 | 525 | 175 | | | | | |
| CONTIG3589 | 11817135_c1_4 | 9275 | 23378 | 189 | 63 | | | | | |
| CONTIG3590 | 812518_c3_5 | 9276 | 23379 | 219 | 73 | | | | | |
| CONTIG3590 | 26307752_c1_3 | 9277 | 23380 | 201 | 67 | | | | | |
| CONTIG3594 | 4766015_f3_3 | 9278 | 23381 | 249 | 83 | | | | | |
| CONTIG3594 | 10552000_c1_5 | 9279 | 23382 | 189 | 63 | | | | | |
| CONTIG3595 | 34257885_c1_7 | 9280 | 23383 | 273 | 91 | | | | | |
| CONTIG3595 | 29687500_c2_8 | 9281 | 23384 | 222 | 74 | | | | | |
| CONTIG3597 | 4335287_c2_3 | 9282 | 23385 | 336 | 112 | | | | | |
| CONTIG3598 | 24409750_f3_3 | 9283 | 23386 | 189 | 63 | | | | | |
| CONTIG3599 | 23679836_c3_4 | 9284 | 23387 | 219 | 73 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG36 | 20007635_f3_2 | 9285 | 23388 | 258 | 86 | | | | | |
| CONTIG36 | 24417183_c1_3 | 9286 | 23389 | 276 | 92 | | | | | |
| CONTIG3600 | 26209676_c1_4 | 9287 | 23390 | 285 | 95 | | | | | |
| CONTIG3600 | 23470318_c3_6 | 9288 | 23391 | 282 | 94 | | | | | |
| CONTIG3601 | 626317_f2_3 | 9289 | 23392 | 246 | 82 | | | | | |
| CONTIG3601 | 34197135_f3_5 | 9290 | 23393 | 192 | 64 | | | | | |
| CONTIG3601 | 1406937_c3_9 | 9291 | 23394 | 453 | 151 | | | | | |
| CONTIG3602 | 2347262_f3_2 | 9292 | 23395 | 258 | 86 | | | | | |
| CONTIG3602 | 21518800_c1_3 | 9293 | 23396 | 252 | 84 | | | | | |
| CONTIG3602 | 5313137_c2_4 | 9294 | 23397 | 183 | 61 | | | | | |
| CONTIG3604 | 22479755_c3_8 | 9295 | 23398 | 246 | 82 | | | | | |
| CONTIG3605 | 33359763_f2_2 | 9296 | 23399 | 267 | 89 | | | | | |
| CONTIG3606 | 5270252_f2_1 | 9297 | 23400 | 231 | 77 | | | | | |
| CONTIG3607 | 2437508_c1_3 | 9298 | 23401 | 234 | 78 | | | | | |
| CONTIG3608 | 2925875_f1_1 | 9299 | 23402 | 243 | 81 | | | | | |
| CONTIG3608 | 4020011_f1_2 | 9300 | 23403 | 309 | 103 | | | | | |
| CONTIG3609 | 4147762_c1_8 | 9301 | 23404 | 351 | 117 | | | | | |
| CONTIG3609 | 1963937_c2_8 | 9302 | 23405 | 201 | 67 | | | | | |
| CONTIG3609 | 24632907_c3_10 | 9303 | 23406 | 195 | 65 | | | | | |
| CONTIG3610 | 6289127_c1_5 | 9304 | 23407 | 270 | 90 | | | | | |
| CONTIG3612 | 25469055_f3_4 | 9305 | 23408 | 183 | 61 | | | | | |
| CONTIG3612 | 24353143_f3_6 | 9306 | 23409 | 216 | 72 | | | | | |
| CONTIG3612 | 1206930_c2_9 | 9307 | 23410 | 564 | 188 | | | | | |
| CONTIG3612 | 33993900_c3_10 | 9308 | 23411 | 444 | 148 | | | | | |
| CONTIG3613 | 35647032_f3_2 | 9309 | 23412 | 201 | 67 | | | | | |
| CONTIG3614 | 450026_f3_2 | 9310 | 23413 | 1656 | 552 | | | | | |
| CONTIG3617 | 6678751_c2_3 | 9311 | 23414 | 666 | 222 | | | | | |
| CONTIG3617 | 10166402_c2_4 | 9312 | 23415 | 207 | 69 | | | | | |
| CONTIG3618 | 20344152_c2_4 | 9313 | 23416 | 588 | 196 | | | | | |
| CONTIG3619 | 30276532_f2_3 | 9314 | 23417 | 219 | 73 | | | | | |
| CONTIG362 | 2189566_f3_1 | 9315 | 23418 | 948 | 316 | | | | | |
| CONTIG3620 | 6641913_c2_3 | 9316 | 23419 | 186 | 62 | | | | | |
| CONTIG3622 | 20734806_f3_1 | 9317 | 23420 | 546 | 182 | | | | | |
| CONTIG3622 | 32069713_c3_4 | 9318 | 23421 | 213 | 71 | | | | | |
| CONTIG3623 | 26214000_c2_7 | 9319 | 23422 | 255 | 85 | | | | | |
| CONTIG3624 | 24502175_c3_5 | 9320 | 23423 | 228 | 76 | | | | | |
| CONTIG3626 | 17049168_f3_2 | 9321 | 23424 | 531 | 177 | | | | | |
| CONTIG3628 | 6921942_c3_4 | 9322 | 23425 | 207 | 69 | | | | | |
| CONTIG3629 | 6050088_c1_4 | 9323 | 23426 | 186 | 62 | | | | | |
| CONTIG3629 | 16579130_c2_5 | 9324 | 23427 | 510 | 170 | | | | | |
| CONTIG3630 | 1203142_f1_1 | 9325 | 23428 | 183 | 61 | | | | | |
| CONTIG3630 | 25953403_c2_4 | 9326 | 23429 | 186 | 62 | | | | | |
| CONTIG3631 | 34172188_f1_1 | 9327 | 23430 | 357 | 119 | | | | | |
| CONTIG3631 | 10006902_f2_2 | 9328 | 23431 | 1038 | 346 | | | | | |
| CONTIG3634 | 6928125_f3_4 | 9329 | 23432 | 228 | 76 | | | | | |
| CONTIG3634 | 2147252_c1_8 | 9330 | 23433 | 186 | 62 | | | | | |
| CONTIG3634 | 23875277_c2_9 | 9331 | 23434 | 300 | 100 | | | | | |
| CONTIG3636 | 287561_c1_5 | 9332 | 23435 | 312 | 104 | | | | | |
| CONTIG3636 | 6837588_c1_7 | 9333 | 23436 | 570 | 190 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3638 | 10976436_f3_3 | 9334 | 23437 | 192 | 64 | | | | | |
| CONTIG3640 | 26353267_c1_7 | 9335 | 23438 | 315 | 105 | | | | | |
| CONTIG3643 | 19539838_c1_4 | 9336 | 23439 | 825 | 275 | | | | | |
| CONTIG3644 | 20395010_f2_1 | 9337 | 23440 | 225 | 75 | | | | | |
| CONTIG3644 | 10546927_f3_2 | 9338 | 23441 | 195 | 65 | | | | | |
| CONTIG3644 | 11135876_c3_4 | 9339 | 23442 | 195 | 65 | | | | | |
| CONTIG3646 | 10578180_f3_1 | 9340 | 23443 | 222 | 74 | | | | | |
| CONTIG3646 | 24744378_c3_2 | 9341 | 23444 | 474 | 158 | | | | | |
| CONTIG3647 | 11522828_f2_2 | 9342 | 23445 | 243 | 81 | | | | | |
| CONTIG3649 | 12707802_c3_8 | 9343 | 23446 | 246 | 82 | | | | | |
| CONTIG365 | 11756938_f2_1 | 9344 | 23447 | 474 | 158 | | | | | |
| CONTIG3650 | 14068967_f1_1 | 9345 | 23448 | 1335 | 445 | | | | | |
| CONTIG3650 | 14500828_c3_2 | 9346 | 23449 | 189 | 63 | | | | | |
| CONTIG3652 | 10946908_f3_1 | 9347 | 23450 | 207 | 69 | | | | | |
| CONTIG3653 | 15636287_f3_5 | 9348 | 23451 | 186 | 62 | | | | | |
| CONTIG3659 | 22445186_c2_5 | 9349 | 23452 | 234 | 78 | | | | | |
| CONTIG3660 | 4145252_c1_4 | 9350 | 23453 | 228 | 76 | | | | | |
| CONTIG3661 | 10722160_c3_6 | 9351 | 23454 | 249 | 83 | | | | | |
| CONTIG3663 | 24610763_f1_1 | 9352 | 23455 | 1269 | 423 | | | | | |
| CONTIG3666 | 24037765_c1_3 | 9353 | 23456 | 255 | 85 | | | | | |
| CONTIG3668 | 5119077_c2_7 | 9354 | 23457 | 528 | 176 | | | | | |
| CONTIG3668 | 7110066_c3_9 | 9355 | 23458 | 246 | 82 | | | | | |
| CONTIG3669 | 24423377_f3_5 | 9356 | 23459 | 183 | 61 | | | | | |
| CONTIG3671 | 29494455_f1_1 | 9357 | 23460 | 258 | 86 | | | | | |
| CONTIG3671 | 984802_f2_2 | 9358 | 23461 | 183 | 61 | | | | | |
| CONTIG3672 | 423761_f3_3 | 9359 | 23462 | 276 | 92 | | | | | |
| CONTIG3673 | 31289057_f1_3 | 9360 | 23463 | 198 | 66 | | | | | |
| CONTIG3673 | 32225926_f2_4 | 9361 | 23464 | 225 | 75 | | | | | |
| CONTIG3675 | 33850338_c2_1 | 9362 | 23465 | 1065 | 355 | | | | | |
| CONTIG3677 | 33208150_f2_1 | 9363 | 23466 | 294 | 98 | | | | | |
| CONTIG3677 | 4723278_f3_3 | 9364 | 23467 | 438 | 146 | | | | | |
| CONTIG3677 | 14316656_c2_5 | 9365 | 23468 | 189 | 63 | | | | | |
| CONTIG3677 | 10558467_c3_7 | 9366 | 23469 | 249 | 83 | | | | | |
| CONTIG3678 | 6054038_f1_1 | 9367 | 23470 | 288 | 96 | | | | | |
| CONTIG3678 | 822338_f1_2 | 9368 | 23471 | 201 | 67 | | | | | |
| CONTIG3678 | 23444677_c2_5 | 9369 | 23472 | 201 | 67 | | | | | |
| CONTIG3681 | 14079686_f1_1 | 9370 | 23473 | 249 | 83 | | | | | |
| CONTIG3682 | 209717_c3_10 | 9371 | 23474 | 186 | 62 | | | | | |
| CONTIG3683 | 24017026_f3_2 | 9372 | 23475 | 219 | 73 | | | | | |
| CONTIG3685 | 22925127_f3_3 | 9373 | 23476 | 186 | 62 | | | | | |
| CONTIG3685 | 25500312_c2_4 | 9374 | 23477 | 183 | 61 | | | | | |
| CONTIG3686 | 22031575_f1_1 | 9375 | 23478 | 906 | 302 | | | | | |
| CONTIG3688 | 23941502_f3_2 | 9376 | 23479 | 633 | 211 | | | | | |
| CONTIG3689 | 4421937_f3_3 | 9377 | 23480 | 330 | 110 | | | | | |
| CONTIG3691 | 35807755_f2_1 | 9378 | 23481 | 444 | 148 | | | | | |
| CONTIG3691 | 234576_f3_3 | 9379 | 23482 | 354 | 118 | | | | | |
| CONTIG3691 | 9850437_c1_4 | 9380 | 23483 | 1263 | 421 | | | | | |
| CONTIG3692 | 79653_c2_6 | 9381 | 23484 | 615 | 205 | | | | | |
| CONTIG3693 | 24313893_c1_3 | 9382 | 23485 | 279 | 93 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3694 | 34008436_f2_2 | 9383 | 23486 | 237 | 79 | | | | | |
| CONTIG3694 | 16839700_c3_8 | 9384 | 23487 | 834 | 278 | | | | | |
| CONTIG3695 | 10594392_f2_4 | 9385 | 23488 | 222 | 74 | | | | | |
| CONTIG3695 | 35354827_c2_7 | 9386 | 23489 | 738 | 246 | | | | | |
| CONTIG3697 | 26562530_f2_3 | 9387 | 23490 | 189 | 63 | | | | | |
| CONTIG3698 | 24064632_f3_4 | 9388 | 23491 | 261 | 87 | | | | | |
| CONTIG3701 | 93_c2_6 | 9389 | 23492 | 183 | 61 | | | | | |
| CONTIG3704 | 24470063_c2_4 | 9390 | 23493 | 561 | 187 | | | | | |
| CONTIG3705 | 5094636_f1_1 | 9391 | 23494 | 681 | 227 | | | | | |
| CONTIG3705 | 14879378_f2_3 | 9392 | 23495 | 195 | 65 | | | | | |
| CONTIG3708 | 23444752_c1_6 | 9393 | 23496 | 186 | 62 | | | | | |
| CONTIG3709 | 34174031_f2_3 | 9394 | 23497 | 213 | 71 | | | | | |
| CONTIG3710 | 19665683_c2_8 | 9395 | 23498 | 1194 | 398 | | | | | |
| CONTIG3710 | 14720327_c2_9 | 9396 | 23499 | 186 | 62 | | | | | |
| CONTIG3712 | 87561_c2_6 | 9397 | 23500 | 195 | 65 | | | | | |
| CONTIG3712 | 4328937_c2_7 | 9398 | 23501 | 738 | 246 | | | | | |
| CONTIG3714 | 9959385_f1_1 | 9399 | 23502 | 201 | 67 | | | | | |
| CONTIG3714 | 23988762_c2_4 | 9400 | 23503 | 255 | 85 | | | | | |
| CONTIG3714 | 16926001_c3_5 | 9401 | 23504 | 207 | 69 | | | | | |
| CONTIG3715 | 20082160_c3_7 | 9402 | 23505 | 240 | 80 | | | | | |
| CONTIG3716 | 259386_c3_9 | 9403 | 23506 | 390 | 130 | | | | | |
| CONTIG3717 | 5078200_c1_5 | 9404 | 23507 | 243 | 81 | | | | | |
| CONTIG3717 | 34381502_c1_7 | 9405 | 23508 | 297 | 99 | | | | | |
| CONTIG3718 | 4687575_f3_5 | 9406 | 23509 | 243 | 81 | | | | | |
| CONTIG3718 | 10660933_c1_7 | 9407 | 23510 | 327 | 109 | | | | | |
| CONTIG3720 | 22445177_c1_4 | 9408 | 23511 | 393 | 131 | | | | | |
| CONTIG3720 | 10819003_c1_5 | 9409 | 23512 | 282 | 94 | | | | | |
| CONTIG3720 | 24339051_c2_6 | 9410 | 23513 | 612 | 204 | | | | | |
| CONTIG3721 | 24414012_f1_1 | 9411 | 23514 | 279 | 93 | | | | | |
| CONTIG3723 | 5972252_f3_4 | 9412 | 23515 | 195 | 65 | | | | | |
| CONTIG3727 | 4821942_f2_3 | 9413 | 23516 | 318 | 106 | | | | | |
| CONTIG3727 | 176892_f3_5 | 9414 | 23517 | 189 | 63 | | | | | |
| CONTIG3728 | 34579626_f2_2 | 9415 | 23518 | 198 | 66 | | | | | |
| CONTIG3728 | 20390926_c1_5 | 9416 | 23519 | 249 | 83 | | | | | |
| CONTIG3728 | 22078552_c2_7 | 9417 | 23520 | 201 | 67 | | | | | |
| CONTIG3728 | 19953140_c3_10 | 9418 | 23521 | 285 | 95 | | | | | |
| CONTIG3729 | 24093840_f2_3 | 9419 | 23522 | 213 | 71 | | | | | |
| CONTIG3730 | 2910812_f1_1 | 9420 | 23523 | 216 | 72 | | | | | |
| CONTIG3730 | 13680192_f1_2 | 9421 | 23524 | 225 | 75 | | | | | |
| CONTIG3730 | 1972127_f3_7 | 9422 | 23525 | 183 | 61 | | | | | |
| CONTIG3730 | 36532887_c1_9 | 9423 | 23526 | 213 | 71 | | | | | |
| CONTIG3730 | 21928137_c2_10 | 9424 | 23527 | 207 | 69 | | | | | |
| CONTIG3731 | 9843930_f2_8 | 9425 | 23528 | 210 | 70 | | | | | |
| CONTIG3731 | 2110306_c2_15 | 9426 | 23529 | 444 | 148 | | | | | |
| CONTIG3732 | 23844008_f1_3 | 9427 | 23530 | 309 | 103 | | | | | |
| CONTIG3732 | 11723200_c1_4 | 9428 | 23531 | 207 | 69 | | | | | |
| CONTIG3735 | 2770337_f2_6 | 9429 | 23532 | 543 | 181 | | | | | |
| CONTIG3735 | 20350808_c1_11 | 9430 | 23533 | 189 | 63 | | | | | |
| CONTIG3737 | 11225691_f2_1 | 9431 | 23534 | 279 | 93 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3738 | 978425_f3_3 | 9432 | 23535 | 936 | 312 | | | | | |
| CONTIG3738 | 21881687_c3_8 | 9433 | 23536 | 186 | 62 | | | | | |
| CONTIG3739 | 240803_f1_1 | 9434 | 23537 | 456 | 152 | | | | | |
| CONTIG3740 | 870902_c3_9 | 9435 | 23538 | 216 | 72 | | | | | |
| CONTIG3741 | 4680_f3_2 | 9436 | 23539 | 198 | 66 | | | | | |
| CONTIG3744 | 11722632_f1_1 | 9437 | 23540 | 192 | 64 | | | | | |
| CONTIG3744 | 24511525_f3_3 | 9438 | 23541 | 183 | 61 | | | | | |
| CONTIG3745 | 10164025_c2_6 | 9439 | 23542 | 228 | 76 | | | | | |
| CONTIG3746 | 14273588_f3_5 | 9440 | 23543 | 183 | 61 | | | | | |
| CONTIG3746 | 24782806_f3_6 | 9441 | 23544 | 441 | 147 | | | | | |
| CONTIG3746 | 16600937_c1_7 | 9442 | 23545 | 195 | 65 | | | | | |
| CONTIG3747 | 25972187_f1_1 | 9443 | 23546 | 969 | 323 | | | | | |
| CONTIG3747 | 22368885_f2_5 | 9444 | 23547 | 465 | 155 | | | | | |
| CONTIG3747 | 35335900_f3_7 | 9445 | 23548 | 255 | 85 | | | | | |
| CONTIG3748 | 3913387_f3_4 | 9446 | 23549 | 234 | 78 | | | | | |
| CONTIG3748 | 4569427_c2_7 | 9447 | 23550 | 198 | 66 | | | | | |
| CONTIG3748 | 3906562_c2_9 | 9448 | 23551 | 213 | 71 | | | | | |
| CONTIG3750 | 11900015_f2_2 | 9449 | 23552 | 195 | 65 | | | | | |
| CONTIG3750 | 29945875_c1_5 | 9450 | 23553 | 198 | 66 | | | | | |
| CONTIG3750 | 19922010_c3_7 | 9451 | 23554 | 204 | 68 | | | | | |
| CONTIG3753 | 7038877_c1_6 | 9452 | 23555 | 189 | 63 | | | | | |
| CONTIG3753 | 13755017_c1_7 | 9453 | 23556 | 273 | 91 | | | | | |
| CONTIG3753 | 15662_c2_8 | 9454 | 23557 | 306 | 102 | | | | | |
| CONTIG3753 | 31346883_c3_11 | 9455 | 23558 | 192 | 64 | | | | | |
| CONTIG3754 | 276878_f1_1 | 9456 | 23559 | 1014 | 338 | | | | | |
| CONTIG3755 | 25406702_c2_8 | 9457 | 23560 | 192 | 64 | | | | | |
| CONTIG3755 | 25974012_c2_10 | 9458 | 23561 | 228 | 76 | | | | | |
| CONTIG3756 | 5086087_c2_6 | 9459 | 23562 | 219 | 73 | | | | | |
| CONTIG3757 | 24617213_f2_1 | 9460 | 23563 | 750 | 250 | | | | | |
| CONTIG3759 | 4098132_f3_4 | 9461 | 23564 | 1440 | 480 | | | | | |
| CONTIG3760 | 30588277_f1_1 | 9462 | 23565 | 216 | 72 | | | | | |
| CONTIG3760 | 4745287_c1_3 | 9463 | 23566 | 186 | 62 | | | | | |
| CONTIG3760 | 29486313_c1_5 | 9464 | 23567 | 204 | 68 | | | | | |
| CONTIG3760 | 14063150_c3_6 | 9465 | 23568 | 267 | 89 | | | | | |
| CONTIG3761 | 6097512_f2_2 | 9466 | 23569 | 222 | 74 | | | | | |
| CONTIG3761 | 35156256_f3_3 | 9467 | 23570 | 216 | 72 | | | | | |
| CONTIG3761 | 3017817_c2_9 | 9468 | 23571 | 222 | 74 | | | | | |
| CONTIG3761 | 12539000_c3_11 | 9469 | 23572 | 186 | 62 | | | | | |
| CONTIG3764 | 881910_f3_3 | 9470 | 23573 | 261 | 87 | | | | | |
| CONTIG3764 | 33369142_c1_5 | 9471 | 23574 | 246 | 82 | | | | | |
| CONTIG3765 | 14095443_f1_1 | 9472 | 23575 | 240 | 80 | | | | | |
| CONTIG3770 | 24615680_c3_5 | 9473 | 23576 | 204 | 68 | | | | | |
| CONTIG3771 | 22070202_f3_6 | 9474 | 23577 | 204 | 68 | | | | | |
| CONTIG3773 | 178_f1_1 | 9475 | 23578 | 189 | 63 | | | | | |
| CONTIG3773 | 12912588_f3_5 | 9476 | 23579 | 228 | 76 | | | | | |
| CONTIG3773 | 6664050_c1_6 | 9477 | 23580 | 243 | 81 | | | | | |
| CONTIG3774 | 24647250_f1_1 | 9478 | 23581 | 195 | 65 | | | | | |
| CONTIG3774 | 14455175_c3_6 | 9479 | 23582 | 216 | 72 | | | | | |
| CONTIG3777 | 23990877_f1_1 | 9480 | 23583 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3777 | 13962833_c2_5 | 9481 | 23584 | 1155 | 385 | | | | | |
| CONTIG3779 | 14176537_c2_8 | 9482 | 23585 | 246 | 82 | | | | | |
| CONTIG378 | 986038_f2_1 | 9483 | 23586 | 294 | 98 | | | | | |
| CONTIG3780 | 4306537_c2_5 | 9484 | 23587 | 531 | 177 | | | | | |
| CONTIG3782 | 235700_c1_4 | 9485 | 23588 | 732 | 244 | | | | | |
| CONTIG3783 | 2548377_c3_9 | 9486 | 23589 | 243 | 81 | | | | | |
| CONTIG3785 | 10838882_f1_1 | 9487 | 23590 | 711 | 237 | | | | | |
| CONTIG3787 | 2344382_f1_1 | 9488 | 23591 | 306 | 102 | | | | | |
| CONTIG3789 | 882937_f2_2 | 9489 | 23592 | 342 | 114 | | | | | |
| CONTIG3790 | 33782837_f2_2 | 9490 | 23593 | 261 | 87 | | | | | |
| CONTIG3791 | 30275337_f3_3 | 9491 | 23594 | 294 | 98 | | | | | |
| CONTIG3792 | 23828302_f1_1 | 9492 | 23595 | 450 | 150 | | | | | |
| CONTIG3792 | 29501590_f2_6 | 9493 | 23596 | 195 | 65 | | | | | |
| CONTIG3793 | 32428956_f3_2 | 9494 | 23597 | 1386 | 462 | | | | | |
| CONTIG3795 | 22065900_c1_4 | 9495 | 23598 | 195 | 65 | | | | | |
| CONTIG3796 | 11812626_f1_1 | 9496 | 23599 | 720 | 240 | | | | | |
| CONTIG3797 | 9770668_f3_4 | 9497 | 23600 | 1029 | 343 | | | | | |
| CONTIG3797 | 2936006_c1_5 | 9498 | 23601 | 264 | 88 | | | | | |
| CONTIG3798 | 10815812_f2_3 | 9499 | 23602 | 1068 | 356 | | | | | |
| CONTIG3799 | 176562_c1_5 | 9500 | 23603 | 246 | 82 | | | | | |
| CONTIG380 | 557885_c3_3 | 9501 | 23604 | 306 | 102 | | | | | |
| CONTIG3800 | 35367025_f1_1 | 9502 | 23605 | 204 | 68 | | | | | |
| CONTIG3802 | 2632818_c1_7 | 9503 | 23606 | 258 | 86 | | | | | |
| CONTIG3802 | 34392052_c2_11 | 9504 | 23607 | 189 | 63 | | | | | |
| CONTIG3802 | 53326_c2_12 | 9505 | 23608 | 201 | 67 | | | | | |
| CONTIG3804 | 813802_f3_3 | 9506 | 23609 | 210 | 70 | | | | | |
| CONTIG3804 | 23650702_f3_4 | 9507 | 23610 | 789 | 263 | | | | | |
| CONTIG3804 | 2560436_c3_8 | 9508 | 23611 | 225 | 75 | | | | | |
| CONTIG3805 | 785432_f3_4 | 9509 | 23612 | 258 | 86 | | | | | |
| CONTIG3806 | 2891426_f3_7 | 9510 | 23613 | 213 | 71 | | | | | |
| CONTIG3807 | 991682_c2_8 | 9511 | 23614 | 240 | 80 | | | | | |
| CONTIG3808 | 24250753_f2_2 | 9512 | 23615 | 252 | 84 | | | | | |
| CONTIG3808 | 35179626_c2_5 | 9513 | 23616 | 213 | 71 | | | | | |
| CONTIG3809 | 15109700_c3_6 | 9514 | 23617 | 291 | 97 | | | | | |
| CONTIG3809 | 24335937_f2_3 | 9515 | 23618 | 240 | 80 | | | | | |
| CONTIG3809 | 813801_f3_5 | 9516 | 23619 | 315 | 105 | | | | | |
| CONTIG3815 | 19921875_f1_1 | 9517 | 23620 | 207 | 69 | | | | | |
| CONTIG3815 | 1968753_c3_6 | 9518 | 23621 | 273 | 91 | | | | | |
| CONTIG3816 | 1179632_f3_1 | 9519 | 23622 | 222 | 74 | | | | | |
| CONTIG3816 | 861267_c1_4 | 9520 | 23623 | 222 | 74 | | | | | |
| CONTIG3817 | 197152_c3_6 | 9521 | 23624 | 297 | 99 | | | | | |
| CONTIG3819 | 14226562_f2_2 | 9522 | 23625 | 786 | 262 | | | | | |
| CONTIG382 | 22445312_f2_2 | 9523 | 23626 | 1827 | 609 | | | | | |
| CONTIG382 | 31257682_f3_1 | 9524 | 23627 | 189 | 63 | | | | | |
| CONTIG3822 | 34180438_c2_2 | 9525 | 23628 | 186 | 62 | | | | | |
| CONTIG3822 | 23859437_f2_2 | 9526 | 23629 | 189 | 63 | | | | | |
| CONTIG3822 | 1542_c2_3 | 9527 | 23630 | 216 | 72 | | | | | |
| CONTIG3823 | 665942_f1_2 | 9528 | 23631 | 198 | 66 | | | | | |
| CONTIG3823 | 4062535_f1_3 | 9529 | 23632 | 192 | 64 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3823 | 11173762_f2_4 | 9530 | 23633 | 183 | 61 | | | | | |
| CONTIG3823 | 5908406_c1_8 | 9531 | 23634 | 195 | 65 | | | | | |
| CONTIG3824 | 24298782_c1_4 | 9532 | 23635 | 186 | 62 | | | | | |
| CONTIG3824 | 11829516_c2_6 | 9533 | 23636 | 315 | 105 | | | | | |
| CONTIG3824 | 5159633_c3_9 | 9534 | 23637 | 189 | 63 | | | | | |
| CONTIG3824 | 30131937_c3_10 | 9535 | 23638 | 195 | 65 | | | | | |
| CONTIG3825 | 21516433_f3_5 | 9536 | 23639 | 573 | 191 | | | | | |
| CONTIG3828 | 31414568_f1_1 | 9537 | 23640 | 204 | 68 | | | | | |
| CONTIG3829 | 19551557_f2_2 | 9538 | 23641 | 819 | 273 | | | | | |
| CONTIG383 | 19532511_f2_2 | 9539 | 23642 | 282 | 94 | | | | | |
| CONTIG3830 | 10972936_c1_3 | 9540 | 23643 | 321 | 107 | | | | | |
| CONTIG3830 | 20322165_c3_5 | 9541 | 23644 | 369 | 123 | | | | | |
| CONTIG3832 | 157037_c2_9 | 9542 | 23645 | 210 | 70 | | | | | |
| CONTIG3833 | 23866250_f3_7 | 9543 | 23646 | 282 | 94 | | | | | |
| CONTIG3835 | 13671877_c1_3 | 9544 | 23647 | 225 | 75 | | | | | |
| CONTIG3835 | 5897083_c2_6 | 9545 | 23648 | 267 | 89 | | | | | |
| CONTIG3835 | 22265635_c3_7 | 9546 | 23649 | 231 | 77 | | | | | |
| CONTIG3836 | 13673175_f1_1 | 9547 | 23650 | 1203 | 401 | | | | | |
| CONTIG3837 | 33406575_f1_2 | 9548 | 23651 | 198 | 66 | | | | | |
| CONTIG3837 | 50_f3_4 | 9549 | 23652 | 237 | 79 | | | | | |
| CONTIG3837 | 14221875_c1_6 | 9550 | 23653 | 420 | 140 | | | | | |
| CONTIG3838 | 19695265_c1_1 | 9551 | 23654 | 189 | 63 | | | | | |
| CONTIG3839 | 4882875_f1_2 | 9552 | 23655 | 306 | 102 | | | | | |
| CONTIG3839 | 21875075_c2_6 | 9553 | 23656 | 210 | 70 | | | | | |
| CONTIG3840 | 24619177_f2_2 | 9554 | 23657 | 246 | 82 | | | | | |
| CONTIG3840 | 406302_f2_3 | 9555 | 23658 | 201 | 67 | | | | | |
| CONTIG3840 | 10980181_c2_5 | 9556 | 23659 | 231 | 77 | | | | | |
| CONTIG3842 | 34550127_f1_3 | 9557 | 23660 | 201 | 67 | | | | | |
| CONTIG3842 | 20400300_f2_5 | 9558 | 23661 | 660 | 220 | | | | | |
| CONTIG3844 | 35736025_c3_5 | 9559 | 23662 | 279 | 93 | | | | | |
| CONTIG3845 | 4102152_f1_1 | 9560 | 23663 | 192 | 64 | | | | | |
| CONTIG3845 | 20398307_f2_2 | 9561 | 23664 | 183 | 61 | | | | | |
| CONTIG3845 | 4176285_c1_3 | 9562 | 23665 | 369 | 123 | | | | | |
| CONTIG3847 | 12303188_f1_2 | 9563 | 23666 | 183 | 61 | | | | | |
| CONTIG3847 | 134677_f1_5 | 9564 | 23667 | 723 | 241 | | | | | |
| CONTIG3847 | 23445312_f3_9 | 9565 | 23668 | 195 | 65 | | | | | |
| CONTIG3847 | 19798830_c3_14 | 9566 | 23669 | 201 | 67 | | | | | |
| CONTIG3849 | 3592001_f2_2 | 9567 | 23670 | 780 | 260 | | | | | |
| CONTIG3849 | 2162818_f2_3 | 9568 | 23671 | 426 | 142 | | | | | |
| CONTIG3849 | 19569575_c2_10 | 9569 | 23672 | 192 | 64 | | | | | |
| CONTIG385 | 2498276_c1_3 | 9570 | 23673 | 225 | 75 | | | | | |
| CONTIG3851 | 489135_f2_4 | 9571 | 23674 | 231 | 77 | | | | | |
| CONTIG3851 | 22112537_f2_5 | 9572 | 23675 | 1056 | 352 | | | | | |
| CONTIG3853 | 14453155_c3_8 | 9573 | 23676 | 195 | 65 | | | | | |
| CONTIG3854 | 29930015_f2_4 | 9574 | 23677 | 195 | 65 | | | | | |
| CONTIG3854 | 14882663_c1_8 | 9575 | 23678 | 297 | 99 | | | | | |
| CONTIG3856 | 14555805_f2_2 | 9576 | 23679 | 267 | 89 | | | | | |
| CONTIG3858 | 4719637_c3_7 | 9577 | 23680 | 966 | 322 | | | | | |
| CONTIG386 | 14975680_f3_1 | 9578 | 23681 | 240 | 80 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3860 | 973375_f1_2 | 9579 | 23682 | 195 | 65 | | | | | |
| CONTIG3861 | 10757840_c2_8 | 9580 | 23683 | 252 | 84 | | | | | |
| CONTIG3862 | 24223127_f2_4 | 9581 | 23684 | 189 | 63 | | | | | |
| CONTIG3862 | 782751_c1_5 | 9582 | 23685 | 324 | 108 | | | | | |
| CONTIG3864 | 21526436_c2_7 | 9583 | 23686 | 921 | 307 | | | | | |
| CONTIG3865 | 656378_f1_1 | 9584 | 23687 | 225 | 75 | | | | | |
| CONTIG3866 | 19722787_f3_1 | 9585 | 23688 | 1626 | 542 | | | | | |
| CONTIG3866 | 34182837_c1_3 | 9586 | 23689 | 195 | 65 | | | | | |
| CONTIG3867 | 5939062_f2_2 | 9587 | 23690 | 330 | 110 | | | | | |
| CONTIG3867 | 80062_c1_4 | 9588 | 23691 | 189 | 63 | | | | | |
| CONTIG3869 | 179625_c1_2 | 9589 | 23692 | 243 | 81 | | | | | |
| CONTIG3869 | 4688161_c1_3 | 9590 | 23693 | 201 | 67 | | | | | |
| CONTIG387 | 24234775_c3_5 | 9591 | 23694 | 222 | 74 | | | | | |
| CONTIG3872 | 11805457_f2_2 | 9592 | 23695 | 303 | 101 | | | | | |
| CONTIG3872 | 23460952_c2_6 | 9593 | 23696 | 297 | 99 | | | | | |
| CONTIG3872 | 23689513_c3_7 | 9594 | 23697 | 183 | 61 | | | | | |
| CONTIG3872 | 110683_c3_8 | 9595 | 23698 | 291 | 97 | | | | | |
| CONTIG3874 | 21485967_f3_3 | 9596 | 23699 | 219 | 73 | | | | | |
| CONTIG3876 | 2548753_f1_2 | 9597 | 23700 | 213 | 71 | | | | | |
| CONTIG3876 | 835000_f1_3 | 9598 | 23701 | 198 | 66 | | | | | |
| CONTIG3876 | 11970083_f3_6 | 9599 | 23702 | 297 | 99 | | | | | |
| CONTIG3877 | 23632951_c3_9 | 9600 | 23703 | 192 | 64 | | | | | |
| CONTIG3877 | 24687555_f2_1 | 9601 | 23704 | 207 | 69 | | | | | |
| CONTIG3877 | 9801307_f2_2 | 9602 | 23705 | 291 | 97 | | | | | |
| CONTIG3877 | 4866637_f3_3 | 9603 | 23706 | 186 | 62 | | | | | |
| CONTIG3877 | 3944053_c1_5 | 9604 | 23707 | 297 | 99 | | | | | |
| CONTIG3877 | 4882700_c2_6 | 9605 | 23708 | 219 | 73 | | | | | |
| CONTIG3877 | 2913961_c3_7 | 9606 | 23709 | 192 | 64 | | | | | |
| CONTIG3879 | 5890675_f1_2 | 9607 | 23710 | 783 | 261 | | | | | |
| CONTIG3879 | 29580040_c2_3 | 9608 | 23711 | 297 | 99 | | | | | |
| CONTIG388 | 24062838_c3_3 | 9609 | 23712 | 192 | 64 | | | | | |
| CONTIG3881 | 23632336_f3_3 | 9610 | 23713 | 342 | 114 | | | | | |
| CONTIG3881 | 13851510_c2_5 | 9611 | 23714 | 228 | 76 | | | | | |
| CONTIG3882 | 25992778_f1_2 | 9612 | 23715 | 201 | 67 | | | | | |
| CONTIG3884 | 11726576_f3_7 | 9613 | 23716 | 186 | 62 | | | | | |
| CONTIG3885 | 179576_c3_4 | 9614 | 23717 | 258 | 86 | | | | | |
| CONTIG3885 | 25428261_c3_5 | 9615 | 23718 | 579 | 193 | | | | | |
| CONTIG3886 | 6729632_c2_3 | 9616 | 23719 | 273 | 91 | | | | | |
| CONTIG3887 | 19580380_f3_3 | 9617 | 23720 | 189 | 63 | | | | | |
| CONTIG3887 | 13787786_c2_4 | 9618 | 23721 | 195 | 65 | | | | | |
| CONTIG3888 | 13707187_c1_2 | 9619 | 23722 | 387 | 129 | | | | | |
| CONTIG3888 | 10352000_c1_3 | 9620 | 23723 | 774 | 258 | | | | | |
| CONTIG3888 | 6917952_c2_4 | 9621 | 23724 | 186 | 62 | | | | | |
| CONTIG389 | 24697050_f1_2 | 9622 | 23725 | 309 | 103 | | | | | |
| CONTIG3890 | 26600750_f3_3 | 9623 | 23726 | 186 | 62 | | | | | |
| CONTIG3891 | 24298452_f1_2 | 9624 | 23727 | 189 | 63 | | | | | |
| CONTIG3891 | 300_c1_7 | 9625 | 23728 | 195 | 65 | | | | | |
| CONTIG3891 | 593837_c3_13 | 9626 | 23729 | 219 | 73 | | | | | |
| CONTIG3894 | 1447182_c2_6 | 9627 | 23730 | 321 | 107 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3896 | 26380391_f1_1 | 9628 | 23731 | 234 | 78 | | | | | |
| CONTIG3896 | 4147762_c2_9 | 9629 | 23732 | 351 | 117 | | | | | |
| CONTIG3897 | 26437767_c1_2 | 9630 | 23733 | 294 | 98 | | | | | |
| CONTIG3897 | 16585912_c2_3 | 9631 | 23734 | 237 | 79 | | | | | |
| CONTIG3897 | 36330062_c3_4 | 9632 | 23735 | 198 | 66 | | | | | |
| CONTIG3898 | 29495332_c2_4 | 9633 | 23736 | 219 | 73 | | | | | |
| CONTIG3898 | 2771010_f2_3 | 9634 | 23737 | 522 | 174 | | | | | |
| CONTIG3900 | 84650_f3_4 | 9635 | 23738 | 204 | 68 | | | | | |
| CONTIG3902 | 4511502_c1_8 | 9636 | 23739 | 192 | 64 | | | | | |
| CONTIG3902 | 26600903_c2_10 | 9637 | 23740 | 201 | 67 | | | | | |
| CONTIG3903 | 35407805_c3_6 | 9638 | 23741 | 1212 | 404 | | | | | |
| CONTIG3904 | 33237767_f3_3 | 9639 | 23742 | 273 | 91 | | | | | |
| CONTIG3904 | 4101561_c2_5 | 9640 | 23743 | 258 | 86 | | | | | |
| CONTIG3905 | 804151_c3_7 | 9641 | 23744 | 420 | 140 | | | | | |
| CONTIG3907 | 605078_c2_3 | 9642 | 23745 | 195 | 65 | | | | | |
| CONTIG3908 | 14562657_f1_1 | 9643 | 23746 | 573 | 191 | | | | | |
| CONTIG3908 | 24240950_f2_2 | 9644 | 23747 | 1113 | 371 | | | | | |
| CONTIG3908 | 14507942_f3_3 | 9645 | 23748 | 216 | 72 | | | | | |
| CONTIG3908 | 6070255_f1_5 | 9646 | 23749 | 273 | 91 | | | | | |
| CONTIG3909 | 24464641_f1_1 | 9647 | 23750 | 753 | 251 | | | | | |
| CONTIG3909 | 6734752_f2_2 | 9648 | 23751 | 504 | 168 | | | | | |
| CONTIG3909 | 26255317_f2_3 | 9649 | 23752 | 594 | 198 | | | | | |
| CONTIG3909 | 4472502_f3_5 | 9650 | 23753 | 255 | 85 | | | | | |
| CONTIG3911 | 23594017_c1_4 | 9651 | 23754 | 240 | 80 | | | | | |
| CONTIG3911 | 4298828_c3_5 | 9652 | 23755 | 219 | 73 | | | | | |
| CONTIG3912 | 2931377_f1_1 | 9653 | 23756 | 183 | 61 | | | | | |
| CONTIG3912 | 19729787_f3_2 | 9654 | 23757 | 207 | 69 | | | | | |
| CONTIG3912 | 22462510_f3_3 | 9655 | 23758 | 225 | 75 | | | | | |
| CONTIG3913 | 25569552_f3_6 | 9656 | 23759 | 1137 | 379 | | | | | |
| CONTIG3917 | 3915677_c1_4 | 9657 | 23760 | 216 | 72 | | | | | |
| CONTIG3919 | 21675305_f2_1 | 9658 | 23761 | 219 | 73 | | | | | |
| CONTIG3919 | 30156300_f3_3 | 9659 | 23762 | 258 | 86 | | | | | |
| CONTIG3919 | 470300_c3_7 | 9660 | 23763 | 1116 | 372 | | | | | |
| CONTIG392 | 35194681_f1_2 | 9661 | 23764 | 219 | 73 | | | | | |
| CONTIG3922 | 24657885_f2_2 | 9662 | 23765 | 207 | 69 | | | | | |
| CONTIG3922 | 500010_f3_5 | 9663 | 23766 | 198 | 66 | | | | | |
| CONTIG3922 | 24407537_c1_6 | 9664 | 23767 | 234 | 78 | | | | | |
| CONTIG3926 | 878405_f1_1 | 9665 | 23768 | 234 | 78 | | | | | |
| CONTIG3927 | 22072340_f1_2 | 9666 | 23769 | 831 | 277 | | | | | |
| CONTIG3928 | 31757160_c2_4 | 9667 | 23770 | 219 | 73 | | | | | |
| CONTIG393 | 24395207_f3_2 | 9668 | 23771 | 189 | 63 | | | | | |
| CONTIG3932 | 6140902_f2_2 | 9669 | 23772 | 1188 | 396 | | | | | |
| CONTIG3935 | 23945430_f2_3 | 9670 | 23773 | 222 | 74 | | | | | |
| CONTIG3935 | 14566686_c2_7 | 9671 | 23774 | 201 | 67 | | | | | |
| CONTIG3936 | 32243750_f2_1 | 9672 | 23775 | 195 | 65 | | | | | |
| CONTIG3936 | 21742000_f3_3 | 9673 | 23776 | 195 | 65 | | | | | |
| CONTIG3936 | 25475652_f3_4 | 9674 | 23777 | 189 | 63 | | | | | |
| CONTIG3937 | 23535786_f3_2 | 9675 | 23778 | 252 | 84 | | | | | |
| CONTIG3937 | 6100628_c2_6 | 9676 | 23779 | 504 | 168 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3938 | 6140877_f1_2 | 9677 | 23780 | 264 | 88 | | | | | |
| CONTIG394 | 10734386_f1_2 | 9678 | 23781 | 237 | 79 | | | | | |
| CONTIG394 | 23835760_f2_3 | 9679 | 23782 | 597 | 199 | | | | | |
| CONTIG3940 | 5254758_c1_12 | 9680 | 23783 | 237 | 79 | | | | | |
| CONTIG3940 | 26366506_c1_13 | 9681 | 23784 | 549 | 183 | | | | | |
| CONTIG3940 | 24823590_c3_14 | 9682 | 23785 | 183 | 61 | | | | | |
| CONTIG3942 | 20968927_f2_3 | 9683 | 23786 | 285 | 95 | | | | | |
| CONTIG3942 | 35625000_f3_6 | 9684 | 23787 | 414 | 138 | | | | | |
| CONTIG3943 | 589160_f1_1 | 9685 | 23788 | 510 | 170 | | | | | |
| CONTIG3943 | 30507817_c2_4 | 9686 | 23789 | 204 | 68 | | | | | |
| CONTIG3944 | 23835313_f1_1 | 9687 | 23790 | 258 | 86 | | | | | |
| CONTIG3944 | 5891430_f2_2 | 9688 | 23791 | 1371 | 457 | | | | | |
| CONTIG395 | 7054577_f2_1 | 9689 | 23792 | 225 | 75 | | | | | |
| CONTIG395 | 5908507_c3_3 | 9690 | 23793 | 252 | 84 | | | | | |
| CONTIG3950 | 29511305_c2_5 | 9691 | 23794 | 240 | 80 | | | | | |
| CONTIG3951 | 2348462_f3_3 | 9692 | 23795 | 210 | 70 | | | | | |
| CONTIG3953 | 13313286_c1_5 | 9693 | 23796 | 204 | 68 | | | | | |
| CONTIG3953 | 188901_c2_6 | 9694 | 23797 | 903 | 301 | | | | | |
| CONTIG3958 | 12522787_c2_6 | 9695 | 23798 | 480 | 160 | | | | | |
| CONTIG3958 | 26835937_c1_7 | 9696 | 23799 | 264 | 88 | | | | | |
| CONTIG3959 | 10003402_c2_8 | 9697 | 23800 | 213 | 71 | | | | | |
| CONTIG3959 | 25439062_f3_1 | 9698 | 23801 | 183 | 61 | | | | | |
| CONTIG396 | 6022700_c1_3 | 9699 | 23802 | 216 | 72 | | | | | |
| CONTIG3960 | 29531587_c1_4 | 9700 | 23803 | 234 | 78 | | | | | |
| CONTIG3961 | 24006591_c3_7 | 9701 | 23804 | 282 | 94 | | | | | |
| CONTIG3962 | 9939752_f2_1 | 9702 | 23805 | 579 | 193 | | | | | |
| CONTIG3963 | 2783177_f1_2 | 9703 | 23806 | 204 | 68 | | | | | |
| CONTIG3966 | 647076_f2_1 | 9704 | 23807 | 207 | 69 | | | | | |
| CONTIG3967 | 4742012_f3_4 | 9705 | 23808 | 381 | 127 | | | | | |
| CONTIG397 | 4509400_f3_1 | 9706 | 23809 | 195 | 65 | | | | | |
| CONTIG3970 | 24401875_f3_9 | 9707 | 23810 | 468 | 156 | | | | | |
| CONTIG3971 | 21682713_f2_2 | 9708 | 23811 | 231 | 77 | | | | | |
| CONTIG3971 | 14237508_c2_3 | 9709 | 23812 | 240 | 80 | | | | | |
| CONTIG3973 | 19736712_c3_4 | 9710 | 23813 | 213 | 71 | | | | | |
| CONTIG3973 | 33625012_f3_4 | 9711 | 23814 | 240 | 80 | | | | | |
| CONTIG3975 | 16668552_c2_6 | 9712 | 23815 | 324 | 108 | | | | | |
| CONTIG3975 | 24299012_f1_1 | 9713 | 23816 | 690 | 230 | | | | | |
| CONTIG3976 | 2928202_f1_3 | 9714 | 23817 | 690 | 230 | | | | | |
| CONTIG3977 | 1969010_c3_7 | 9715 | 23818 | 225 | 75 | | | | | |
| CONTIG3978 | 24095392_f2_3 | 9716 | 23819 | 183 | 61 | | | | | |
| CONTIG3979 | 13832550_f2_4 | 9717 | 23820 | 297 | 99 | | | | | |
| CONTIG398 | 4489135_f1_2 | 9718 | 23821 | 213 | 71 | | | | | |
| CONTIG3980 | 239502_c2_2 | 9719 | 23822 | 195 | 65 | | | | | |
| CONTIG3980 | 24001932_f2_1 | 9720 | 23823 | 183 | 61 | | | | | |
| CONTIG3981 | 627002_c2_4 | 9721 | 23824 | 195 | 65 | | | | | |
| CONTIG3981 | 3268326_f1_1 | 9722 | 23825 | 699 | 233 | | | | | |
| CONTIG3981 | 25396950_f1_2 | 9723 | 23826 | 282 | 94 | | | | | |
| CONTIG3981 | 23926703_f2_4 | 9724 | 23827 | 225 | 75 | | | | | |
| CONTIG3981 | 21994032_f3_5 | 9725 | 23828 | 1650 | 550 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG3981 | 24609380_c3_14 | 9726 | 23829 | 216 | 72 | | | | | |
| CONTIG3982 | 30274037_c3_7 | 9727 | 23830 | 438 | 146 | | | | | |
| CONTIG3983 | 5892530_f2_2 | 9728 | 23831 | 195 | 65 | | | | | |
| CONTIG3983 | 33770160_c3_6 | 9729 | 23832 | 234 | 78 | | | | | |
| CONTIG3984 | 15781513_f1_1 | 9730 | 23833 | 192 | 64 | | | | | |
| CONTIG3984 | 2834561_f2_2 | 9731 | 23834 | 306 | 102 | | | | | |
| CONTIG3984 | 2117626_f2_4 | 9732 | 23835 | 222 | 74 | | | | | |
| CONTIG3984 | 9882818_c1_6 | 9733 | 23836 | 993 | 331 | | | | | |
| CONTIG3985 | 2202_f2_2 | 9734 | 23837 | 990 | 330 | | | | | |
| CONTIG3985 | 36338443_f3_4 | 9735 | 23838 | 375 | 125 | | | | | |
| CONTIG3985 | 25394712_c1_10 | 9736 | 23839 | 195 | 65 | | | | | |
| CONTIG3986 | 1953437_f1_2 | 9737 | 23840 | 189 | 63 | | | | | |
| CONTIG3986 | 24421915_f1_3 | 9738 | 23841 | 204 | 68 | | | | | |
| CONTIG3986 | 26382813_c1_8 | 9739 | 23842 | 381 | 127 | | | | | |
| CONTIG3987 | 24062510_c1_4 | 9740 | 23843 | 186 | 62 | | | | | |
| CONTIG3987 | 812637_c2_6 | 9741 | 23844 | 213 | 71 | | | | | |
| CONTIG3988 | 22386538_c1_1 | 9742 | 23845 | 183 | 61 | | | | | |
| CONTIG3988 | 859807_c1_2 | 9743 | 23846 | 183 | 61 | | | | | |
| CONTIG3989 | 29945875_f1_1 | 9744 | 23847 | 204 | 68 | | | | | |
| CONTIG3989 | 656377_c2_3 | 9745 | 23848 | 234 | 78 | | | | | |
| CONTIG399 | 787660_c1_2 | 9746 | 23849 | 228 | 76 | | | | | |
| CONTIG3990 | 21991425_f2_1 | 9747 | 23850 | 258 | 86 | | | | | |
| CONTIG3990 | 24879718_c3_7 | 9748 | 23851 | 1056 | 352 | | | | | |
| CONTIG3991 | 29487760_f1_1 | 9749 | 23852 | 201 | 67 | | | | | |
| CONTIG3991 | 4103441_c1_8 | 9750 | 23853 | 195 | 65 | | | | | |
| CONTIG3992 | 24414188_f1_1 | 9751 | 23854 | 1065 | 355 | | | | | |
| CONTIG3992 | 23553390_f3_3 | 9752 | 23855 | 240 | 80 | | | | | |
| CONTIG3993 | 4765656_c1_4 | 9753 | 23856 | 189 | 63 | | | | | |
| CONTIG3993 | 2168316 2_c2_7 | 9754 | 23857 | 237 | 79 | | | | | |
| CONTIG3994 | 4095006_c1_5 | 9755 | 23858 | 279 | 93 | | | | | |
| CONTIG3995 | 4695177_c1_9 | 9756 | 23859 | 369 | 123 | | | | | |
| CONTIG3995 | 1350337_c2_11 | 9757 | 23860 | 189 | 63 | | | | | |
| CONTIG3997 | 25898453_c1_5 | 9758 | 23861 | 474 | 158 | | | | | |
| CONTIG3999 | 21750003_c1_4 | 9759 | 23862 | 186 | 62 | | | | | |
| CONTIG3999 | 23641036_c2_5 | 9760 | 23863 | 252 | 84 | | | | | |
| CONTIG4001 | 36410906_f2_6 | 9761 | 23864 | 204 | 68 | | | | | |
| CONTIG4003 | 36524037_f2_3 | 9762 | 23865 | 252 | 84 | | | | | |
| CONTIG4005 | 29878388_f1_2 | 9763 | 23866 | 1014 | 338 | | | | | |
| CONTIG4005 | 2626952_c2_5 | 9764 | 23867 | 198 | 66 | | | | | |
| CONTIG4005 | 24255251_c2_6 | 9765 | 23868 | 243 | 81 | | | | | |
| CONTIG4005 | 20188786_c3_8 | 9766 | 23869 | 333 | 111 | | | | | |
| CONTIG4006 | 2956956 2_f2_3 | 9767 | 23870 | 255 | 85 | | | | | |
| CONTIG4006 | 33210762_c1_5 | 9768 | 23871 | 273 | 91 | | | | | |
| CONTIG4006 | 5283142_c2_6 | 9769 | 23872 | 1074 | 358 | | | | | |
| CONTIG4007 | 19730037_c3_7 | 9770 | 23873 | 258 | 86 | | | | | |
| CONTIG4008 | 25990687_c1_7 | 9771 | 23874 | 186 | 62 | | | | | |
| CONTIG4009 | 10635927_f1_1 | 9772 | 23875 | 195 | 65 | | | | | |
| CONTIG4009 | 51115 51_f2_4 | 9773 | 23876 | 240 | 80 | | | | | |
| CONTIG4009 | 4790967_c3_7 | 9774 | 23877 | 231 | 77 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4009 | 33837903_c3_9 | 9775 | 23878 | 243 | 81 | | | | | |
| CONTIG4401 | 6816555_c3_3 | 9776 | 23879 | 192 | 64 | | | | | |
| CONTIG4010 | 6817265_f3_1 | 9777 | 23880 | 1263 | 421 | | | | | |
| CONTIG4012 | 33209687_c3_3 | 9778 | 23881 | 225 | 75 | | | | | |
| CONTIG4013 | 30275688_c1_2 | 9779 | 23882 | 369 | 123 | | | | | |
| CONTIG4013 | 14537687_c3_4 | 9780 | 23883 | 204 | 68 | | | | | |
| CONTIG4016 | 23875885_f2_3 | 9781 | 23884 | 189 | 63 | | | | | |
| CONTIG4016 | 21695160_f3_6 | 9782 | 23885 | 345 | 115 | | | | | |
| CONTIG4016 | 3926552_c1_9 | 9783 | 23886 | 558 | 186 | | | | | |
| CONTIG4016 | 25556700_c2_14 | 9784 | 23887 | 261 | 87 | | | | | |
| CONTIG4016 | 192052_c3_15 | 9785 | 23888 | 282 | 94 | | | | | |
| CONTIG4017 | 33407813_f3_5 | 9786 | 23889 | 189 | 63 | | | | | |
| CONTIG402 | 10725025_c3_2 | 9787 | 23890 | 213 | 71 | | | | | |
| CONTIG402 | 6023427_f2_2 | 9788 | 23891 | 279 | 93 | | | | | |
| CONTIG4020 | 22708393_f3_3 | 9789 | 23892 | 243 | 81 | | | | | |
| CONTIG4020 | 1970450_c3_5 | 9790 | 23893 | 183 | 61 | | | | | |
| CONTIG4021 | 24410686_f3_9 | 9791 | 23894 | 243 | 81 | | | | | |
| CONTIG4022 | 15712778_f1_2 | 9792 | 23895 | 198 | 66 | | | | | |
| CONTIG4024 | 21729675_c2_5 | 9793 | 23896 | 198 | 66 | | | | | |
| CONTIG4026 | 24640937_c1_6 | 9794 | 23897 | 441 | 147 | | | | | |
| CONTIG4027 | 23569437_c1_6 | 9795 | 23898 | 198 | 66 | | | | | |
| CONTIG4029 | 26570150_c1_6 | 9796 | 23899 | 225 | 75 | | | | | |
| CONTIG403 | 23609452_f1_1 | 9797 | 23900 | 186 | 62 | | | | | |
| CONTIG403 | 12269651_f1_2 | 9798 | 23901 | 216 | 72 | | | | | |
| CONTIG403 | 24429592_c1_3 | 9799 | 23902 | 189 | 63 | | | | | |
| CONTIG4030 | 22542587_f1_1 | 9800 | 23903 | 246 | 82 | | | | | |
| CONTIG4030 | 29339678_c1_2 | 9801 | 23904 | 243 | 81 | | | | | |
| CONTIG4030 | 30109676_c1_3 | 9802 | 23905 | 204 | 68 | | | | | |
| CONTIG4032 | 3959652_c2_3 | 9803 | 23906 | 549 | 183 | | | | | |
| CONTIG4033 | 3324287_c2_4 | 9804 | 23907 | 1596 | 532 | | | | | |
| CONTIG4035 | 5960328_f2_1 | 9805 | 23908 | 240 | 80 | | | | | |
| CONTIG4037 | 20898387_c3_4 | 9806 | 23909 | 243 | 81 | | | | | |
| CONTIG4038 | 19585812_f1_1 | 9807 | 23910 | 198 | 66 | | | | | |
| CONTIG4038 | 16522807_f1_2 | 9808 | 23911 | 876 | 292 | | | | | |
| CONTIG4039 | 207762_f2_6 | 9809 | 23912 | 243 | 81 | | | | | |
| CONTIG404 | 204840_f2_2 | 9810 | 23913 | 213 | 71 | | | | | |
| CONTIG4040 | 20391950_c1_3 | 9811 | 23914 | 225 | 75 | | | | | |
| CONTIG4041 | 23479753_f1_1 | 9812 | 23915 | 240 | 80 | | | | | |
| CONTIG4041 | 4381307_f1_2 | 9813 | 23916 | 216 | 72 | | | | | |
| CONTIG4042 | 6768753_f3_3 | 9814 | 23917 | 258 | 86 | | | | | |
| CONTIG4042 | 821925_f3_4 | 9815 | 23918 | 186 | 62 | | | | | |
| CONTIG4042 | 19173313_c3_7 | 9816 | 23919 | 1317 | 439 | | | | | |
| CONTIG4043 | 13756250_f3_3 | 9817 | 23920 | 279 | 93 | | | | | |
| CONTIG4043 | 860015_c3_7 | 9818 | 23921 | 204 | 68 | | | | | |
| CONTIG4044 | 26641533_c2_4 | 9819 | 23922 | 222 | 74 | | | | | |
| CONTIG4045 | 12766918_f3_4 | 9820 | 23923 | 204 | 68 | | | | | |
| CONTIG4045 | 34258387_f3_5 | 9821 | 23924 | 222 | 74 | | | | | |
| CONTIG4045 | 24644178_c2_9 | 9822 | 23925 | 189 | 63 | | | | | |
| CONTIG4047 | 35804715_f2_4 | 9823 | 23926 | 249 | 83 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4047 | 33204068_c3_7 | 9824 | 23927 | 285 | 95 | | | | | |
| CONTIG4048 | 23444001_c3_4 | 9825 | 23928 | 198 | 66 | | | | | |
| CONTIG4053 | 24039140_f2_1 | 9826 | 23929 | 237 | 79 | | | | | |
| CONTIG4053 | 29533143_f2_3 | 9827 | 23930 | 288 | 96 | | | | | |
| CONTIG4055 | 24657687_c1_6 | 9828 | 23931 | 1515 | 505 | | | | | |
| CONTIG4056 | 30179516_c2_6 | 9829 | 23932 | 249 | 83 | | | | | |
| CONTIG4057 | 4485062_f1_1 | 9830 | 23933 | 222 | 74 | | | | | |
| CONTIG4057 | 9875292_c3_6 | 9831 | 23934 | 198 | 66 | | | | | |
| CONTIG4057 | 23475050_c3_7 | 9832 | 23935 | 1266 | 422 | | | | | |
| CONTIG4058 | 29334787_f2_1 | 9833 | 23936 | 501 | 167 | | | | | |
| CONTIG4058 | 4767503_f2_2 | 9834 | 23937 | 1473 | 491 | | | | | |
| CONTIG4058 | 30475887_f3_3 | 9835 | 23938 | 375 | 125 | | | | | |
| CONTIG4059 | 12932067_c2_3 | 9836 | 23939 | 183 | 61 | | | | | |
| CONTIG406 | 6818926_f1_1 | 9837 | 23940 | 231 | 77 | | | | | |
| CONTIG4061 | 9772143_f2_5 | 9838 | 23941 | 234 | 78 | | | | | |
| CONTIG4062 | 25876680_c1_5 | 9839 | 23942 | 204 | 68 | | | | | |
| CONTIG4062 | 20580275_c3_8 | 9840 | 23943 | 237 | 79 | | | | | |
| CONTIG4063 | 5250252_f3_4 | 9841 | 23944 | 366 | 122 | | | | | |
| CONTIG4063 | 24410887_c2_5 | 9842 | 23945 | 255 | 85 | | | | | |
| CONTIG4063 | 30751563_c3_6 | 9843 | 23946 | 216 | 72 | | | | | |
| CONTIG4066 | 204088_f2_1 | 9844 | 23947 | 246 | 82 | | | | | |
| CONTIG4067 | 20425776_f1_1 | 9845 | 23948 | 234 | 78 | | | | | |
| CONTIG4067 | 34554013_c3_7 | 9846 | 23949 | 288 | 96 | | | | | |
| CONTIG4068 | 5260903_f3_2 | 9847 | 23950 | 228 | 76 | | | | | |
| CONTIG4068 | 23939062_c2_4 | 9848 | 23951 | 231 | 77 | | | | | |
| CONTIG4069 | 16798428_f1_2 | 9849 | 23952 | 183 | 61 | | | | | |
| CONTIG4069 | 2188800_f2_3 | 9850 | 23953 | 255 | 85 | | | | | |
| CONTIG4069 | 23626536_c2_7 | 9851 | 23954 | 183 | 61 | | | | | |
| CONTIG4069 | 34573462_c2_8 | 9852 | 23955 | 273 | 91 | | | | | |
| CONTIG4072 | 4976587_c1_10 | 9853 | 23956 | 195 | 65 | | | | | |
| CONTIG4073 | 22351551_f2_1 | 9854 | 23957 | 192 | 64 | | | | | |
| CONTIG4073 | 19537512_c1_2 | 9855 | 23958 | 1269 | 423 | | | | | |
| CONTIG4075 | 970392_f1_2 | 9856 | 23959 | 228 | 76 | | | | | |
| CONTIG4075 | 12502251_c2_12 | 9857 | 23960 | 192 | 64 | | | | | |
| CONTIG4075 | 13863808_c2_13 | 9858 | 23961 | 225 | 75 | | | | | |
| CONTIG4076 | 657530_c3_6 | 9859 | 23962 | 1164 | 388 | | | | | |
| CONTIG4078 | 782965_c1_6 | 9860 | 23963 | 1335 | 445 | | | | | |
| CONTIG4078 | 6428555_c2_7 | 9861 | 23964 | 630 | 210 | | | | | |
| CONTIG4082 | 4066375_f3_3 | 9862 | 23965 | 297 | 99 | | | | | |
| CONTIG4082 | 24335963_f3_3 | 9863 | 23966 | 186 | 62 | | | | | |
| CONTIG4083 | 14257812_c1_3 | 9864 | 23967 | 318 | 106 | | | | | |
| CONTIG4085 | 14298500_f1_1 | 9865 | 23968 | 870 | 290 | | | | | |
| CONTIG4086 | 26965_f3_5 | 9866 | 23969 | 339 | 113 | | | | | |
| CONTIG4087 | 954507_f1_1 | 9867 | 23970 | 420 | 140 | | | | | |
| CONTIG4088 | 10973410_f2_5 | 9868 | 23971 | 1800 | 600 | | | | | |
| CONTIG4088 | 25675628_c1_11 | 9869 | 23972 | 195 | 65 | | | | | |
| CONTIG4089 | 14156568_c2_9 | 9870 | 23973 | 315 | 105 | | | | | |
| CONTIG4089 | 33470762_c3_13 | 9871 | 23974 | 273 | 91 | | | | | |
| CONTIG409 | 21520252_c2_2 | 9872 | 23975 | 213 | 71 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG409 | 4729638_c3_3 | 9873 | 23976 | 249 | 83 | | | | | |
| CONTIG4091 | 13866567_f3_5 | 9874 | 23977 | 396 | 132 | | | | | |
| CONTIG4092 | 14728562_f2_3 | 9875 | 23978 | 354 | 118 | | | | | |
| CONTIG4093 | 14266576_f2_2 | 9876 | 23979 | 219 | 73 | | | | | |
| CONTIG4094 | 14350035_f2_3 | 9877 | 23980 | 276 | 92 | | | | | |
| CONTIG4096 | 10972187_f3_5 | 9878 | 23981 | 423 | 141 | | | | | |
| CONTIG4096 | 24236401_c3_12 | 9879 | 23982 | 183 | 61 | | | | | |
| CONTIG4099 | 24881951_c1_5 | 9880 | 23983 | 234 | 78 | | | | | |
| CONTIG4099 | 23944552_c3_12 | 9881 | 23984 | 315 | 105 | | | | | |
| CONTIG41 | 20525007_f2_1 | 9882 | 23985 | 198 | 66 | | | | | |
| CONTIG41 | 22460953_c2_2 | 9883 | 23986 | 279 | 93 | | | | | |
| CONTIG4100 | 3937766_f3_5 | 9884 | 23987 | 198 | 66 | | | | | |
| CONTIG4100 | 34667938_c3_13 | 9885 | 23988 | 288 | 96 | | | | | |
| CONTIG4101 | 14150050_f2_4 | 9886 | 23989 | 342 | 114 | | | | | |
| CONTIG4101 | 29960200_c3_8 | 9887 | 23990 | 435 | 145 | | | | | |
| CONTIG4102 | 23443760_f2_1 | 9888 | 23991 | 297 | 99 | | | | | |
| CONTIG4103 | 35160337_f1_1 | 9889 | 23992 | 489 | 163 | | | | | |
| CONTIG4103 | 6644092_f2_3 | 9890 | 23993 | 219 | 73 | | | | | |
| CONTIG4104 | 13837762_c3_11 | 9891 | 23994 | 243 | 81 | | | | | |
| CONTIG4105 | 9801453_f1_1 | 9892 | 23995 | 186 | 62 | | | | | |
| CONTIG4105 | 4103378_c2_7 | 9893 | 23996 | 234 | 78 | | | | | |
| CONTIG4105 | 22476512_c2_8 | 9894 | 23997 | 225 | 75 | | | | | |
| CONTIG4107 | 4797155_c1_3 | 9895 | 23998 | 372 | 124 | | | | | |
| CONTIG4108 | 23926683_f2_4 | 9896 | 23999 | 246 | 82 | | | | | |
| CONTIG4108 | 26570458_f3_6 | 9897 | 24000 | 189 | 63 | | | | | |
| CONTIG4108 | 2783400_c1_8 | 9898 | 24001 | 201 | 67 | | | | | |
| CONTIG4109 | 25582682_f2_4 | 9899 | 24002 | 228 | 76 | | | | | |
| CONTIG4109 | 31532167_c1_5 | 9900 | 24003 | 243 | 81 | | | | | |
| CONTIG4112 | 4797752_c3_5 | 9901 | 24004 | 186 | 62 | | | | | |
| CONTIG4115 | 4460135_f3_2 | 9902 | 24005 | 183 | 61 | | | | | |
| CONTIG4116 | 24413883_f2_1 | 9903 | 24006 | 378 | 126 | | | | | |
| CONTIG4118 | 25661042_c1_8 | 9904 | 24007 | 1431 | 477 | | | | | |
| CONTIG4119 | 23941927_f3_1 | 9905 | 24008 | 720 | 240 | | | | | |
| CONTIG4119 | 16500_c1_2 | 9906 | 24009 | 237 | 79 | | | | | |
| CONTIG412 | 25672215_c3_5 | 9907 | 24010 | 186 | 62 | | | | | |
| CONTIG412 | 585002_f3_1 | 9908 | 24011 | 321 | 107 | | | | | |
| CONTIG4120 | 4890693_f2_3 | 9909 | 24012 | 240 | 80 | | | | | |
| CONTIG4120 | 5898400_f3_4 | 9910 | 24013 | 525 | 175 | | | | | |
| CONTIG4121 | 4335312_f1_1 | 9911 | 24014 | 189 | 63 | | | | | |
| CONTIG4121 | 26203388_f1_2 | 9912 | 24015 | 927 | 309 | | | | | |
| CONTIG4121 | 176538_f3_4 | 9913 | 24016 | 204 | 68 | | | | | |
| CONTIG4123 | 23859437_f1_1 | 9914 | 24017 | 186 | 62 | | | | | |
| CONTIG4123 | 2402078_f3_3 | 9915 | 24018 | 183 | 61 | | | | | |
| CONTIG4123 | 4179708_f3_4 | 9916 | 24019 | 183 | 61 | | | | | |
| CONTIG4124 | 26350931_f2_3 | 9917 | 24020 | 411 | 137 | | | | | |
| CONTIG4125 | 30157938_f2_5 | 9918 | 24021 | 192 | 64 | | | | | |
| CONTIG4126 | 22460012_c2_7 | 9919 | 24022 | 396 | 132 | | | | | |
| CONTIG4127 | 22270931_f2_2 | 9920 | 24023 | 576 | 192 | | | | | |
| CONTIG4127 | 135906_c3_6 | 9921 | 24024 | 288 | 96 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4128 | 978575_f2_2 | 9922 | 24025 | 783 | 261 | | | | | |
| CONTIG4128 | 187507_c1_7 | 9923 | 24026 | 255 | 85 | | | | | |
| CONTIG4128 | 25438431_c3_8 | 9924 | 24027 | 456 | 152 | | | | | |
| CONTIG4130 | 31367137_f1_3 | 9925 | 24028 | 183 | 61 | | | | | |
| CONTIG4131 | 12610660_c2_9 | 9926 | 24029 | 183 | 61 | | | | | |
| CONTIG4133 | 3917078_f1_2 | 9927 | 24030 | 204 | 68 | | | | | |
| CONTIG4133 | 1954385_f1_3 | 9928 | 24031 | 246 | 82 | | | | | |
| CONTIG4133 | 20317067_f2_4 | 9929 | 24032 | 195 | 65 | | | | | |
| CONTIG4133 | 35647042_c2_6 | 9930 | 24033 | 189 | 63 | | | | | |
| CONTIG4134 | 14063127_f2_1 | 9931 | 24034 | 933 | 311 | | | | | |
| CONTIG4134 | 175011_f3_4 | 9932 | 24035 | 762 | 254 | | | | | |
| CONTIG4134 | 6697302_c2_6 | 9933 | 24036 | 234 | 78 | | | | | |
| CONTIG4135 | 30573550_f1_3 | 9934 | 24037 | 183 | 61 | | | | | |
| CONTIG4135 | 22268763_c1_5 | 9935 | 24038 | 312 | 104 | | | | | |
| CONTIG4135 | 10945277_c1_6 | 9936 | 24039 | 213 | 71 | | | | | |
| CONTIG4135 | 4150912_c1_7 | 9937 | 24040 | 249 | 83 | | | | | |
| CONTIG4139 | 10019187_c2_10 | 9938 | 24041 | 1143 | 381 | | | | | |
| CONTIG4140 | 14860306_c1_5 | 9939 | 24042 | 348 | 116 | | | | | |
| CONTIG4142 | 34173513_c3_4 | 9940 | 24043 | 705 | 235 | | | | | |
| CONTIG4145 | 97008 7_f1_1 | 9941 | 24044 | 291 | 97 | | | | | |
| CONTIG4145 | 502290_f2_2 | 9942 | 24045 | 603 | 201 | | | | | |
| CONTIG4145 | 15641627_c3_8 | 9943 | 24046 | 240 | 80 | | | | | |
| CONTIG4146 | 24411052_c2_8 | 9944 | 24047 | 573 | 191 | | | | | |
| CONTIG4146 | 33439635_c3_9 | 9945 | 24048 | 189 | 63 | | | | | |
| CONTIG4147 | 2937750_c3_7 | 9946 | 24049 | 528 | 176 | | | | | |
| CONTIG4148 | 14647177_f1_1 | 9947 | 24050 | 189 | 63 | | | | | |
| CONTIG4148 | 197655_f3_3 | 9948 | 24051 | 276 | 92 | | | | | |
| CONTIG415 | 4898411_c3_6 | 9949 | 24052 | 273 | 91 | | | | | |
| CONTIG4150 | 10423577_f2_4 | 9950 | 24053 | 189 | 63 | | | | | |
| CONTIG4150 | 910905_c1_12 | 9951 | 24054 | 339 | 113 | | | | | |
| CONTIG4151 | 22298177_f1_1 | 9952 | 24055 | 204 | 68 | | | | | |
| CONTIG4151 | 36620465_c1_5 | 9953 | 24056 | 207 | 69 | | | | | |
| CONTIG4152 | 16531300_f2_4 | 9954 | 24057 | 306 | 102 | | | | | |
| CONTIG4152 | 25392127_f2_5 | 9955 | 24058 | 240 | 80 | | | | | |
| CONTIG4153 | 24250017_f3_2 | 9956 | 24059 | 1317 | 439 | | | | | |
| CONTIG4154 | 23553887_c1_5 | 9957 | 24060 | 282 | 94 | | | | | |
| CONTIG4155 | 4806883_f2_1 | 9958 | 24061 | 240 | 80 | | | | | |
| CONTIG4155 | 43183333_c3_4 | 9959 | 24062 | 192 | 64 | | | | | |
| CONTIG4157 | 1135787_f1_1 | 9960 | 24063 | 684 | 228 | | | | | |
| CONTIG4158 | 35235325_c3_6 | 9961 | 24064 | 183 | 61 | | | | | |
| CONTIG416 | 25515912_f2_2 | 9962 | 24065 | 225 | 75 | | | | | |
| CONTIG4160 | 3261 0817_f1_1 | 9963 | 24066 | 726 | 242 | | | | | |
| CONTIG4161 | 4723300_f2_2 | 9964 | 24067 | 672 | 224 | | | | | |
| CONTIG4161 | 2125012_f1_5 | 9965 | 24068 | 213 | 71 | | | | | |
| CONTIG4162 | 30714465_f3_9 | 9966 | 24069 | 210 | 70 | | | | | |
| CONTIG4162 | 14459637_c1_9 | 9967 | 24070 | 582 | 194 | | | | | |
| CONTIG4162 | 4882275_c2_11 | 9968 | 24071 | 672 | 224 | | | | | |
| CONTIG4162 | 34182826_c3_13 | 9969 | 24072 | 576 | 192 | | | | | |
| CONTIG4163 | 23634705_c2_5 | 9970 | 24073 | 234 | 78 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4164 | 25503431_f1_1 | 9971 | 24074 | 927 | 309 | | | | | |
| CONTIG4164 | 11910662_c3_9 | 9972 | 24075 | 384 | 128 | | | | | |
| CONTIG4165 | 20413450_f2_1 | 9973 | 24076 | 282 | 94 | | | | | |
| CONTIG4165 | 12985688_c1_5 | 9974 | 24077 | 183 | 61 | | | | | |
| CONTIG4166 | 4064013_c1_6 | 9975 | 24078 | 969 | 323 | | | | | |
| CONTIG4166 | 2063331_f1_1 | 9976 | 24079 | 186 | 62 | | | | | |
| CONTIG4166 | 24642181_f2_2 | 9977 | 24080 | 489 | 163 | | | | | |
| CONTIG4166 | 14191876_f2_3 | 9978 | 24081 | 372 | 124 | | | | | |
| CONTIG4166 | 10743800_f3_4 | 9979 | 24082 | 603 | 201 | | | | | |
| CONTIG4167 | 3390675_c2_8 | 9980 | 24083 | 189 | 63 | | | | | |
| CONTIG4167 | 26443753_f2_4 | 9981 | 24084 | 294 | 98 | | | | | |
| CONTIG4167 | 2234556_f3_6 | 9982 | 24085 | 231 | 77 | | | | | |
| CONTIG4168 | 36117062_f2_2 | 9983 | 24086 | 228 | 76 | | | | | |
| CONTIG4168 | 1211562_c2_5 | 9984 | 24087 | 711 | 237 | | | | | |
| CONTIG4170 | 798583_f3_2 | 9985 | 24088 | 1437 | 479 | | | | | |
| CONTIG4171 | 22851686_f2_1 | 9986 | 24089 | 279 | 93 | | | | | |
| CONTIG4171 | 9964802_f3_4 | 9987 | 24090 | 216 | 72 | | | | | |
| CONTIG4171 | 10743825_c1_6 | 9988 | 24091 | 228 | 76 | | | | | |
| CONTIG4173 | 24412912_c1_8 | 9989 | 24092 | 318 | 106 | | | | | |
| CONTIG4174 | 6063552_f3_7 | 9990 | 24093 | 201 | 67 | | | | | |
| CONTIG4174 | 26822574_c1_6 | 9991 | 24094 | 282 | 94 | | | | | |
| CONTIG4175 | 34063915_c3_6 | 9992 | 24095 | 432 | 144 | | | | | |
| CONTIG4175 | 34551687_c3_7 | 9993 | 24096 | 390 | 130 | | | | | |
| CONTIG4176 | 25582518_f2_2 | 9994 | 24097 | 195 | 65 | | | | | |
| CONTIG4179 | 14962631_c1_4 | 9995 | 24098 | 225 | 75 | | | | | |
| CONTIG418 | 10045286_f3_2 | 9996 | 24099 | 201 | 67 | | | | | |
| CONTIG418 | 600142_c3_3 | 9997 | 24100 | 534 | 178 | | | | | |
| CONTIG4180 | 9767660_c1_6 | 9998 | 24101 | 243 | 81 | | | | | |
| CONTIG4180 | 14064750_c1_7 | 9999 | 24102 | 294 | 98 | | | | | |
| CONTIG4181 | 5103203_c2_6 | 10000 | 24103 | 186 | 62 | | | | | |
| CONTIG4185 | 22870642_f1_3 | 10001 | 24104 | 210 | 70 | | | | | |
| CONTIG4185 | 26619155_f3_5 | 10002 | 24105 | 195 | 65 | | | | | |
| CONTIG4185 | 35159468_c1_6 | 10003 | 24106 | 204 | 68 | | | | | |
| CONTIG4186 | 26460817_f3_1 | 10004 | 24107 | 918 | 306 | | | | | |
| CONTIG4186 | 6049205_c3_4 | 10005 | 24108 | 192 | 64 | | | | | |
| CONTIG4191 | 14319703_c2_6 | 10006 | 24109 | 258 | 86 | | | | | |
| CONTIG4192 | 14532180_f3_1 | 10007 | 24110 | 663 | 221 | | | | | |
| CONTIG4192 | 23910900_c1_2 | 10008 | 24111 | 744 | 248 | | | | | |
| CONTIG4192 | 23448375_c3_3 | 10009 | 24112 | 462 | 154 | | | | | |
| CONTIG4193 | 5870300_f1_4 | 10010 | 24113 | 189 | 63 | | | | | |
| CONTIG4193 | 24644627_c3_10 | 10011 | 24114 | 228 | 76 | | | | | |
| CONTIG4193 | 33786302_c3_11 | 10012 | 24115 | 441 | 147 | | | | | |
| CONTIG4194 | 21534011_f3_4 | 10013 | 24116 | 258 | 86 | | | | | |
| CONTIG4194 | 28219636_c1_5 | 10014 | 24117 | 1275 | 425 | | | | | |
| CONTIG4195 | 34409803_c2_5 | 10015 | 24118 | 246 | 82 | | | | | |
| CONTIG4196 | 22069655_c1_4 | 10016 | 24119 | 207 | 69 | | | | | |
| CONTIG4197 | 24484375_c2_6 | 10017 | 24120 | 1302 | 434 | | | | | |
| CONTIG4198 | 4705336_c3_8 | 10018 | 24121 | 183 | 61 | | | | | |
| CONTIG420 | 33782212_f1_1 | 10019 | 24122 | 585 | 195 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG420 | 1178913_c3_5 | 10020 | 24123 | 450 | 150 | | | | | |
| CONTIG4200 | 36132162_c3_8 | 10021 | 24124 | 735 | 245 | | | | | |
| CONTIG4202 | 14882625_f3_5 | 10022 | 24125 | 1296 | 432 | | | | | |
| CONTIG4202 | 11879125_c2_8 | 10023 | 24126 | 285 | 95 | | | | | |
| CONTIG4202 | 5100260_c3_11 | 10024 | 24127 | 201 | 67 | | | | | |
| CONTIG4203 | 2929568_f3_3 | 10025 | 24128 | 195 | 65 | | | | | |
| CONTIG4204 | 35729666_f1_1 | 10026 | 24129 | 210 | 70 | | | | | |
| CONTIG4204 | 23479650_c1_3 | 10027 | 24130 | 228 | 76 | | | | | |
| CONTIG4205 | 16898513_c1_3 | 10028 | 24131 | 366 | 122 | | | | | |
| CONTIG4206 | 46900_f1_1 | 10029 | 24132 | 240 | 80 | | | | | |
| CONTIG4208 | 24798380_c2_9 | 10030 | 24133 | 270 | 90 | | | | | |
| CONTIG4208 | 23484437_c3_10 | 10031 | 24134 | 204 | 68 | | | | | |
| CONTIG4209 | 31329512_c3_6 | 10032 | 24135 | 696 | 232 | | | | | |
| CONTIG421 | 23634390_c2_5 | 10033 | 24136 | 333 | 111 | | | | | |
| CONTIG4210 | 21603427_f2_3 | 10034 | 24137 | 246 | 82 | | | | | |
| CONTIG4210 | 24612557_c3_10 | 10035 | 24138 | 774 | 258 | | | | | |
| CONTIG4211 | 20110306_c2_2 | 10036 | 24139 | 927 | 309 | | | | | |
| CONTIG4212 | 11023327_f2_1 | 10037 | 24140 | 2151 | 717 | | | | | |
| CONTIG4213 | 32221927_f1_1 | 10038 | 24141 | 1281 | 427 | | | | | |
| CONTIG4213 | 1056557_f1_2 | 10039 | 24142 | 531 | 177 | | | | | |
| CONTIG4214 | 24807927_f1_3 | 10040 | 24143 | 267 | 89 | | | | | |
| CONTIG4216 | 14245938_f2_3 | 10041 | 24144 | 276 | 92 | | | | | |
| CONTIG4217 | 20365825_f1_1 | 10042 | 24145 | 222 | 74 | | | | | |
| CONTIG4217 | 29502175_c1_4 | 10043 | 24146 | 240 | 80 | | | | | |
| CONTIG4217 | 14237508_c1_5 | 10044 | 24147 | 279 | 93 | | | | | |
| CONTIG4219 | 819086_c1_2 | 10045 | 24148 | 795 | 265 | | | | | |
| CONTIG4219 | 20347152_c3_3 | 10046 | 24149 | 1167 | 389 | | | | | |
| CONTIG422 | 25572075_c3_4 | 10047 | 24150 | 558 | 186 | | | | | |
| CONTIG4220 | 390927_f3_1 | 10048 | 24151 | 225 | 75 | | | | | |
| CONTIG4222 | 4719767_f2_6 | 10049 | 24152 | 201 | 67 | | | | | |
| CONTIG4222 | 24844202_c2_12 | 10050 | 24153 | 240 | 80 | | | | | |
| CONTIG4223 | 2050012_f1_1 | 10051 | 24154 | 189 | 63 | | | | | |
| CONTIG4223 | 21531550_f1_2 | 10052 | 24155 | 198 | 66 | | | | | |
| CONTIG4225 | 6640925_f2_1 | 10053 | 24156 | 249 | 83 | | | | | |
| CONTIG4225 | 31304507_f3_2 | 10054 | 24157 | 936 | 312 | | | | | |
| CONTIG4225 | 25396931_c2_4 | 10055 | 24158 | 189 | 63 | | | | | |
| CONTIG4225 | 23984625_c3_5 | 10056 | 24159 | 477 | 159 | | | | | |
| CONTIG4226 | 2948438_f1_1 | 10057 | 24160 | 195 | 65 | | | | | |
| CONTIG4226 | 2537553_f3_3 | 10058 | 24161 | 312 | 104 | | | | | |
| CONTIG4227 | 25391316_c2_7 | 10059 | 24162 | 222 | 74 | | | | | |
| CONTIG4228 | 34610255_f3_6 | 10060 | 24163 | 807 | 269 | | | | | |
| CONTIG4228 | 30111343_c1_7 | 10061 | 24164 | 207 | 69 | | | | | |
| CONTIG4229 | 4710761_f2_1 | 10062 | 24165 | 462 | 154 | | | | | |
| CONTIG423 | 23679677_f2_1 | 10063 | 24166 | 201 | 67 | | | | | |
| CONTIG423 | 22297187_c3_2 | 10064 | 24167 | 216 | 72 | | | | | |
| CONTIG4230 | 3944692_f1_1 | 10065 | 24168 | 576 | 192 | | | | | |
| CONTIG4232 | 4721408_f2_4 | 10066 | 24169 | 210 | 70 | | | | | |
| CONTIG4232 | 23867002_c1_2 | 10067 | 24170 | 186 | 62 | | | | | |
| CONTIG4233 | | 10068 | 24171 | 828 | 276 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4233 | 10554750_c3_6 | 10069 | 24172 | 213 | 71 | | | | | |
| CONTIG4235 | 867775_f3_5 | 10070 | 24173 | 207 | 69 | | | | | |
| CONTIG4235 | 24020285_c3_7 | 10071 | 24174 | 240 | 80 | | | | | |
| CONTIG4236 | 47137_c2_5 | 10072 | 24175 | 1452 | 484 | | | | | |
| CONTIG4237 | 24398505_c1_4 | 10073 | 24176 | 213 | 71 | | | | | |
| CONTIG4237 | 11204691_c1_6 | 10074 | 24177 | 246 | 82 | | | | | |
| CONTIG4239 | 13085917_f3_3 | 10075 | 24178 | 210 | 70 | | | | | |
| CONTIG4239 | 15819062_c2_4 | 10076 | 24179 | 186 | 62 | | | | | |
| CONTIG4240 | 12772677_c3_5 | 10077 | 24180 | 240 | 80 | | | | | |
| CONTIG4240 | 33595882_c3_3 | 10078 | 24181 | 195 | 65 | | | | | |
| CONTIG4241 | 4101075_c2_7 | 10079 | 24182 | 183 | 61 | | | | | |
| CONTIG4241 | 34581257_c2_9 | 10080 | 24183 | 186 | 62 | | | | | |
| CONTIG4242 | 26367212_c3_11 | 10081 | 24184 | 204 | 68 | | | | | |
| CONTIG4242 | 5469035_f1_2 | 10082 | 24185 | 180 | 60 | | | | | |
| CONTIG4242 | 11963542_f3_4 | 10083 | 24186 | 315 | 105 | | | | | |
| CONTIG4242 | 33241625_f3_5 | 10084 | 24187 | 210 | 70 | | | | | |
| CONTIG4243 | 988252_c1_4 | 10085 | 24188 | 216 | 72 | | | | | |
| CONTIG4244 | 21991530_f1_1 | 10086 | 24189 | 402 | 134 | | | | | |
| CONTIG4244 | 24798193_f2_2 | 10087 | 24190 | 213 | 71 | | | | | |
| CONTIG4244 | 13866682_f3_4 | 10088 | 24191 | 216 | 72 | | | | | |
| CONTIG4244 | 25564812_c1_7 | 10089 | 24192 | 246 | 82 | | | | | |
| CONTIG4244 | 14459525_c3_13 | 10090 | 24193 | 183 | 61 | | | | | |
| CONTIG4245 | 26672055_f2_4 | 10091 | 24194 | 189 | 63 | | | | | |
| CONTIG4245 | 26448468_c2_13 | 10092 | 24195 | 225 | 75 | | | | | |
| CONTIG4246 | 26380312_c3_7 | 10093 | 24196 | 288 | 96 | | | | | |
| CONTIG4247 | 6369081_f3_2 | 10094 | 24197 | 267 | 89 | | | | | |
| CONTIG4247 | 469375_c3_6 | 10095 | 24198 | 237 | 79 | | | | | |
| CONTIG4248 | 5891561_f3_3 | 10096 | 24199 | 1605 | 535 | | | | | |
| CONTIG4248 | 36133277_c2_4 | 10097 | 24200 | 411 | 137 | | | | | |
| CONTIG4248 | 4067592_c2_5 | 10098 | 24201 | 216 | 72 | | | | | |
| CONTIG4249 | 4742076_f2_4 | 10099 | 24202 | 312 | 104 | | | | | |
| CONTIG4249 | 26595305_f2_5 | 10100 | 24203 | 729 | 243 | | | | | |
| CONTIG4250 | 32562_f1_1 | 10101 | 24204 | 363 | 121 | | | | | |
| CONTIG4253 | 25391017_f3_4 | 10102 | 24205 | 987 | 329 | | | | | |
| CONTIG4254 | 1351436_f1_1 | 10103 | 24206 | 237 | 79 | | | | | |
| CONTIG4254 | 822638_f2_2 | 10104 | 24207 | 207 | 69 | | | | | |
| CONTIG4254 | 14745312_f2_3 | 10105 | 24208 | 258 | 86 | | | | | |
| CONTIG4255 | 22042150_f1_1 | 10106 | 24209 | 297 | 99 | | | | | |
| CONTIG4255 | 30133385_f1_3 | 10107 | 24210 | 363 | 121 | | | | | |
| CONTIG4256 | 21484431_c1_4 | 10108 | 24211 | 258 | 86 | | | | | |
| CONTIG4256 | 4071015_c2_8 | 10109 | 24212 | 195 | 65 | | | | | |
| CONTIG4258 | 23959763_f3_1 | 10110 | 24213 | 273 | 91 | | | | | |
| CONTIG4258 | 16835825_c2_5 | 10111 | 24214 | 345 | 115 | | | | | |
| CONTIG4259 | 25674157_f1_1 | 10112 | 24215 | 225 | 75 | | | | | |
| CONTIG4259 | 19798126_f2_3 | 10113 | 24216 | 351 | 117 | | | | | |
| CONTIG4259 | 839068_f3_4 | 10114 | 24217 | 1851 | 617 | | | | | |
| CONTIG4259 | 25469805_c3_7 | 10115 | 24218 | 222 | 74 | | | | | |
| CONTIG4259 | 22462936_c3_13 | 10116 | 24219 | 216 | 72 | | | | | |
| CONTIG426 | 9819500_f1_1 | 10117 | 24220 | 222 | 74 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4262 | 33254501_f1_1 | 10118 | 24221 | 183 | 61 | | | | | |
| CONTIG4263 | 969062_f1_2 | 10119 | 24222 | 282 | 94 | | | | | |
| CONTIG4263 | 31735425_f2_3 | 10120 | 24223 | 198 | 66 | | | | | |
| CONTIG4263 | 12376293_c1_5 | 10121 | 24224 | 216 | 72 | | | | | |
| CONTIG4263 | 162590_c1_7 | 10122 | 24225 | 186 | 62 | | | | | |
| CONTIG4264 | 35235005_f1_1 | 10123 | 24226 | 294 | 98 | | | | | |
| CONTIG4266 | 36110812_f1_1 | 10124 | 24227 | 186 | 62 | | | | | |
| CONTIG4266 | 36074156_c2_5 | 10125 | 24228 | 231 | 77 | | | | | |
| CONTIG4268 | 22078517_c2_9 | 10126 | 24229 | 201 | 67 | | | | | |
| CONTIG4269 | 25664001_c1_2 | 10127 | 24230 | 219 | 73 | | | | | |
| CONTIG427 | 423261_f2_1 | 10128 | 24231 | 378 | 126 | | | | | |
| CONTIG427 | 24300006_c2_3 | 10129 | 24232 | 243 | 81 | | | | | |
| CONTIG4271 | 401655_f3_5 | 10130 | 24233 | 195 | 65 | | | | | |
| CONTIG4271 | 35188825_c2_6 | 10131 | 24234 | 195 | 65 | | | | | |
| CONTIG4272 | 32063462_c1_4 | 10132 | 24235 | 726 | 242 | | | | | |
| CONTIG4273 | 32531558_c1_8 | 10133 | 24236 | 828 | 276 | | | | | |
| CONTIG4273 | 9765628_c3_11 | 10134 | 24237 | 1017 | 339 | | | | | |
| CONTIG4274 | 23537831_c2_9 | 10135 | 24238 | 192 | 64 | | | | | |
| CONTIG4275 | 13859626_c1_6 | 10136 | 24239 | 1182 | 394 | | | | | |
| CONTIG4275 | 6250305_c3_8 | 10137 | 24240 | 225 | 75 | | | | | |
| CONTIG4278 | 1368877_f2_3 | 10138 | 24241 | 192 | 64 | | | | | |
| CONTIG4278 | 35399086_f3_4 | 10139 | 24242 | 186 | 62 | | | | | |
| CONTIG428 | 19620463_c1_4 | 10140 | 24243 | 186 | 62 | | | | | |
| CONTIG428 | 4896927_c1_7 | 10141 | 24244 | 234 | 78 | | | | | |
| CONTIG4282 | 21932625_f2_2 | 10142 | 24245 | 363 | 121 | | | | | |
| CONTIG4283 | 35676576_f3_3 | 10143 | 24246 | 537 | 179 | | | | | |
| CONTIG4283 | 20351625_c3_12 | 10144 | 24247 | 450 | 150 | | | | | |
| CONTIG4283 | 15625458_f2_2 | 10145 | 24248 | 219 | 73 | | | | | |
| CONTIG4284 | 3927_f3_4 | 10146 | 24249 | 195 | 65 | | | | | |
| CONTIG4284 | 20365825_c1_5 | 10147 | 24250 | 192 | 64 | | | | | |
| CONTIG4284 | 24306588_f3_2 | 10148 | 24251 | 207 | 69 | | | | | |
| CONTIG4285 | 23648937_c2_7 | 10149 | 24252 | 273 | 91 | | | | | |
| CONTIG4285 | 10631250_c2_8 | 10150 | 24253 | 210 | 70 | | | | | |
| CONTIG4287 | 11807825_f2_3 | 10151 | 24254 | 237 | 79 | | | | | |
| CONTIG4287 | 4187830_c2_9 | 10152 | 24255 | 528 | 176 | | | | | |
| CONTIG4288 | 9846900_f1_1 | 10153 | 24256 | 204 | 68 | | | | | |
| CONTIG4288 | 19926260_c2_5 | 10154 | 24257 | 201 | 67 | | | | | |
| CONTIG4289 | 12782393_f3_3 | 10155 | 24258 | 237 | 79 | | | | | |
| CONTIG4289 | 15888_c2_6 | 10156 | 24259 | 222 | 74 | | | | | |
| CONTIG429 | 29456300_c1_2 | 10157 | 24260 | 360 | 120 | | | | | |
| CONTIG429 | 16446937_c3_3 | 10158 | 24261 | 417 | 139 | | | | | |
| CONTIG4290 | 34236641_f1_1 | 10159 | 24262 | 183 | 61 | | | | | |
| CONTIG4290 | 22445890_f2_3 | 10160 | 24263 | 198 | 66 | | | | | |
| CONTIG4290 | 79682_f3_5 | 10161 | 24264 | 255 | 85 | | | | | |
| CONTIG4291 | 6689200_f3_6 | 10162 | 24265 | 186 | 62 | | | | | |
| CONTIG4291 | 4173188_f3_7 | 10163 | 24266 | 249 | 83 | | | | | |
| CONTIG4292 | 14531261_f3_2 | 10164 | 24267 | 267 | 89 | | | | | |
| CONTIG4292 | 21517025_c2_3 | 10165 | 24268 | 312 | 104 | | | | | |
| CONTIG4292 | 6921961_c3_6 | 10166 | 24269 | 207 | 69 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4292 | 34424200_c3_7 | 10167 | 24270 | 246 | 82 | | | | | |
| CONTIG4293 | 24853305_f1_2 | 10168 | 24271 | 183 | 61 | | | | | |
| CONTIG4293 | 4875057_f2_3 | 10169 | 24272 | 444 | 148 | | | | | |
| CONTIG4294 | 14734553_c2_5 | 10170 | 24273 | 375 | 125 | | | | | |
| CONTIG4295 | 21770762_c2_7 | 10171 | 24274 | 366 | 122 | | | | | |
| CONTIG4295 | 568937_c3_11 | 10172 | 24275 | 210 | 70 | | | | | |
| CONTIG4296 | 390640_c3_5 | 10173 | 24276 | 237 | 79 | | | | | |
| CONTIG4296 | 25581700_f3_3 | 10174 | 24277 | 219 | 73 | | | | | |
| CONTIG4297 | 12626537_c1_5 | 10175 | 24278 | 369 | 123 | | | | | |
| CONTIG4297 | 3243902_f1_1 | 10176 | 24279 | 273 | 91 | | | | | |
| CONTIG4301 | 33205001_f3_5 | 10177 | 24280 | 336 | 112 | | | | | |
| CONTIG4304 | 3392_f2_1 | 10171 | 24281 | 225 | 75 | | | | | |
| CONTIG4305 | 35205453_c2_5 | 10179 | 24282 | 246 | 82 | | | | | |
| CONTIG4305 | 3964802_f1_1 | 10180 | 24283 | 201 | 67 | | | | | |
| CONTIG4306 | 24297176_c2_8 | 10181 | 24284 | 600 | 200 | | | | | |
| CONTIG4308 | 24501702_c3_9 | 10182 | 24285 | 1044 | 348 | | | | | |
| CONTIG4308 | 24876880_f1_2 | 10183 | 24286 | 207 | 69 | | | | | |
| CONTIG4309 | 14456318_c1_6 | 10184 | 24287 | 207 | 69 | | | | | |
| CONTIG4309 | 23828250_c2_8 | 10185 | 24288 | 246 | 82 | | | | | |
| CONTIG4310 | 24227252_c1_5 | 10186 | 24289 | 261 | 87 | | | | | |
| CONTIG4310 | 12195286_c3_10 | 10187 | 24290 | 630 | 210 | | | | | |
| CONTIG4311 | 2606283_f3_6 | 10188 | 24291 | 192 | 64 | | | | | |
| CONTIG4312 | 4478406_c3_8 | 10189 | 24292 | 204 | 68 | | | | | |
| CONTIG4313 | 426567_f1_2 | 10190 | 24293 | 234 | 78 | | | | | |
| CONTIG4313 | 23486578_c2_6 | 10191 | 24294 | 237 | 79 | | | | | |
| CONTIG4314 | 33203551_f3_4 | 10192 | 24295 | 198 | 66 | | | | | |
| CONTIG4314 | 819075_c2_5 | 10193 | 24296 | 231 | 77 | | | | | |
| CONTIG4315 | 9803276_c2_10 | 10194 | 24297 | 201 | 67 | | | | | |
| CONTIG4315 | 25548251_c2_11 | 10195 | 24298 | 246 | 82 | | | | | |
| CONTIG4316 | 16056937_f3_1 | 10196 | 24299 | 219 | 73 | | | | | |
| CONTIG4318 | 34195461_c1_4 | 10197 | 24300 | 285 | 95 | | | | | |
| CONTIG4319 | 14563152_f2_2 | 10198 | 24301 | 240 | 80 | | | | | |
| CONTIG4321 | 23628387_f3_6 | 10199 | 24302 | 627 | 209 | | | | | |
| CONTIG4321 | 22539136_f3_7 | 10200 | 24303 | 210 | 70 | | | | | |
| CONTIG4322 | 23647586_c2_4 | 10201 | 24304 | 246 | 82 | | | | | |
| CONTIG4323 | 35203432_f1_1 | 10202 | 24305 | 228 | 76 | | | | | |
| CONTIG4323 | 30272157_f3_3 | 10203 | 24306 | 273 | 91 | | | | | |
| CONTIG4324 | 23475300_c1_8 | 10204 | 24307 | 690 | 230 | | | | | |
| CONTIG4326 | 4509567_f2_3 | 10205 | 24308 | 189 | 63 | | | | | |
| CONTIG4326 | 20161567_f3_7 | 10206 | 24309 | 213 | 71 | | | | | |
| CONTIG4329 | 29532775_c3_1 | 10207 | 24310 | 207 | 69 | | | | | |
| CONTIG4332 | 5896900_c3_2 | 10208 | 24311 | 261 | 87 | | | | | |
| CONTIG4333 | 4962542_c2_9 | 10209 | 24312 | 288 | 96 | | | | | |
| CONTIG4333 | 25585902_c3_8 | 10210 | 24313 | 324 | 108 | | | | | |
| CONTIG4336 | 24492063_f1_2 | 10211 | 24314 | 198 | 66 | | | | | |
| CONTIG4336 | 24647675_c2_9 | 10212 | 24315 | 198 | 66 | | | | | |
| CONTIG4337 | 24433757_f1_1 | 10213 | 24316 | 183 | 61 | | | | | |
| CONTIG4337 | 16414000_c3_10 | 10214 | 24317 | 558 | 186 | | | | | |
| CONTIG4338 | 14852192_f3_4 | 10215 | 24318 | 213 | 71 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4338 | 14453132_c2_9 | 10216 | 24319 | 249 | 83 | | | | | |
| CONTIG4338 | 36454062_c3_11 | 10217 | 24320 | 204 | 68 | | | | | |
| CONTIG4339 | 882817_f3_4 | 10218 | 24321 | 234 | 78 | | | | | |
| CONTIG434 | 33713410_f1_1 | 10219 | 24322 | 192 | 64 | | | | | |
| CONTIG4340 | 5288910_f1_1 | 10220 | 24323 | 663 | 221 | | | | | |
| CONTIG4341 | 34459687_c1_4 | 10221 | 24324 | 222 | 74 | | | | | |
| CONTIG4342 | 24505052_f2_1 | 10222 | 24325 | 222 | 74 | | | | | |
| CONTIG4343 | 15861703_f2_1 | 10223 | 24326 | 189 | 63 | | | | | |
| CONTIG4343 | 6343827_c1_4 | 10224 | 24327 | 243 | 81 | | | | | |
| CONTIG4343 | 22457687_c3_7 | 10225 | 24328 | 204 | 68 | | | | | |
| CONTIG4345 | 14843758_f1_1 | 10226 | 24329 | 183 | 61 | | | | | |
| CONTIG4345 | 32064087_f2_5 | 10227 | 24330 | 663 | 221 | | | | | |
| CONTIG4345 | 24303300_c1_8 | 10228 | 24331 | 240 | 80 | | | | | |
| CONTIG4346 | 24265837_c2_4 | 10229 | 24332 | 192 | 64 | | | | | |
| CONTIG4347 | 23614662_f1_3 | 10230 | 24333 | 258 | 86 | | | | | |
| CONTIG4347 | 9773376_f1_4 | 10231 | 24334 | 201 | 67 | | | | | |
| CONTIG4349 | 23867135_c1_4 | 10232 | 24335 | 189 | 63 | | | | | |
| CONTIG4351 | 4180277_f2_1 | 10233 | 24336 | 261 | 87 | | | | | |
| CONTIG4352 | 23447188_f3_6 | 10234 | 24337 | 255 | 85 | | | | | |
| CONTIG4353 | 193757_c2_4 | 10235 | 24338 | 204 | 68 | | | | | |
| CONTIG4353 | 34187800_c2_5 | 10236 | 24339 | 255 | 85 | | | | | |
| CONTIG4353 | 9881556_c3_6 | 10237 | 24340 | 258 | 86 | | | | | |
| CONTIG4354 | 32475877_c3_7 | 10238 | 24341 | 321 | 107 | | | | | |
| CONTIG4355 | 984385_c2_7 | 10239 | 24342 | 258 | 86 | | | | | |
| CONTIG4356 | 3303577_f1_2 | 10240 | 24343 | 207 | 69 | | | | | |
| CONTIG4356 | 10718911_c2_8 | 10241 | 24344 | 264 | 88 | | | | | |
| CONTIG4359 | 24414838_f1_2 | 10242 | 24345 | 294 | 98 | | | | | |
| CONTIG4360 | 23538853_f2_2 | 10243 | 24346 | 213 | 71 | | | | | |
| CONTIG4361 | 22438255_f2_6 | 10244 | 24347 | 198 | 66 | | | | | |
| CONTIG4362 | 3845250_f1_3 | 10245 | 24348 | 297 | 99 | | | | | |
| CONTIG4362 | 24413912_c2_6 | 10246 | 24349 | 1686 | 562 | | | | | |
| CONTIG4363 | 14587552_f2_3 | 10247 | 24350 | 501 | 167 | | | | | |
| CONTIG4364 | 4119786_f1_1 | 10248 | 24351 | 204 | 68 | | | | | |
| CONTIG4364 | 33984687_c1_5 | 10249 | 24352 | 198 | 66 | | | | | |
| CONTIG4364 | 174041_c2_6 | 10250 | 24353 | 249 | 83 | | | | | |
| CONTIG4364 | 4003135_c2_7 | 10251 | 24354 | 309 | 103 | | | | | |
| CONTIG4366 | 16796925_c2_3 | 10252 | 24355 | 207 | 69 | | | | | |
| CONTIG4368 | 23548453_f1_1 | 10253 | 24356 | 204 | 68 | | | | | |
| CONTIG4369 | 4137_c1_6 | 10254 | 24357 | 210 | 70 | | | | | |
| CONTIG4369 | 2913936_c2_9 | 10255 | 24358 | 261 | 87 | | | | | |
| CONTIG4369 | 14101427_c3_13 | 10256 | 24359 | 270 | 90 | | | | | |
| CONTIG4373 | 31262_c1_2 | 10257 | 24360 | 228 | 76 | | | | | |
| CONTIG4373 | 14863811_c2_6 | 10258 | 24361 | 183 | 61 | | | | | |
| CONTIG4373 | 11145290_c3_8 | 10259 | 24362 | 183 | 61 | | | | | |
| CONTIG4376 | 25437631_c1_6 | 10260 | 24363 | 1875 | 625 | | | | | |
| CONTIG4376 | 22284563_c1_7 | 10261 | 24364 | 183 | 61 | | | | | |
| CONTIG4376 | 24495327_c2_10 | 10262 | 24365 | 273 | 91 | | | | | |
| CONTIG4377 | 23835058_f3_4 | 10263 | 24366 | 555 | 185 | | | | | |
| CONTIG4378 | 20312766_c2_7 | 10264 | 24367 | 201 | 67 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4379 | 287516_c2_4 | 10265 | 24368 | 195 | 65 | | | | | |
| CONTIG4380 | 31250462_f2_1 | 10266 | 24369 | 225 | 75 | | | | | |
| CONTIG4380 | 30756262_c2_4 | 10267 | 24370 | 267 | 89 | | | | | |
| CONTIG4380 | 10718766_c3_5 | 10268 | 24371 | 273 | 91 | | | | | |
| CONTIG4381 | 36562812_f2_1 | 10269 | 24372 | 237 | 79 | | | | | |
| CONTIG4381 | 34026550_c2_4 | 10270 | 24373 | 219 | 73 | | | | | |
| CONTIG4381 | 14064002_c3_6 | 10271 | 24374 | 267 | 89 | | | | | |
| CONTIG4381 | 10975886_c3_7 | 10272 | 24375 | 189 | 63 | | | | | |
| CONTIG4383 | 13125050_c1_9 | 10273 | 24376 | 468 | 156 | | | | | |
| CONTIG4383 | 165936_c2_10 | 10274 | 24377 | 483 | 161 | | | | | |
| CONTIG4388 | 22400262_c2_4 | 10275 | 24378 | 348 | 116 | | | | | |
| CONTIG4389 | 7033206_c1_3 | 10276 | 24379 | 270 | 90 | | | | | |
| CONTIG4389 | 20117012_c2_5 | 10277 | 24380 | 198 | 66 | | | | | |
| CONTIG4390 | 24475061_c2_5 | 10278 | 24381 | 195 | 65 | | | | | |
| CONTIG4390 | 26445212_c2_9 | 10279 | 24382 | 192 | 64 | | | | | |
| CONTIG4392 | 7087885_c1_4 | 10280 | 24383 | 246 | 82 | | | | | |
| CONTIG4393 | 23943937_c2_9 | 10281 | 24384 | 198 | 66 | | | | | |
| CONTIG4394 | 2120187_c3_8 | 10282 | 24385 | 462 | 154 | | | | | |
| CONTIG4395 | 390680_f1_1 | 10283 | 24386 | 201 | 67 | | | | | |
| CONTIG4395 | 14475035_c3_12 | 10284 | 24387 | 1674 | 558 | | | | | |
| CONTIG4396 | 2750181_c2_9 | 10285 | 24388 | 231 | 77 | | | | | |
| CONTIG4401 | 9765625_c2_4 | 10286 | 24389 | 426 | 142 | | | | | |
| CONTIG4401 | 829000_c3_5 | 10287 | 24390 | 1251 | 417 | | | | | |
| CONTIG4403 | 9819155_f1_2 | 10288 | 24391 | 210 | 70 | | | | | |
| CONTIG4403 | 30080288_c1_11 | 10289 | 24392 | 216 | 72 | | | | | |
| CONTIG4403 | 12367178_c1_15 | 10290 | 24393 | 243 | 81 | | | | | |
| CONTIG4404 | 1171927_f1_1 | 10291 | 24394 | 210 | 70 | | | | | |
| CONTIG4407 | 5915677_f3_4 | 10292 | 24395 | 189 | 63 | | | | | |
| CONTIG4407 | 3944442_c3_10 | 10293 | 24396 | 204 | 68 | | | | | |
| CONTIG4408 | 3203213_f2_1 | 10294 | 24397 | 210 | 70 | | | | | |
| CONTIG4408 | 4720277_c1_4 | 10295 | 24398 | 510 | 170 | | | | | |
| CONTIG4408 | 24256253_c2_6 | 10296 | 24399 | 240 | 80 | | | | | |
| CONTIG4408 | 12613281_c3_7 | 10297 | 24400 | 534 | 178 | | | | | |
| CONTIG4409 | 14957812_c3_7 | 10298 | 24401 | 219 | 73 | | | | | |
| CONTIG4410 | 23541656_f2_2 | 10299 | 24402 | 222 | 74 | | | | | |
| CONTIG4411 | 14736430_f2_5 | 10300 | 24403 | 342 | 114 | | | | | |
| CONTIG4413 | 33392177_c3_6 | 10301 | 24404 | 192 | 64 | | | | | |
| CONTIG4414 | 1416317_f2_2 | 10302 | 24405 | 252 | 84 | | | | | |
| CONTIG4416 | 35642642_f2_4 | 10303 | 24406 | 201 | 67 | | | | | |
| CONTIG4416 | 30183578_c2_9 | 10304 | 24407 | 984 | 328 | | | | | |
| CONTIG4416 | 21562877_c2_10 | 10305 | 24408 | 207 | 69 | | | | | |
| CONTIG4416 | 12517010_c2_11 | 10306 | 24409 | 189 | 63 | | | | | |
| CONTIG4417 | 26345280_f3_6 | 10307 | 24410 | 522 | 174 | | | | | |
| CONTIG4417 | 26362717_c1_8 | 10308 | 24411 | 957 | 319 | | | | | |
| CONTIG4417 | 19689035_c1_9 | 10309 | 24412 | 213 | 71 | | | | | |
| CONTIG4417 | 36361550_c3_12 | 10310 | 24413 | 282 | 94 | | | | | |
| CONTIG4418 | 12297510_f1_3 | 10311 | 24414 | 771 | 257 | | | | | |
| CONTIG4418 | 2929561_f2_4 | 10312 | 24415 | 231 | 77 | | | | | |
| CONTIG4418 | 5084686_f3_7 | 10313 | 24416 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4419 | 12272137_c1_6 | 10314 | 24417 | 1413 | 471 | | | | | |
| CONTIG4420 | 14644181_f1_3 | 10315 | 24418 | 198 | 66 | | | | | |
| CONTIG4420 | 12675261_c1_5 | 10316 | 24419 | 204 | 68 | | | | | |
| CONTIG4422 | 10740802_c2_7 | 10317 | 24420 | 807 | 269 | | | | | |
| CONTIG4422 | 9964087_c2_10 | 10318 | 24421 | 198 | 66 | | | | | |
| CONTIG4423 | 398441_f1_1 | 10319 | 24422 | 351 | 117 | | | | | |
| CONTIG4424 | 24414212_c1_5 | 10320 | 24423 | 183 | 61 | | | | | |
| CONTIG4425 | 23634627_f1_3 | 10321 | 24424 | 201 | 67 | | | | | |
| CONTIG4425 | 9776950_f2_4 | 10322 | 24425 | 186 | 62 | | | | | |
| CONTIG4426 | 34000078_f3_6 | 10323 | 24426 | 192 | 64 | | | | | |
| CONTIG4429 | 4101702_c2_5 | 10324 | 24427 | 285 | 95 | | | | | |
| CONTIG4432 | 13884508_c1_9 | 10325 | 24428 | 270 | 90 | | | | | |
| CONTIG4433 | 24023912_c1_6 | 10326 | 24429 | 216 | 72 | | | | | |
| CONTIG4433 | 35329512_c2_8 | 10327 | 24430 | 183 | 61 | | | | | |
| CONTIG4434 | 5104767_f2_3 | 10328 | 24431 | 195 | 65 | | | | | |
| CONTIG4434 | 15823587_c3_6 | 10329 | 24432 | 258 | 86 | | | | | |
| CONTIG4435 | 36223427_f1_1 | 10330 | 24433 | 201 | 67 | | | | | |
| CONTIG4436 | 4178780_f2_4 | 10331 | 24434 | 597 | 199 | | | | | |
| CONTIG4436 | 960811_f2_5 | 10332 | 24435 | 216 | 72 | | | | | |
| CONTIG4436 | 14531511_c3_11 | 10333 | 24436 | 246 | 82 | | | | | |
| CONTIG4437 | 14553300_f1_2 | 10334 | 24437 | 420 | 140 | | | | | |
| CONTIG4437 | 12284661_f2_5 | 10335 | 24438 | 372 | 124 | | | | | |
| CONTIG4438 | 14720641_f2_1 | 10336 | 24439 | 207 | 69 | | | | | |
| CONTIG4439 | 6645138_c3_9 | 10337 | 24440 | 834 | 278 | | | | | |
| CONTIG444 | 1032510_f2_1 | 10338 | 24441 | 186 | 62 | | | | | |
| CONTIG4440 | 32595135_f3_4 | 10339 | 24442 | 1515 | 505 | | | | | |
| CONTIG4443 | 23612777_f1_1 | 10340 | 24443 | 1614 | 538 | | | | | |
| CONTIG4444 | 24020436_f3_4 | 10341 | 24444 | 261 | 87 | | | | | |
| CONTIG4444 | 36539078_c3_5 | 10342 | 24445 | 396 | 132 | | | | | |
| CONTIG4445 | 24412507_f2_2 | 10343 | 24446 | 189 | 63 | | | | | |
| CONTIG4445 | 20343752_f2_4 | 10344 | 24447 | 276 | 92 | | | | | |
| CONTIG4445 | 34176287_f3_5 | 10345 | 24448 | 183 | 61 | | | | | |
| CONTIG4445 | 10_c3_8 | 10346 | 24449 | 198 | 66 | | | | | |
| CONTIG4450 | 5350285_c2_8 | 10347 | 24450 | 249 | 83 | | | | | |
| CONTIG4450 | 19725156_c3_10 | 10348 | 24451 | 261 | 87 | | | | | |
| CONTIG4452 | 23461561_c1_8 | 10349 | 24452 | 363 | 121 | | | | | |
| CONTIG4452 | 31363453_c2_11 | 10350 | 24453 | 345 | 115 | | | | | |
| CONTIG4454 | 3909575_c2_2 | 10351 | 24454 | 249 | 83 | | | | | |
| CONTIG4455 | 13800181_c3_3 | 10352 | 24455 | 189 | 63 | | | | | |
| CONTIG4456 | 23676627_f2_3 | 10353 | 24456 | 252 | 84 | | | | | |
| CONTIG4456 | 633541_f3_4 | 10354 | 24457 | 276 | 92 | | | | | |
| CONTIG4457 | 21964768_f1_2 | 10355 | 24458 | 246 | 82 | | | | | |
| CONTIG4457 | 290676_c3_12 | 10356 | 24459 | 390 | 130 | | | | | |
| CONTIG4459 | 22676451_f3_3 | 10357 | 24460 | 234 | 78 | | | | | |
| CONTIG4459 | 6850192_c1_5 | 10358 | 24461 | 327 | 109 | | | | | |
| CONTIG4459 | 47878_c2_6 | 10359 | 24462 | 198 | 66 | | | | | |
| CONTIG4459 | 24332892_c2_8 | 10360 | 24463 | 192 | 64 | | | | | |
| CONTIG4459 | 24416015_c3_10 | 10361 | 24464 | 258 | 86 | | | | | |
| CONTIG446 | 29428127_f2_1 | 10362 | 24465 | 267 | 89 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4461 | 13947681_f2_2 | 10363 | 24466 | 186 | 62 | | | | | |
| CONTIG4463 | 1353133_c1_1 | 10364 | 24467 | 240 | 80 | | | | | |
| CONTIG4466 | 2334407_f2_2 | 10365 | 24468 | 495 | 165 | | | | | |
| CONTIG4466 | 26345307_c2_6 | 10366 | 24469 | 225 | 75 | | | | | |
| CONTIG4467 | 6484385_f1_1 | 10367 | 24470 | 282 | 94 | | | | | |
| CONTIG4467 | 33392762_f3_4 | 10368 | 24471 | 222 | 74 | | | | | |
| CONTIG4467 | 4550705_c3_8 | 10369 | 24472 | 1218 | 406 | | | | | |
| CONTIG4468 | 36505_f3_5 | 10370 | 24473 | 918 | 306 | | | | | |
| CONTIG4469 | 26367187_f1_2 | 10371 | 24474 | 276 | 92 | | | | | |
| CONTIG447 | 4708281_f2_1 | 10372 | 24475 | 768 | 256 | | | | | |
| CONTIG4470 | 15863761_f3_2 | 10373 | 24476 | 240 | 80 | | | | | |
| CONTIG4470 | 47812_c2_6 | 10374 | 24477 | 207 | 69 | | | | | |
| CONTIG4470 | 4070341_c3_7 | 10375 | 24478 | 291 | 97 | | | | | |
| CONTIG4471 | 35349012_f3_3 | 10376 | 24479 | 195 | 65 | | | | | |
| CONTIG4471 | 4491257_c1_5 | 10377 | 24480 | 552 | 184 | | | | | |
| CONTIG4471 | 26571050_c2_6 | 10378 | 24481 | 291 | 97 | | | | | |
| CONTIG4471 | 883555_c2_7 | 10379 | 24482 | 354 | 118 | | | | | |
| CONTIG4471 | 25430427_c3_10 | 10380 | 24483 | 189 | 63 | | | | | |
| CONTIG4473 | 11025707_f2_2 | 10381 | 24484 | 1638 | 546 | | | | | |
| CONTIG4475 | 1070887_c2_7 | 10382 | 24485 | 897 | 299 | | | | | |
| CONTIG4475 | 7800_c3_12 | 10383 | 24486 | 204 | 68 | | | | | |
| CONTIG4477 | 3642090_c2_3 | 10384 | 24487 | 210 | 70 | | | | | |
| CONTIG4477 | 34258442_c3_5 | 10385 | 24488 | 672 | 224 | | | | | |
| CONTIG4478 | 34187942_f1_1 | 10386 | 24489 | 183 | 61 | | | | | |
| CONTIG4478 | 14667567_f3_4 | 10387 | 24490 | 180 | 60 | | | | | |
| CONTIG4478 | 1204818_c1_5 | 10388 | 24491 | 183 | 61 | | | | | |
| CONTIG4479 | 23626512_c3_4 | 10389 | 24492 | 2358 | 786 | | | | | |
| CONTIG448 | 26441303_c1_2 | 10390 | 24493 | 789 | 263 | | | | | |
| CONTIG4480 | 25585151_f1_2 | 10391 | 24494 | 195 | 65 | | | | | |
| CONTIG4480 | 1065805_f2_3 | 10392 | 24495 | 183 | 61 | | | | | |
| CONTIG4480 | 656252_f2_4 | 10393 | 24496 | 225 | 75 | | | | | |
| CONTIG4481 | 715_c3_13 | 10394 | 24497 | 249 | 83 | | | | | |
| CONTIG4483 | 979832_f3_11 | 10395 | 24498 | 198 | 66 | | | | | |
| CONTIG4483 | 627_c1_12 | 10396 | 24499 | 231 | 77 | | | | | |
| CONTIG4483 | 12915962_c2_16 | 10397 | 24500 | 606 | 202 | | | | | |
| CONTIG4483 | 23552163_c2_17 | 10398 | 24501 | 216 | 72 | | | | | |
| CONTIG4484 | 36116402_f3_3 | 10399 | 24502 | 192 | 64 | | | | | |
| CONTIG4484 | 14643812_c3_6 | 10400 | 24503 | 186 | 62 | | | | | |
| CONTIG4485 | 4111650_f2_4 | 10401 | 24504 | 288 | 96 | | | | | |
| CONTIG4485 | 11126926_c2_7 | 10402 | 24505 | 231 | 77 | | | | | |
| CONTIG4485 | 10446062_c3_8 | 10403 | 24506 | 189 | 63 | | | | | |
| CONTIG4488 | 6933260_f3_1 | 10404 | 24507 | 210 | 70 | | | | | |
| CONTIG4488 | 53806_c2_3 | 10405 | 24508 | 516 | 172 | | | | | |
| CONTIG4490 | 22052216_f3_2 | 10406 | 24509 | 249 | 83 | | | | | |
| CONTIG4490 | 34692_c3_7 | 10407 | 24510 | 291 | 97 | | | | | |
| CONTIG4491 | 23714687_f1_1 | 10408 | 24511 | 294 | 98 | | | | | |
| CONTIG4491 | 34173311_c1_3 | 10409 | 24512 | 630 | 210 | | | | | |
| CONTIG4492 | 34179665_f3_2 | 10410 | 24513 | 186 | 62 | | | | | |
| CONTIG4492 | 21738888_c2_7 | 10411 | 24514 | 321 | 107 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4493 | 25421925_f2_4 | 10412 | 24515 | 405 | 135 | | | | | |
| CONTIG4493 | 3605468_f3_6 | 10413 | 24516 | 183 | 61 | | | | | |
| CONTIG4493 | 5110268_c3_17 | 10414 | 24517 | 231 | 77 | | | | | |
| CONTIG4494 | 6667160_f1_2 | 10415 | 24518 | 363 | 121 | | | | | |
| CONTIG4495 | 5104826_c2_6 | 10416 | 24519 | 216 | 72 | | | | | |
| CONTIG4496 | 4413885_c1_4 | 10417 | 24520 | 222 | 74 | | | | | |
| CONTIG4496 | 34620311_c2_5 | 10418 | 24521 | 198 | 66 | | | | | |
| CONTIG4496 | 14630200_f2_2 | 10419 | 24522 | 213 | 71 | | | | | |
| CONTIG4497 | 4892177_f2_3 | 10420 | 24523 | 246 | 82 | | | | | |
| CONTIG4497 | 4891280_f3_5 | 10421 | 24524 | 213 | 71 | | | | | |
| CONTIG4497 | 953177_c3_9 | 10422 | 24525 | 405 | 135 | | | | | |
| CONTIG4499 | 31454761_f3_9 | 10423 | 24526 | 192 | 64 | | | | | |
| CONTIG45 | 30126926_c2_2 | 10424 | 24527 | 183 | 61 | | | | | |
| CONTIG45 | 117805_c3_3 | 10425 | 24528 | 315 | 105 | | | | | |
| CONTIG450 | 22037558_f1_1 | 10426 | 24529 | 216 | 72 | | | | | |
| CONTIG4500 | 89378_f2_2 | 10427 | 24530 | 219 | 73 | | | | | |
| CONTIG4500 | 24304635_c2_9 | 10428 | 24531 | 276 | 92 | | | | | |
| CONTIG4501 | 20392175_f1_2 | 10429 | 24532 | 186 | 62 | | | | | |
| CONTIG4501 | 10251077_f1_3 | 10430 | 24533 | 195 | 65 | | | | | |
| CONTIG4501 | 13068766_c1_7 | 10431 | 24534 | 237 | 79 | | | | | |
| CONTIG4501 | 14492010_c3_13 | 10432 | 24535 | 189 | 63 | | | | | |
| CONTIG4503 | 32245467_c1_6 | 10433 | 24536 | 552 | 184 | | | | | |
| CONTIG4503 | 2002403 5_c3_7 | 10434 | 24537 | 1239 | 413 | | | | | |
| CONTIG4505 | 5350840_c2_10 | 10435 | 24538 | 258 | 86 | | | | | |
| CONTIG4506 | 19531262_f3_11 | 10436 | 24539 | 282 | 94 | | | | | |
| CONTIG4509 | 156553_f3_3 | 10437 | 24540 | 225 | 75 | | | | | |
| CONTIG451 | 20413430_f3_2 | 10438 | 24541 | 300 | 100 | | | | | |
| CONTIG4510 | 3915910_c2_4 | 10439 | 24542 | 219 | 73 | | | | | |
| CONTIG4512 | 25822831_f3_5 | 10440 | 24543 | 216 | 72 | | | | | |
| CONTIG4512 | 9796950_c1_6 | 10441 | 24544 | 201 | 67 | | | | | |
| CONTIG4514 | 579555_f2_6 | 10442 | 24545 | 207 | 69 | | | | | |
| CONTIG4515 | 36228151_f1_1 | 10443 | 24546 | 195 | 65 | | | | | |
| CONTIG4517 | 46958_f2_6 | 10444 | 24547 | 183 | 61 | | | | | |
| CONTIG4517 | 24657650_f3_7 | 10445 | 24548 | 1302 | 434 | | | | | |
| CONTIG4517 | 242787_c1_9 | 10446 | 24549 | 195 | 65 | | | | | |
| CONTIG4518 | 1363755_f2_1 | 10447 | 24550 | 861 | 287 | | | | | |
| CONTIG452 | 444687_c3_3 | 10448 | 24551 | 264 | 88 | | | | | |
| CONTIG452 | 4865752_c3_5 | 10449 | 24552 | 195 | 65 | | | | | |
| CONTIG4521 | 237937_f3_3 | 10450 | 24553 | 279 | 93 | | | | | |
| CONTIG4522 | 33213412_f2_2 | 10451 | 24554 | 270 | 90 | | | | | |
| CONTIG4523 | 19694050_f2_1 | 10452 | 24555 | 192 | 64 | | | | | |
| CONTIG4523 | 16421912_c3_6 | 10453 | 24556 | 210 | 70 | | | | | |
| CONTIG4525 | 29303427_f1_1 | 10454 | 24557 | 1836 | 612 | | | | | |
| CONTIG4525 | 26602262_c3_7 | 10455 | 24558 | 186 | 62 | | | | | |
| CONTIG4526 | 35392508_f2_4 | 10456 | 24559 | 237 | 79 | | | | | |
| CONTIG4527 | 14586062_c3_11 | 10457 | 24560 | 246 | 82 | | | | | |
| CONTIG4528 | 26367306_c3_12 | 10458 | 24561 | 900 | 300 | | | | | |
| CONTIG453 | 22459385_f2_2 | 10459 | 24562 | 183 | 61 | | | | | |
| CONTIG4531 | 3318827_f2_6 | 10460 | 24563 | 201 | 67 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4531 | 15642686_c1_8 | 10461 | 24564 | 207 | 69 | | | | | |
| CONTIG4534 | 21641930_f2_3 | 10462 | 24565 | 210 | 70 | | | | | |
| CONTIG4534 | 9777127_f2_4 | 10463 | 24566 | 387 | 129 | | | | | |
| CONTIG4534 | 24510188_f2_5 | 10464 | 24567 | 552 | 184 | | | | | |
| CONTIG4535 | 1195907_c3_12 | 10465 | 24568 | 192 | 64 | | | | | |
| CONTIG4536 | 829712_f1_1 | 10466 | 24569 | 219 | 73 | | | | | |
| CONTIG4536 | 7032138_c3_8 | 10467 | 24570 | 216 | 72 | | | | | |
| CONTIG4537 | 2829802_f3_4 | 10468 | 24571 | 219 | 73 | | | | | |
| CONTIG4537 | 6329502_c3_8 | 10469 | 24572 | 405 | 135 | | | | | |
| CONTIG4538 | 15789752_c1_3 | 10470 | 24573 | 198 | 66 | | | | | |
| CONTIG4539 | 4073412_f2_3 | 10471 | 24574 | 969 | 323 | | | | | |
| CONTIG4539 | 6836425_c1_10 | 10472 | 24575 | 228 | 76 | | | | | |
| CONTIG4539 | 25400936_c2_14 | 10473 | 24576 | 225 | 75 | | | | | |
| CONTIG4540 | 13865830_f3_4 | 10474 | 24577 | 291 | 97 | | | | | |
| CONTIG4540 | 35314125_c2_4 | 10475 | 24578 | 318 | 106 | | | | | |
| CONTIG4541 | 23640926_c1_5 | 10476 | 24579 | 240 | 80 | | | | | |
| CONTIG4541 | 35353382_c2_8 | 10477 | 24580 | 960 | 320 | | | | | |
| CONTIG4542 | 30129843_f2_1 | 10478 | 24581 | 237 | 79 | | | | | |
| CONTIG4542 | 35314125_c2_4 | 10479 | 24582 | 231 | 77 | | | | | |
| CONTIG4542 | 21679687_c3_5 | 10480 | 24583 | 297 | 99 | | | | | |
| CONTIG4543 | 10625432_f2_3 | 10481 | 24584 | 318 | 106 | | | | | |
| CONTIG4544 | 33242186_c1_2 | 10482 | 24585 | 192 | 64 | | | | | |
| CONTIG4545 | 24647500_c3_5 | 10483 | 24586 | 708 | 236 | | | | | |
| CONTIG4549 | 26563942_f2_1 | 10484 | 24587 | 267 | 89 | | | | | |
| CONTIG4550 | 1173552_f3_2 | 10485 | 24588 | 255 | 85 | | | | | |
| CONTIG4550 | 24410666_c2_3 | 10486 | 24589 | 192 | 64 | | | | | |
| CONTIG4551 | 796900_f2_5 | 10487 | 24590 | 762 | 254 | | | | | |
| CONTIG4551 | 814457_f3_7 | 10488 | 24591 | 186 | 62 | | | | | |
| CONTIG4552 | 25666067_f3_10 | 10489 | 24592 | 195 | 65 | | | | | |
| CONTIG4552 | 33699002_c1_11 | 10490 | 24593 | 207 | 69 | | | | | |
| CONTIG4552 | 9954032_c2_15 | 10491 | 24594 | 642 | 214 | | | | | |
| CONTIG4554 | 29296893_f2_1 | 10492 | 24595 | 627 | 209 | | | | | |
| CONTIG4556 | 23469081_f1_4 | 10493 | 24596 | 231 | 77 | | | | | |
| CONTIG4556 | 1211516_f2_6 | 10494 | 24597 | 234 | 78 | | | | | |
| CONTIG4557 | 30581500_c2_8 | 10495 | 24598 | 204 | 68 | | | | | |
| CONTIG4558 | 5086537_c2_8 | 10496 | 24599 | 279 | 93 | | | | | |
| CONTIG4558 | 6913151_f1_1 | 10497 | 24600 | 1023 | 341 | | | | | |
| CONTIG4560 | 16447213_f3_5 | 10498 | 24601 | 195 | 65 | | | | | |
| CONTIG4561 | 5360192_f3_3 | 10499 | 24602 | 414 | 138 | | | | | |
| CONTIG4561 | 24239061_f2_2 | 10500 | 24603 | 201 | 67 | | | | | |
| CONTIG4565 | 13675252_f2_4 | 10501 | 24604 | 207 | 69 | | | | | |
| CONTIG4565 | 21722756_c2_6 | 10502 | 24605 | 375 | 125 | | | | | |
| CONTIG4566 | 24800877_c3_7 | 10503 | 24606 | 627 | 209 | | | | | |
| CONTIG4566 | 24666067_f1_1 | 10504 | 24607 | 231 | 77 | | | | | |
| CONTIG4567 | 22070286_f2_1 | 10505 | 24608 | 216 | 72 | | | | | |
| CONTIG4568 | 4740717_f1_1 | 10506 | 24609 | 237 | 79 | | | | | |
| CONTIG4568 | 22539075_c2_8 | 10507 | 24610 | 1062 | 354 | | | | | |
| CONTIG4568 | 13883577_c3_9 | 10508 | 24611 | 270 | 90 | | | | | |
| CONTIG4569 | 11877175_f3_2 | 10509 | 24612 | 273 | 91 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4569 | 12383582_c3_6 | 10510 | 24613 | 183 | 61 | | | | | |
| CONTIG4569 | 24465927_c3_7 | 10511 | 24614 | 411 | 137 | | | | | |
| CONTIG4571 | 2421 8753_f1_1 | 10512 | 24615 | 195 | 65 | | | | | |
| CONTIG4571 | 7986052_c1_4 | 10513 | 24616 | 186 | 62 | | | | | |
| CONTIG4572 | 213535_f3_2 | 10514 | 24617 | 270 | 90 | | | | | |
| CONTIG4572 | 29692680_c2_3 | 10515 | 24618 | 183 | 61 | | | | | |
| CONTIG4572 | 3004843_c2_4 | 10516 | 24619 | 183 | 61 | | | | | |
| CONTIG4574 | 31287811_c1_6 | 10517 | 24620 | 210 | 70 | | | | | |
| CONTIG4575 | 3907677_c1_5 | 10518 | 24621 | 255 | 85 | | | | | |
| CONTIG4575 | 23835952_c3_10 | 10519 | 24622 | 456 | 152 | | | | | |
| CONTIG4576 | 4073552_f2_5 | 10520 | 24623 | 246 | 82 | | | | | |
| CONTIG4576 | 10978433_f3_6 | 10521 | 24624 | 231 | 77 | | | | | |
| CONTIG4577 | 20756528_f3_2 | 10522 | 24625 | 243 | 81 | | | | | |
| CONTIG4577 | 164000_f3_3 | 10523 | 24626 | 240 | 80 | | | | | |
| CONTIG4578 | 34632692_f1_1 | 10524 | 24627 | 1005 | 335 | | | | | |
| CONTIG4578 | 176567_f3_6 | 10525 | 24628 | 315 | 105 | | | | | |
| CONTIG4579 | 267887_f2_1 | 10526 | 24629 | 258 | 86 | | | | | |
| CONTIG4579 | 24271916_f2_2 | 10527 | 24630 | 933 | 311 | | | | | |
| CONTIG4579 | 24026885_f3_3 | 10528 | 24631 | 195 | 65 | | | | | |
| CONTIG4579 | 32128750_c2_7 | 10529 | 24632 | 192 | 64 | | | | | |
| CONTIG4580 | 15035438_c3_7 | 10530 | 24633 | 663 | 221 | | | | | |
| CONTIG4582 | 4564377_f2_1 | 10531 | 24634 | 183 | 61 | | | | | |
| CONTIG4582 | 12673437_c2_4 | 10532 | 24635 | 390 | 130 | | | | | |
| CONTIG4583 | 1180262_c1_2 | 10533 | 24636 | 339 | 113 | | | | | |
| CONTIG4584 | 30470040_f1_1 | 10534 | 24637 | 201 | 67 | | | | | |
| CONTIG4584 | 860327_f2_4 | 10535 | 24638 | 237 | 79 | | | | | |
| CONTIG4584 | 29533135_c1_6 | 10536 | 24639 | 216 | 72 | | | | | |
| CONTIG4584 | 5121010_c3_10 | 10537 | 24640 | 222 | 74 | | | | | |
| CONTIG4585 | 6848752_c1_9 | 10538 | 24641 | 1206 | 402 | | | | | |
| CONTIG4585 | 1257843_c3_11 | 10539 | 24642 | 360 | 120 | | | | | |
| CONTIG4587 | 23707925_c2_6 | 10540 | 24643 | 210 | 70 | | | | | |
| CONTIG4588 | 12617031_f1_2 | 10541 | 24644 | 357 | 119 | | | | | |
| CONTIG4588 | 35991688_c1_5 | 10542 | 24645 | 252 | 84 | | | | | |
| CONTIG4589 | 19691885_c2_5 | 10543 | 24646 | 204 | 68 | | | | | |
| CONTIG459 | 24409392_f1_1 | 10544 | 24647 | 219 | 73 | | | | | |
| CONTIG4590 | 20495686_f1_2 | 10545 | 24648 | 315 | 105 | | | | | |
| CONTIG4590 | 20350337_f2_4 | 10546 | 24649 | 297 | 99 | | | | | |
| CONTIG4590 | 16617063_f3_5 | 10547 | 24650 | 213 | 71 | | | | | |
| CONTIG4590 | 3275_f3_6 | 10548 | 24651 | 198 | 66 | | | | | |
| CONTIG4590 | 5115811_c2_8 | 10549 | 24652 | 225 | 75 | | | | | |
| CONTIG4590 | 4695933_c3_9 | 10550 | 24653 | 213 | 71 | | | | | |
| CONTIG4591 | 19609687_c1_3 | 10551 | 24654 | 210 | 70 | | | | | |
| CONTIG4591 | 24413951_c1_4 | 10552 | 24655 | 189 | 63 | | | | | |
| CONTIG4592 | 2772637_c3_10 | 10553 | 24656 | 186 | 62 | | | | | |
| CONTIG4592 | 25468792_c1_5 | 10554 | 24657 | 666 | 222 | | | | | |
| CONTIG4594 | 24229561_f2_3 | 10555 | 24658 | 603 | 201 | | | | | |
| CONTIG4596 | 9870156_c3_12 | 10556 | 24659 | 345 | 115 | | | | | |
| CONTIG4597 | 24089055_f1_2 | 10557 | 24660 | 252 | 84 | | | | | |
| CONTIG4597 | 20189415_f3_6 | 10558 | 24661 | 282 | 94 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4598 | 16604678_c1_6 | 10559 | 24662 | 198 | 66 | | | | | |
| CONTIG4599 | 35656506_f2_2 | 10560 | 24663 | 261 | 87 | | | | | |
| CONTIG4599 | 167630_f3_3 | 10561 | 24664 | 255 | 85 | | | | | |
| CONTIG46 | 26445285_c2_2 | 10562 | 24665 | 261 | 87 | | | | | |
| CONTIG460 | 34164218_c2_1 | 10563 | 24666 | 207 | 69 | | | | | |
| CONTIG4600 | 36539177_c2_3 | 10564 | 24667 | 195 | 65 | | | | | |
| CONTIG4602 | 26382938_c2_5 | 10565 | 24668 | 330 | 110 | | | | | |
| CONTIG4603 | 3302280_f2_3 | 10566 | 24669 | 213 | 71 | | | | | |
| CONTIG4603 | 22679566_f3_5 | 10567 | 24670 | 300 | 100 | | | | | |
| CONTIG4604 | 39062_f2_3 | 10568 | 24671 | 1014 | 338 | | | | | |
| CONTIG4604 | 24617807_f2_4 | 10569 | 24672 | 234 | 78 | | | | | |
| CONTIG4605 | 10835942_f2_2 | 10570 | 24673 | 375 | 125 | | | | | |
| CONTIG4605 | 24426553_f3_5 | 10571 | 24674 | 225 | 75 | | | | | |
| CONTIG4606 | 188760_c2_10 | 10572 | 24675 | 231 | 77 | | | | | |
| CONTIG4606 | 29429687_f3_5 | 10573 | 24676 | 297 | 99 | | | | | |
| CONTIG4606 | 6054502_c1_6 | 10574 | 24677 | 195 | 65 | | | | | |
| CONTIG4608 | 9766512_f1_3 | 10575 | 24678 | 297 | 99 | | | | | |
| CONTIG4608 | 4953405_f2_4 | 10576 | 24679 | 258 | 86 | | | | | |
| CONTIG4608 | 4860702_c3_10 | 10577 | 24680 | 246 | 82 | | | | | |
| CONTIG4609 | 3016750_f1_2 | 10578 | 24681 | 192 | 64 | | | | | |
| CONTIG4609 | 972942_f3_7 | 10579 | 24682 | 207 | 69 | | | | | |
| CONTIG4609 | 2926502_c2_15 | 10580 | 24683 | 243 | 81 | | | | | |
| CONTIG461 | 26281687_c2_4 | 10581 | 24684 | 777 | 259 | | | | | |
| CONTIG4610 | 46961_f1_2 | 10582 | 24685 | 264 | 88 | | | | | |
| CONTIG4610 | 13836052_f2_3 | 10583 | 24686 | 384 | 128 | | | | | |
| CONTIG4610 | 24303503_c1_5 | 10584 | 24687 | 264 | 88 | | | | | |
| CONTIG4610 | 14492175_c1_6 | 10585 | 24688 | 186 | 62 | | | | | |
| CONTIG4615 | 10413382_f3_3 | 10586 | 24689 | 345 | 115 | | | | | |
| CONTIG4615 | 23454050_f3_4 | 10587 | 24690 | 183 | 61 | | | | | |
| CONTIG4616 | 30556257_f3_6 | 10588 | 24691 | 186 | 62 | | | | | |
| CONTIG4616 | 970262_c1_5 | 10589 | 24692 | 192 | 64 | | | | | |
| CONTIG4619 | 20955000_c2_8 | 10590 | 24693 | 237 | 79 | | | | | |
| CONTIG462 | 4890700_f3_5 | 10591 | 24694 | 189 | 63 | | | | | |
| CONTIG4620 | 984636_f2_2 | 10592 | 24695 | 312 | 104 | | | | | |
| CONTIG4621 | 1181325_f2_5 | 10593 | 24696 | 198 | 66 | | | | | |
| CONTIG4621 | 16065962_f2_2 | 10594 | 24697 | 774 | 258 | | | | | |
| CONTIG4622 | 19960300_f2_3 | 10595 | 24698 | 501 | 167 | | | | | |
| CONTIG4623 | 6285306_f1_2 | 10596 | 24699 | 525 | 175 | | | | | |
| CONTIG4623 | 34485682_f1_2 | 10597 | 24700 | 195 | 65 | | | | | |
| CONTIG4623 | 3306262_f2_3 | 10598 | 24701 | 441 | 147 | | | | | |
| CONTIG4623 | 23960010_c1_6 | 10599 | 24702 | 183 | 61 | | | | | |
| CONTIG4625 | 23995626_c1_7 | 10600 | 24703 | 336 | 112 | | | | | |
| CONTIG4625 | 4877182_f1_1 | 10601 | 24704 | 183 | 61 | | | | | |
| CONTIG4625 | 34011592_c3_9 | 10602 | 24705 | 255 | 85 | | | | | |
| CONTIG4626 | 31328317_f2_1 | 10603 | 24706 | 186 | 62 | | | | | |
| CONTIG4628 | 23948450_f2_1 | 10604 | 24707 | 183 | 61 | | | | | |
| CONTIG4628 | 4475312_c3_4 | 10605 | 24708 | 216 | 72 | | | | | |
| CONTIG4628 | 625075_c3_4 | 10606 | 24709 | 279 | 93 | | | | | |
| CONTIG4629 | 14642142_f1_1 | 10607 | 24710 | 228 | 76 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4629 | 33484692_c2_8 | 10608 | 24711 | 291 | 97 | | | | | |
| CONTIG4630 | 5866432_c1_7 | 10609 | 24712 | 231 | 77 | | | | | |
| CONTIG4631 | 956640_f3_5 | 10610 | 24713 | 225 | 75 | | | | | |
| CONTIG4631 | 23957887_c3_11 | 10611 | 24714 | 255 | 85 | | | | | |
| CONTIG4632 | 30251942_c2_9 | 10612 | 24715 | 255 | 85 | | | | | |
| CONTIG4633 | 25422512_c2_9 | 10613 | 24716 | 204 | 68 | | | | | |
| CONTIG4633 | 4722125_c3_11 | 10614 | 24717 | 192 | 64 | | | | | |
| CONTIG4633 | 6031563_c3_12 | 10615 | 24718 | 192 | 64 | | | | | |
| CONTIG4634 | 24320307_f2_1 | 10616 | 24719 | 453 | 151 | | | | | |
| CONTIG4635 | 3912750_f1_2 | 10617 | 24720 | 384 | 128 | | | | | |
| CONTIG4636 | 12900099_c1_3 | 10618 | 24721 | 183 | 61 | | | | | |
| CONTIG4636 | 1053763_c3_8 | 10619 | 24722 | 192 | 64 | | | | | |
| CONTIG464 | 10005175_f2_1 | 10620 | 24723 | 297 | 99 | | | | | |
| CONTIG4640 | 876312_f1_1 | 10621 | 24724 | 756 | 252 | | | | | |
| CONTIG4640 | 30115937_c1_7 | 10622 | 24725 | 708 | 236 | | | | | |
| CONTIG4642 | 20321910_f2_3 | 10623 | 24726 | 186 | 62 | | | | | |
| CONTIG4642 | 24093812_f2_4 | 10624 | 24727 | 351 | 117 | | | | | |
| CONTIG4642 | 23468786_f3_7 | 10625 | 24728 | 270 | 90 | | | | | |
| CONTIG4642 | 25397135_c2_9 | 10626 | 24729 | 186 | 62 | | | | | |
| CONTIG4643 | 4064186_f2_3 | 10627 | 24730 | 294 | 98 | | | | | |
| CONTIG4643 | 2773428_c3_7 | 10628 | 24731 | 225 | 75 | | | | | |
| CONTIG4644 | 26853527_f1_1 | 10629 | 24732 | 228 | 76 | | | | | |
| CONTIG4644 | 26368818_f3_7 | 10630 | 24733 | 1806 | 602 | | | | | |
| CONTIG4644 | 20703930_c3_12 | 10631 | 24734 | 252 | 84 | | | | | |
| CONTIG4644 | 3994200_c3_13 | 10632 | 24735 | 186 | 62 | | | | | |
| CONTIG4645 | 6678467_f1_1 | 10633 | 24736 | 288 | 96 | | | | | |
| CONTIG4645 | 24422151_c1_7 | 10634 | 24737 | 273 | 91 | | | | | |
| CONTIG4647 | 23443761_f2_2 | 10635 | 24738 | 258 | 86 | | | | | |
| CONTIG4647 | 5292812_f2_3 | 10636 | 24739 | 243 | 81 | | | | | |
| CONTIG4647 | 26287532_f3_6 | 10637 | 24740 | 255 | 85 | | | | | |
| CONTIG4647 | 11876300_c2_7 | 10638 | 24741 | 867 | 289 | | | | | |
| CONTIG4647 | 859680_c3_8 | 10639 | 24742 | 840 | 280 | | | | | |
| CONTIG4649 | 3912761_c2_8 | 10640 | 24743 | 222 | 74 | | | | | |
| CONTIG4650 | 21758462_f3_6 | 10641 | 24744 | 279 | 93 | | | | | |
| CONTIG4650 | 1284692_c1_7 | 10642 | 24745 | 213 | 71 | | | | | |
| CONTIG4650 | 19742706_c1_8 | 10643 | 24746 | 201 | 67 | | | | | |
| CONTIG4651 | 33831687_c3_5 | 10644 | 24747 | 348 | 116 | | | | | |
| CONTIG4652 | 7069687_f1_1 | 10645 | 24748 | 465 | 155 | | | | | |
| CONTIG4652 | 3520312_f2_3 | 10646 | 24749 | 204 | 68 | | | | | |
| CONTIG4652 | 24882188_f2_5 | 10647 | 24750 | 1008 | 336 | | | | | |
| CONTIG4653 | 7039182_f1_2 | 10648 | 24751 | 237 | 79 | | | | | |
| CONTIG4654 | 33401587_f3_7 | 10649 | 24752 | 219 | 73 | | | | | |
| CONTIG4657 | 1429657_c1_8 | 10650 | 24753 | 192 | 64 | | | | | |
| CONTIG4658 | 2933176_f1_1 | 10651 | 24754 | 393 | 131 | | | | | |
| CONTIG4659 | 4034635_f2_3 | 10652 | 24755 | 543 | 181 | | | | | |
| CONTIG4659 | 24022207_f3_5 | 10653 | 24756 | 192 | 64 | | | | | |
| CONTIG4659 | 6772075_c2_6 | 10654 | 24757 | 294 | 98 | | | | | |
| CONTIG4660 | 26594806_f3_7 | 10655 | 24758 | 963 | 321 | | | | | |
| CONTIG4661 | 25820875_c2_4 | 10656 | 24759 | 243 | 81 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4663 | 2439383_f1_1 | 10657 | 24760 | 348 | 116 | | | | | |
| CONTIG4663 | 26345452_f3_5 | 10658 | 24761 | 471 | 157 | | | | | |
| CONTIG4663 | 32289566_c1_10 | 10659 | 24762 | 195 | 65 | | | | | |
| CONTIG4663 | 29925662_c2_14 | 10660 | 24763 | 252 | 84 | | | | | |
| CONTIG4663 | 5959453_c3_15 | 10661 | 24764 | 237 | 79 | | | | | |
| CONTIG4664 | 23400_c2_7 | 10662 | 24765 | 261 | 87 | | | | | |
| CONTIG4665 | 36226661_c2_12 | 10663 | 24766 | 1752 | 584 | | | | | |
| CONTIG4666 | 24475676_f1_3 | 10664 | 24767 | 213 | 71 | | | | | |
| CONTIG4666 | 32620691_c1_12 | 10665 | 24768 | 285 | 95 | | | | | |
| CONTIG4667 | 34049067_c3_10 | 10666 | 24769 | 204 | 68 | | | | | |
| CONTIG4668 | 551937_f1_1 | 10667 | 24770 | 183 | 61 | | | | | |
| CONTIG4668 | 1195186_c2_6 | 10668 | 24771 | 243 | 81 | | | | | |
| CONTIG4669 | 26041308_c2_6 | 10669 | 24772 | 186 | 62 | | | | | |
| CONTIG4669 | 26269625_c2_7 | 10670 | 24773 | 189 | 63 | | | | | |
| CONTIG467 | 33400317_c3_1 | 10671 | 24774 | 678 | 226 | | | | | |
| CONTIG4670 | 14276437_f1_2 | 10672 | 24775 | 495 | 165 | | | | | |
| CONTIG4670 | 25520275_c1_7 | 10673 | 24776 | 228 | 76 | | | | | |
| CONTIG4671 | 10978377_f2_1 | 10674 | 24777 | 324 | 108 | | | | | |
| CONTIG4671 | 20595178_f3_3 | 10675 | 24778 | 192 | 64 | | | | | |
| CONTIG4671 | 23867177_c3_12 | 10676 | 24779 | 219 | 73 | | | | | |
| CONTIG4672 | 9772578_f3_4 | 10677 | 24780 | 189 | 63 | | | | | |
| CONTIG4673 | 22063426_c2_7 | 10678 | 24781 | 237 | 79 | | | | | |
| CONTIG4673 | 6851413_c3_10 | 10679 | 24782 | 204 | 68 | | | | | |
| CONTIG4676 | 26350317_f3_2 | 10680 | 24783 | 273 | 91 | | | | | |
| CONTIG4676 | 10272590_f3_3 | 10681 | 24784 | 186 | 62 | | | | | |
| CONTIG4676 | 25398318_c3_7 | 10682 | 24785 | 186 | 62 | | | | | |
| CONTIG4678 | 14726502_f3_6 | 10683 | 24786 | 189 | 63 | | | | | |
| CONTIG4680 | 6908280_f2_3 | 10684 | 24787 | 195 | 65 | | | | | |
| CONTIG4680 | 14161511_f2_4 | 10685 | 24788 | 216 | 72 | | | | | |
| CONTIG4680 | 21662938_c2_10 | 10686 | 24789 | 909 | 31 | | | | | |
| CONTIG4680 | 26658510_c2_11 | 10687 | 24790 | 1074 | 358 | | | | | |
| CONTIG4681 | 13775302_c3_3 | 10688 | 24791 | 216 | 72 | | | | | |
| CONTIG4682 | 20595252_f2_2 | 10689 | 24792 | 183 | 61 | | | | | |
| CONTIG4682 | 25581377_f3_5 | 10690 | 24793 | 240 | 80 | | | | | |
| CONTIG4683 | 4300002_f3_2 | 10691 | 24794 | 204 | 68 | | | | | |
| CONTIG4686 | 2037807_f1_2 | 10692 | 24795 | 234 | 78 | | | | | |
| CONTIG4686 | 2070378_f3_4 | 10693 | 24796 | 183 | 61 | | | | | |
| CONTIG4686 | 14179218_c2_6 | 10694 | 24797 | 321 | 107 | | | | | |
| CONTIG4687 | 24313925_f3_7 | 10695 | 24798 | 504 | 168 | | | | | |
| CONTIG4687 | 2378762_c1_8 | 10696 | 24799 | 198 | 66 | | | | | |
| CONTIG4688 | 19707632_c1_6 | 10697 | 24800 | 294 | 98 | | | | | |
| CONTIG4688 | 10162937_c1_7 | 10698 | 24801 | 186 | 62 | | | | | |
| CONTIG4689 | 35673427_f3_6 | 10699 | 24802 | 189 | 63 | | | | | |
| CONTIG4690 | 36574038_f3_4 | 10700 | 24803 | 228 | 76 | | | | | |
| CONTIG4690 | 4064400_c1_6 | 10701 | 24804 | 387 | 129 | | | | | |
| CONTIG4690 | 21721906_c2_8 | 10702 | 24805 | 198 | 66 | | | | | |
| CONTIG4691 | 24485912_f2_3 | 10703 | 24806 | 342 | 114 | | | | | |
| CONTIG4692 | 6093783_c2_6 | 10704 | 24807 | 243 | 81 | | | | | |
| CONTIG4693 | 25390718_c2_3 | 10705 | 24808 | 204 | 68 | | | | | |

| Contig | Orf | ntID | aaID | nt Length | aa Length | Blast Score | Blast Probability | Subject Name | Subject Taxonomy | Subject Definition |
|---|---|---|---|---|---|---|---|---|---|---|
| CONTIG4694 | 23642126_f2_2 | 10706 | 24809 | 1980 | 660 | | | | | |
| CONTIG4695 | 2915807_f1_1 | 10707 | 24810 | 258 | 86 | | | | | |
| CONTIG4695 | 25414501_f2_3 | 10708 | 24811 | 294 | 98 | | | | | |
| CONTIG4695 | 33398390_f3_4 | 10709 | 24812 | 189 | 63 | | | | | |
| CONTIG4695 | 34062510_f3_5 | 10710 | 24813 | 204 | 68 | | | | | |
| CONTIG4695 | 19970375_c3_8 | 10711 | 24814 | 282 | 94 | | | | | |
| CONTIG4696 | 6752202_f3_5 | 10712 | 24815 | 306 | 102 | | | | | |
| CONTIG4696 | 3242816_c1_6 | 10713 | 24816 | 249 | 83 | | | | | |
| CONTIG4698 | 35156550_c1_3 | 10714 | 24817 | 213 | 71 | | | | | |
| CONTIG4698 | 822181_c1_4 | 10715 | 24818 | 228 | 76 | | | | | |
| CONTIG4699 | 19726562_f2_3 | 10716 | 24819 | 183 | 61 | | | | | |
| CONTIG4699 | 15938_f2_4 | 10717 | 24820 | 219 | 73 | | | | | |
| CONTIG47 | 23929512_f2_3 | 10718 | 24821 | 276 | 92 | | | | | |
| CONTIG47 | 3183587_c2_7 | 10719 | 24822 | 198 | 66 | | | | | |
| CONTIG470 | 2869788_f1_1 | 10720 | 24823 | 690 | 230 | | | | | |
| CONTIG4700 | 36610890_f3_5 | 10721 | 24824 | 204 | 68 | | | | | |
| CONTIG4701 | 26359385_c1_6 | 10722 | 24825 | 351 | 117 | | | | | |
| CONTIG4701 | 20194375_c3_13 | 10723 | 24826 | 222 | 74 | | | | | |
| CONTIG4703 | 2381300_f2_3 | 10724 | 24827 | 246 | 82 | | | | | |
| CONTIG4703 | 31906517_f2_6 | 10725 | 24828 | 213 | 71 | | | | | |
| CONTIG4703 | 12578130_f3_7 | 10726 | 24829 | 216 | 72 | | | | | |
| CONTIG4704 | 1048280_c2_7 | 10727 | 24830 | 888 | 296 | | | | | |
| CONTIG4705 | 23634510_f3_5 | 10728 | 24831 | 690 | 230 | | | | | |
| CONTIG4706 | 22048176_f1_1 | 10729 | 24832 | 435 | 145 | | | | | |
| CONTIG4707 | 19584410_f1_1 | 10730 | 24833 | 246 | 82 | | | | | |
| CONTIG4707 | 26839217_c2_6 | 10731 | 24834 | 195 | 65 | | | | | |
| CONTIG4707 | 24008385_c3_8 | 10732 | 24835 | 930 | 310 | | | | | |
| CONTIG4708 | 23515905_c2_4 | 10733 | 24836 | 243 | 81 | | | | | |
| CONTIG4709 | 14259688_f3_9 | 10734 | 24837 | 270 | 90 | | | | | |
| CONTIG471 | 23535938_f2_1 | 10735 | 24838 | 291 | 97 | | | | | |
| CONTIG4710 | 7304543_f1_1 | 10736 | 24839 | 183 | 61 | | | | | |
| CONTIG4710 | 33798562_c3_5 | 10737 | 24840 | 294 | 98 | | | | | |
| CONTIG4710 | 21995462_c3_7 | 10738 | 24841 | 585 | 195 | | | | | |
| CONTIG4712 | 40750_f2_2 | 10739 | 24842 | 198 | 66 | | | | | |
| CONTIG4713 | 33437880_c2_6 | 10740 | 24843 | 324 | 108 | | | | | |
| CONTIG4714 | 10820307_f3_5 | 10741 | 24844 | 297 | 99 | | | | | |
| CONTIG4714 | 23625000_c1_6 | 10742 | 24845 | 207 | 69 | | | | | |
| CONTIG4715 | 2928275_c1_7 | 10743 | 24846 | 369 | 123 | | | | | |
| CONTIG4715 | 663567_f2_4 | 10744 | 24847 | 216 | 72 | | | | | |
| CONTIG4715 | 15914193_f3_8 | 10745 | 24848 | 198 | 66 | | | | | |
| CONTIG4716 | 25390701_f1_3 | 10746 | 24849 | 210 | 70 | | | | | |
| CONTIG4716 | 24004752_f3_6 | 10747 | 24850 | 192 | 64 | | | | | |
| CONTIG4716 | 14628127_c1_8 | 10748 | 24851 | 297 | 99 | | | | | |
| CONTIG4717 | 33245255_c2_6 | 10749 | 24852 | 243 | 81 | | | | | |
| CONTIG4720 | 116588_f1_1 | 10750 | 24853 | 333 | 111 | | | | | |
| CONTIG4720 | 1438826_f2_3 | 10751 | 24854 | 294 | 98 | | | | | |
| CONTIG4720 | 32226562_c1_9 | 10752 | 24855 | 198 | 66 | | | | | |
| CONTIG4720 | 3017287_c2_10 | 10753 | 24856 | 906 | 302 | | | | | |
| CONTIG4722 | 26214192_f2_2 | 10754 | 24857 | 279 | 93 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4722 | 17041563_c2_7 | 10755 | 24858 | 198 | 66 | | | | | |
| CONTIG4722 | 10725005_c3_10 | 10756 | 24859 | 189 | 63 | | | | | |
| CONTIG4724 | 5937660_f2_2 | 10757 | 24860 | 375 | 125 | | | | | |
| CONTIG4724 | 36220656_f2_3 | 10758 | 24861 | 246 | 82 | | | | | |
| CONTIG4725 | 24226553_f2_3 | 10759 | 24862 | 225 | 75 | | | | | |
| CONTIG4726 | 24298432_f2_2 | 10760 | 24863 | 186 | 62 | | | | | |
| CONTIG4726 | 3313825_f2_3 | 10761 | 24864 | 570 | 190 | | | | | |
| CONTIG4727 | 3323762_f2_2 | 10762 | 24865 | 261 | 87 | | | | | |
| CONTIG4728 | 4492303_c2_8 | 10763 | 24866 | 822 | 274 | | | | | |
| CONTIG4728 | 35157000_c2_11 | 10764 | 24867 | 282 | 94 | | | | | |
| CONTIG4728 | 34274188_c3_14 | 10765 | 24868 | 753 | 251 | | | | | |
| CONTIG4729 | 24414042_c1_7 | 10766 | 24869 | 513 | 171 | | | | | |
| CONTIG4729 | 35943775_c3_13 | 10767 | 24870 | 261 | 87 | | | | | |
| CONTIG4730 | 24722817_f3_6 | 10768 | 24871 | 294 | 98 | | | | | |
| CONTIG4731 | 5266890_f1_2 | 10769 | 24872 | 297 | 99 | | | | | |
| CONTIG4731 | 16803177_f2_6 | 10770 | 24873 | 204 | 68 | | | | | |
| CONTIG4731 | 2829427_c1_11 | 10771 | 24874 | 609 | 203 | | | | | |
| CONTIG4732 | 21570262_f1_3 | 10772 | 24875 | 207 | 69 | | | | | |
| CONTIG4732 | 4425805_f2_5 | 10773 | 24876 | 201 | 67 | | | | | |
| CONTIG4733 | 4339688_f1_1 | 10774 | 24877 | 183 | 61 | | | | | |
| CONTIG4733 | 178528_f2_3 | 10775 | 24878 | 417 | 139 | | | | | |
| CONTIG4734 | 21890902_c2_8 | 10776 | 24879 | 255 | 85 | | | | | |
| CONTIG4734 | 5163180_c2_9 | 10777 | 24880 | 243 | 81 | | | | | |
| CONTIG4736 | 21673300_f2_3 | 10778 | 24881 | 759 | 253 | | | | | |
| CONTIG4738 | 24033_f1_2 | 10779 | 24882 | 201 | 67 | | | | | |
| CONTIG4738 | 32109457_c2_7 | 10780 | 24883 | 234 | 78 | | | | | |
| CONTIG4738 | 22300262_c2_8 | 10781 | 24884 | 315 | 105 | | | | | |
| CONTIG4739 | 2034403_c3_5 | 10782 | 24885 | 201 | 67 | | | | | |
| CONTIG4740 | 22850053_f2_7 | 10783 | 24886 | 186 | 62 | | | | | |
| CONTIG4742 | 19648385_f2_2 | 10784 | 24887 | 702 | 234 | | | | | |
| CONTIG4742 | 4070938_c3_9 | 10785 | 24888 | 258 | 86 | | | | | |
| CONTIG4743 | 36570311_f1_1 | 10786 | 24889 | 225 | 75 | | | | | |
| CONTIG4743 | 35972153_f1_2 | 10787 | 24890 | 219 | 73 | | | | | |
| CONTIG4744 | 29922180_c3_8 | 10788 | 24891 | 195 | 65 | | | | | |
| CONTIG4745 | 26444562_c3_6 | 10789 | 24892 | 261 | 87 | | | | | |
| CONTIG4745 | 26444807_f2_2 | 10790 | 24893 | 198 | 66 | | | | | |
| CONTIG4746 | 14253805_f3_4 | 10791 | 24894 | 252 | 84 | | | | | |
| CONTIG4746 | 26912513_c3_12 | 10792 | 24895 | 483 | 161 | | | | | |
| CONTIG4746 | 15627015_c3_13 | 10793 | 24896 | 198 | 66 | | | | | |
| CONTIG4747 | 24401410_f1_3 | 10794 | 24897 | 192 | 64 | | | | | |
| CONTIG4748 | 5865918_f3_4 | 10795 | 24898 | 282 | 94 | | | | | |
| CONTIG4748 | 24433535_c1_8 | 10796 | 24899 | 237 | 79 | | | | | |
| CONTIG475 | 10761078_c2_1 | 10797 | 24900 | 186 | 62 | | | | | |
| CONTIG4750 | 23629450_f2_4 | 10798 | 24901 | 201 | 67 | | | | | |
| CONTIG4753 | 12112877_f1_2 | 10799 | 24902 | 249 | 83 | | | | | |
| CONTIG4754 | 32038937_f1_1 | 10800 | 24903 | 219 | 73 | | | | | |
| CONTIG4754 | 22317055_c3_7 | 10801 | 24904 | 186 | 62 | | | | | |
| CONTIG4756 | 11814425_f2_3 | 10802 | 24905 | 204 | 68 | | | | | |
| CONTIG4756 | 836638_c1_11 | 10803 | 24906 | 357 | 119 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG4757 | 4095052_c2_6 | 10804 | 24907 | 204 | 68 | | | | | |
| CONTIG4757 | 24022825_c3_8 | 10805 | 24908 | 228 | 76 | | | | | |
| CONTIG4759 | 34160783_f2_6 | 10806 | 24909 | 297 | 99 | | | | | |
| CONTIG4759 | 15930_c2_14 | 10807 | 24910 | 990 | 330 | | | | | |
| CONTIG476 | 13851630_c3_1 | 10808 | 24911 | 555 | 185 | | | | | |
| CONTIG4760 | 23836052_f3_2 | 10809 | 24912 | 225 | 75 | | | | | |
| CONTIG4761 | 24395305_f3_3 | 10810 | 24913 | 222 | 74 | | | | | |
| CONTIG4761 | 21673825_f3_4 | 10811 | 24914 | 264 | 88 | | | | | |
| CONTIG4762 | 12988307_f2_2 | 10812 | 24915 | 354 | 118 | | | | | |
| CONTIG4762 | 23835408_f3_7 | 10813 | 24916 | 279 | 93 | | | | | |
| CONTIG4762 | 14848427_f3_8 | 10814 | 24917 | 534 | 178 | | | | | |
| CONTIG4762 | 5129681_f3_9 | 10815 | 24918 | 213 | 71 | | | | | |
| CONTIG4763 | 2735890_f1_2 | 10816 | 24919 | 336 | 112 | | | | | |
| CONTIG4764 | 20431588_c3_8 | 10817 | 24920 | 312 | 104 | | | | | |
| CONTIG4764 | 197000_c3_13 | 10818 | 24921 | 186 | 62 | | | | | |
| CONTIG4765 | 14251561_c2_6 | 10819 | 24922 | 204 | 68 | | | | | |
| CONTIG4765 | 429561_f1_1 | 10820 | 24923 | 369 | 123 | | | | | |
| CONTIG4765 | 8406313_c3_9 | 10821 | 24924 | 186 | 62 | | | | | |
| CONTIG4765 | 21492755_c3_10 | 10822 | 24925 | 1407 | 469 | | | | | |
| CONTIG164766 | 5877300_f2_3 | 10823 | 24926 | 219 | 73 | | | | | |
| CONTIG4766 | 14251561_c2_6 | 10824 | 24927 | 192 | 64 | | | | | |
| CONTIG4767 | 14744000_c3_7 | 10825 | 24928 | 669 | 223 | | | | | |
| CONTIG4769 | 13942887_c2_9 | 10826 | 24929 | 276 | 92 | | | | | |
| CONTIG4770 | 24239425_f2_3 | 10827 | 24930 | 183 | 61 | | | | | |
| CONTIG4771 | 4017751_f2_3 | 12578 | 26681 | 1497 | 499 | | | | | |
| CONTIG5615 | 6640686_f3_15 | 12579 | 26682 | 186 | 62 | | | | | |
| CONTIG5615 | 24892317_c3_24 | 12580 | 26683 | 405 | 135 | | | | | |
| CONTIG5616 | 29320206_f2_8 | 12581 | 26684 | 201 | 67 | | | | | |
| CONTIG5616 | 22283128_c1_19 | 12582 | 26685 | 255 | 85 | | | | | |
| CONTIG5616 | 15902206_c1_21 | 12583 | 26686 | 294 | 98 | | | | | |
| CONTIG5616 | 13785055_c2_28 | 12584 | 26687 | 258 | 86 | | | | | |
| CONTIG5616 | 34553582_c2_30 | 12585 | 26688 | 507 | 169 | | | | | |
| CONTIG5616 | 16600282_c2_31 | 12586 | 26689 | 765 | 255 | | | | | |
| CONTIG5616 | 4709507_c3_34 | 12587 | 26690 | 336 | 112 | | | | | |
| CONTIG5617 | 2750391_c3_35 | 12588 | 26691 | 339 | 113 | | | | | |
| CONTIG5617 | 25626890_f2_3 | 12589 | 26692 | 1854 | 618 | | | | | |
| CONTIG5618 | 4704652_f3_5 | 12590 | 26693 | 333 | 111 | | | | | |
| CONTIG5618 | 23632877_f1_1 | 12591 | 26694 | 192 | 64 | | | | | |
| CONTIG5618 | 23600042_c2_22 | 12592 | 26695 | 366 | 122 | | | | | |
| CONTIG5619 | 25478377_c3_29 | 12593 | 26696 | 195 | 65 | | | | | |
| CONTIG5620 | 7832_f1_4 | 12594 | 26697 | 345 | 115 | | | | | |
| CONTIG5620 | 156461_f3_7 | 12595 | 26698 | 231 | 77 | | | | | |
| CONTIG5620 | 24304587_c1_11 | 12596 | 26699 | 1182 | 394 | | | | | |
| CONTIG5621 | 23835902_c2_16 | 12597 | 26700 | 249 | 83 | | | | | |
| CONTIG5622 | 2756510_f1_1 | 12598 | 26701 | 237 | 79 | | | | | |
| CONTIG5623 | 814152_c1_12 | 12599 | 26702 | 207 | 69 | | | | | |
| CONTIG5623 | 20484630_c3_11 | 12600 | 26703 | 198 | 66 | | | | | |
| CONTIG5624 | 12990638_f2_5 | 12601 | 26704 | 186 | 62 | | | | | |
| CONTIG5625 | 34470775_f1_5 | 12602 | 26705 | 192 | 64 | | | | | |
| CONTIG5625 | 23648312_f2_12 | | | | | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5625 | 4100641_c2_22 | 12603 | 26706 | 189 | 63 | | | | | |
| CONTIG5625 | 2869193_c2_24 | 12604 | 26707 | 1995 | 665 | | | | | |
| CONTIG5625 | 4970337_c2_25 | 12605 | 26708 | 204 | 68 | | | | | |
| CONTIG5625 | 10682625_c3_27 | 12606 | 26709 | 237 | 79 | | | | | |
| CONTIG5626 | 21506962_f3_5 | 12607 | 26710 | 222 | 74 | | | | | |
| CONTIG5627 | 20709436_f2_4 | 12608 | 26711 | 267 | 89 | | | | | |
| CONTIG5627 | 20507752_c1_10 | 12609 | 26712 | 213 | 71 | | | | | |
| CONTIG5627 | 4798135_c3_11 | 12610 | 26713 | 1548 | 516 | | | | | |
| CONTIG5627 | 3160142_c3_13 | 12611 | 26714 | 276 | 92 | | | | | |
| CONTIG5628 | 34104687_f2_6 | 12612 | 26715 | 183 | 61 | | | | | |
| CONTIG5628 | 24074140_f3_9 | 12613 | 26716 | 216 | 72 | | | | | |
| CONTIG5628 | 395280_c2_13 | 12614 | 26717 | 393 | 131 | | | | | |
| CONTIG5628 | 11179637_c3_23 | 12615 | 26718 | 252 | 84 | | | | | |
| CONTIG5629 | 10752136_f2_6 | 12616 | 26719 | 363 | 121 | | | | | |
| CONTIG5629 | 161267_c3_20 | 12617 | 26720 | 240 | 80 | | | | | |
| CONTIG5629 | 3945377_f1_1 | 12618 | 26721 | 219 | 73 | | | | | |
| CONTIG563 | 24398425_c2_4 | 12619 | 26722 | 447 | 149 | | | | | |
| CONTIG5630 | 13673200_f1_1 | 12620 | 26723 | 201 | 67 | | | | | |
| CONTIG5630 | 35323378_f3_7 | 12621 | 26724 | 204 | 68 | | | | | |
| CONTIG5630 | 14500138_c3_21 | 12622 | 26725 | 786 | 262 | | | | | |
| CONTIG5630 | 664507_c3_22 | 12623 | 26726 | 543 | 181 | | | | | |
| CONTIG5631 | 24414707_f1_1 | 12624 | 26727 | 303 | 101 | | | | | |
| CONTIG5631 | 30712642_f2_4 | 12625 | 26728 | 1953 | 651 | | | | | |
| CONTIG5631 | 21692300_c1_9 | 12626 | 26729 | 210 | 70 | | | | | |
| CONTIG5631 | 2050062_c2_10 | 12627 | 26730 | 528 | 176 | | | | | |
| CONTIG5631 | 21878540_c3_13 | 12628 | 26731 | 1224 | 408 | | | | | |
| CONTIG5633 | 13859517_c1_12 | 12629 | 26732 | 420 | 140 | | | | | |
| CONTIG5633 | 14353562_c2_15 | 12630 | 26733 | 1476 | 492 | | | | | |
| CONTIG5633 | 37503_c3_18 | 12631 | 26734 | 246 | 82 | | | | | |
| CONTIG5634 | 164678_c3_28 | 12632 | 26735 | 255 | 85 | | | | | |
| CONTIG5635 | 11737887_c3_19 | 12633 | 26736 | 405 | 135 | | | | | |
| CONTIG5636 | 24407802_f3_5 | 12634 | 26737 | 315 | 105 | | | | | |
| CONTIG5637 | 4725892_f2_5 | 12635 | 26738 | 186 | 62 | | | | | |
| CONTIG5637 | 2421943_c1_13 | 12636 | 26739 | 252 | 84 | | | | | |
| CONTIG5637 | 22360675_c1_18 | 12637 | 26740 | 294 | 98 | | | | | |
| CONTIG5637 | 15024215_c2_20 | 12638 | 26741 | 222 | 74 | | | | | |
| CONTIG5638 | 437913_f1_1 | 12639 | 26742 | 186 | 62 | | | | | |
| CONTIG5638 | 12511300_f2_8 | 12640 | 26743 | 510 | 170 | | | | | |
| CONTIG5638 | 23992630_f2_9 | 12641 | 26744 | 219 | 73 | | | | | |
| CONTIG5638 | 236260_f2_10 | 12642 | 26745 | 207 | 69 | | | | | |
| CONTIG5639 | 9945303_c1_13 | 12643 | 26746 | 186 | 62 | | | | | |
| CONTIG5639 | 31836090_c2_17 | 12644 | 26747 | 324 | 108 | | | | | |
| CONTIG5639 | 10269660_c3_20 | 12645 | 26748 | 1017 | 339 | | | | | |
| CONTIG5639 | 25815637_c3_22 | 12646 | 26749 | 957 | 319 | | | | | |
| CONTIG5639 | 23439393_c3_23 | 12647 | 26750 | 246 | 82 | | | | | |
| CONTIG564 | 24626562_c3_3 | 12648 | 26751 | 183 | 61 | | | | | |
| CONTIG5640 | 421903_c3_13 | 12649 | 26752 | 183 | 61 | | | | | |
| CONTIG5641 | 14656516_c1_11 | 12650 | 26753 | 831 | 277 | | | | | |
| CONTIG5641 | 10975386_c3_16 | 12651 | 26754 | 186 | 62 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5642 | 110136_f1_1 | 12652 | 26755 | 279 | 93 | | | | | |
| CONTIG5642 | 4303425_f3_6 | 12653 | 26756 | 252 | 84 | | | | | |
| CONTIG5642 | 22519063_c3_23 | 12654 | 26757 | 201 | 67 | | | | | |
| CONTIG5643 | 35401660_f1_2 | 12655 | 26758 | 204 | 68 | | | | | |
| CONTIG5643 | 20095015_f1_3 | 12656 | 26759 | 1206 | 402 | | | | | |
| CONTIG5643 | 9813837_f2_5 | 12657 | 26760 | 273 | 91 | | | | | |
| CONTIG5643 | 288128_f2_6 | 12658 | 26761 | 183 | 61 | | | | | |
| CONTIG5643 | 1369062_f2_7 | 12659 | 26762 | 897 | 299 | | | | | |
| CONTIG5643 | 12890675_f2_11 | 12660 | 26763 | 279 | 93 | | | | | |
| CONTIG5643 | 23900627_c1_20 | 12661 | 26764 | 225 | 75 | | | | | |
| CONTIG5643 | 34259632_c2_26 | 12662 | 26765 | 471 | 157 | | | | | |
| CONTIG5643 | 25390052_c3_31 | 12663 | 26766 | 204 | 68 | | | | | |
| CONTIG5643 | 15835882_c3_32 | 12664 | 26767 | 297 | 99 | | | | | |
| CONTIG5644 | 13757906_f3_10 | 12665 | 26768 | 258 | 86 | | | | | |
| CONTIG5644 | 14885900_f3_11 | 12666 | 26769 | 279 | 93 | | | | | |
| CONTIG5644 | 16522588_f3_12 | 12667 | 26770 | 186 | 62 | | | | | |
| CONTIG5645 | 2929687_f2_6 | 12668 | 26771 | 207 | 69 | | | | | |
| CONTIG5646 | 24254451_f2_13 | 12669 | 26772 | 207 | 69 | | | | | |
| CONTIG5646 | 22376400_c2_15 | 12670 | 26773 | 216 | 72 | | | | | |
| CONTIG5647 | 4069068_f1_5 | 12671 | 26774 | 264 | 88 | | | | | |
| CONTIG5647 | 1975050_f1_7 | 12672 | 26775 | 195 | 65 | | | | | |
| CONTIG5648 | 29879385_f1_3 | 12673 | 26776 | 333 | 111 | | | | | |
| CONTIG5648 | 14851632_f2_5 | 12674 | 26777 | 1140 | 380 | | | | | |
| CONTIG5648 | 4741292_f3_11 | 12675 | 26778 | 231 | 77 | | | | | |
| CONTIG5648 | 3131937_c1_14 | 12676 | 26779 | 318 | 106 | | | | | |
| CONTIG5648 | 29533140_c2_20 | 12677 | 26780 | 204 | 68 | | | | | |
| CONTIG5648 | 31369057_c3_21 | 12678 | 26781 | 318 | 106 | | | | | |
| CONTIG5648 | 16587807_c3_23 | 12679 | 26782 | 201 | 67 | | | | | |
| CONTIG5649 | 1381582_f1_5 | 12680 | 26783 | 183 | 61 | | | | | |
| CONTIG5649 | 2072018_f3_10 | 12681 | 26784 | 207 | 69 | | | | | |
| CONTIG5649 | 628438_f3_12 | 12682 | 26785 | 540 | 180 | | | | | |
| CONTIG5649 | 21523912_c2_17 | 12683 | 26786 | 183 | 61 | | | | | |
| CONTIG5650 | 14274132_f3_12 | 12684 | 26787 | 273 | 91 | | | | | |
| CONTIG5651 | 33369063_f1_3 | 12685 | 26788 | 228 | 76 | | | | | |
| CONTIG5651 | 26855302_c1_17 | 12686 | 26789 | 600 | 200 | | | | | |
| CONTIG5651 | 4892325_c1_18 | 12687 | 26790 | 1149 | 383 | | | | | |
| CONTIG5652 | 10401950_c3_30 | 12688 | 26791 | 357 | 119 | | | | | |
| CONTIG5652 | 13069211_f1_4 | 12689 | 26792 | 228 | 76 | | | | | |
| CONTIG5652 | 4095887_f3_14 | 12690 | 26793 | 510 | 170 | | | | | |
| CONTIG5652 | 19691086_c1_16 | 12691 | 26794 | 189 | 63 | | | | | |
| CONTIG5652 | 14538307_c1_18 | 12692 | 26795 | 189 | 63 | | | | | |
| CONTIG5652 | 4687555_c2_23 | 12693 | 26796 | 261 | 87 | | | | | |
| CONTIG5653 | 4805252_c1_15 | 12694 | 26797 | 747 | 249 | | | | | |
| CONTIG5653 | 14964427_c2_18 | 12695 | 26798 | 594 | 198 | | | | | |
| CONTIG5654 | 13850317_f1_1 | 12696 | 26799 | 231 | 77 | | | | | |
| CONTIG5654 | 14708135_f3_7 | 12697 | 26800 | 216 | 72 | | | | | |
| CONTIG5654 | 25984660_c1_9 | 12698 | 26801 | 285 | 95 | | | | | |
| CONTIG5655 | 6737890_c2_14 | 12699 | 26802 | 261 | 87 | | | | | |
| CONTIG5655 | 10651077_c2_15 | 12700 | 26803 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5655 | 21723792_c3_19 | 12701 | 26804 | 261 | 87 | | | | | |
| CONTIG5655 | 35429578_c3_20 | 12702 | 26805 | 330 | 110 | | | | | |
| CONTIG5655 | 22925152_c3_24 | 12703 | 26806 | 363 | 121 | | | | | |
| CONTIG5656 | 9768811_f1_1 | 12704 | 26807 | 336 | 112 | | | | | |
| CONTIG5656 | 25674002_f1_3 | 12705 | 26808 | 339 | 113 | | | | | |
| CONTIG5656 | 21516687_f2_4 | 12706 | 26809 | 711 | 237 | | | | | |
| CONTIG5656 | 4804142_f2_7 | 12707 | 26810 | 276 | 92 | | | | | |
| CONTIG5656 | 16443767_f3_11 | 12708 | 26811 | 303 | 101 | | | | | |
| CONTIG5657 | 36621088_f3_11 | 12709 | 26812 | 201 | 67 | | | | | |
| CONTIG5657 | 10726025_f3_13 | 12710 | 26813 | 1272 | 424 | | | | | |
| CONTIG5657 | 3131930_c1_14 | 12711 | 26814 | 195 | 65 | | | | | |
| CONTIG5657 | 24413902_c3_21 | 12712 | 26815 | 624 | 208 | | | | | |
| CONTIG5658 | 292842_f1_3 | 12713 | 26816 | 204 | 68 | | | | | |
| CONTIG5658 | 24304552_f1_5 | 12714 | 26817 | 204 | 68 | | | | | |
| CONTIG5658 | 30501261_c1_16 | 12715 | 26818 | 183 | 61 | | | | | |
| CONTIG5659 | 21537500_f1_4 | 12716 | 26819 | 189 | 63 | | | | | |
| CONTIG5659 | 6723407_f2_7 | 12717 | 26820 | 711 | 237 | | | | | |
| CONTIG5659 | 22656930_f3_15 | 12718 | 26821 | 186 | 62 | | | | | |
| CONTIG5659 | 16973300_c1_16 | 12719 | 26822 | 255 | 85 | | | | | |
| CONTIG5659 | 5361312_c2_24 | 12720 | 26823 | 186 | 62 | | | | | |
| CONTIG5659 | 12709502_c3_27 | 12721 | 26824 | 192 | 64 | | | | | |
| CONTIG5659 | 16444682_c3_28 | 12722 | 26825 | 684 | 228 | | | | | |
| CONTIG566 | 4718775_f1_1 | 12723 | 26826 | 252 | 84 | | | | | |
| CONTIG566 | 23861643_f1_2 | 12724 | 26827 | 183 | 61 | | | | | |
| CONTIG5660 | 1407762_f1_5 | 12725 | 26828 | 201 | 67 | | | | | |
| CONTIG5660 | 30741436_f3_10 | 12726 | 26829 | 243 | 81 | | | | | |
| CONTIG5660 | 10238408_c1_18 | 12727 | 26830 | 201 | 67 | | | | | |
| CONTIG5660 | 22304842_c2_20 | 12728 | 26831 | 201 | 67 | | | | | |
| CONTIG5661 | 167018_c1_8 | 12729 | 26832 | 240 | 80 | | | | | |
| CONTIG5661 | 12990638_c2_11 | 12730 | 26833 | 198 | 66 | | | | | |
| CONTIG5661 | 1953125_c2_13 | 12731 | 26834 | 183 | 61 | | | | | |
| CONTIG5662 | 2199015_f2_7 | 12732 | 26835 | 396 | 132 | | | | | |
| CONTIG5662 | 23907755_c3_12 | 12733 | 26836 | 573 | 191 | | | | | |
| CONTIG5663 | 22712625_f2_6 | 12734 | 26837 | 447 | 149 | | | | | |
| CONTIG5663 | 24415812_f2_8 | 12735 | 26838 | 183 | 61 | | | | | |
| CONTIG5663 | 37878_f3_10 | 12736 | 26839 | 579 | 193 | | | | | |
| CONTIG5663 | 1562_f3_11 | 12737 | 26840 | 201 | 67 | | | | | |
| CONTIG5664 | 4494027_f3_8 | 12738 | 26841 | 264 | 88 | | | | | |
| CONTIG5665 | 24414188_f3_5 | 12739 | 26842 | 198 | 66 | | | | | |
| CONTIG5665 | 36131437_f3_6 | 12740 | 26843 | 195 | 65 | | | | | |
| CONTIG5665 | 178877_c3_24 | 12741 | 26844 | 375 | 125 | | | | | |
| CONTIG5667 | 21659762_f3_6 | 12742 | 26845 | 306 | 102 | | | | | |
| CONTIG5667 | 10241328_f3_7 | 12743 | 26846 | 318 | 106 | | | | | |
| CONTIG5667 | 10241328_f3_8 | 12744 | 26847 | 264 | 88 | | | | | |
| CONTIG5667 | 16600806_c2_14 | 12745 | 26848 | 201 | 67 | | | | | |
| CONTIG5667 | 11819125_c2_15 | 12746 | 26849 | 267 | 89 | | | | | |
| CONTIG5667 | 2143755_c2_16 | 12747 | 26850 | 366 | 122 | | | | | |
| CONTIG5667 | 26457806_c2_17 | 12748 | 26851 | 330 | 110 | | | | | |
| CONTIG5668 | 34101687_f2_2 | 12749 | 26852 | 342 | 114 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5668 | 29489177_f2_4 | 12750 | 26853 | 384 | 128 | | | | | |
| CONTIG5668 | 3148317_f3_5 | 12751 | 26854 | 333 | 111 | | | | | |
| CONTIG5668 | 10750188_f3_6 | 12752 | 26855 | 378 | 126 | | | | | |
| CONTIG5668 | 10563175_c2_13 | 12753 | 26856 | 216 | 72 | | | | | |
| CONTIG5668 | 23444527_c3_14 | 12754 | 26857 | 336 | 112 | | | | | |
| CONTIG5668 | 1253160_c3_16 | 12755 | 26858 | 243 | 81 | | | | | |
| CONTIG5669 | 33757837_f1_1 | 12756 | 26859 | 264 | 88 | | | | | |
| CONTIG5669 | 11148308_f1_2 | 12757 | 26860 | 1323 | 441 | | | | | |
| CONTIG5669 | 23992051_f1_4 | 12758 | 26861 | 198 | 66 | | | | | |
| CONTIG5669 | 21522692_c3_29 | 12759 | 26862 | 204 | 68 | | | | | |
| CONTIG5669 | 9766541_c3_30 | 12760 | 26863 | 234 | 78 | | | | | |
| CONTIG567 | 23961542_f3_2 | 12761 | 26864 | 396 | 132 | | | | | |
| CONTIG5670 | 19537932_f1_1 | 12762 | 26865 | 312 | 104 | | | | | |
| CONTIG5670 | 35431925_f1_2 | 12763 | 26866 | 453 | 151 | | | | | |
| CONTIG5670 | 6140761_f2_7 | 12764 | 26867 | 453 | 151 | | | | | |
| CONTIG5670 | 24039062_f2_8 | 12765 | 26868 | 273 | 91 | | | | | |
| CONTIG5670 | 34261068_c2_29 | 12766 | 26869 | 258 | 86 | | | | | |
| CONTIG5670 | 958465_c3_35 | 12767 | 26870 | 195 | 65 | | | | | |
| CONTIG5671 | 23944003_f1_1 | 12768 | 26871 | 423 | 141 | | | | | |
| CONTIG5671 | 6095260_f1_2 | 12769 | 26872 | 312 | 104 | | | | | |
| CONTIG5671 | 14223251_f1_4 | 12770 | 26873 | 198 | 66 | | | | | |
| CONTIG5671 | 6363267_f1_5 | 12771 | 26874 | 1773 | 591 | | | | | |
| CONTIG5671 | 19569203_f2_6 | 12772 | 26875 | 216 | 72 | | | | | |
| CONTIG5672 | 24223408_f3_11 | 12773 | 26876 | 228 | 76 | | | | | |
| CONTIG5672 | 9800012_f3_14 | 12774 | 26877 | 234 | 78 | | | | | |
| CONTIG5672 | 21884467_c1_15 | 12775 | 26878 | 231 | 77 | | | | | |
| CONTIG5672 | 29725812_c2_20 | 12776 | 26879 | 333 | 111 | | | | | |
| CONTIG5672 | 11929011_c3_21 | 12777 | 26880 | 354 | 118 | | | | | |
| CONTIG5673 | 3923250_f1_2 | 12778 | 26881 | 183 | 61 | | | | | |
| CONTIG5673 | 24314037_f3_18 | 12779 | 26882 | 201 | 67 | | | | | |
| CONTIG5673 | 20203527_c1_26 | 12780 | 26883 | 225 | 75 | | | | | |
| CONTIG5673 | 32071965_c3_33 | 12781 | 26884 | 207 | 69 | | | | | |
| CONTIG5673 | 15736261_c3_45 | 12782 | 26885 | 183 | 61 | | | | | |
| CONTIG5674 | 29297000_f1_2 | 12783 | 26886 | 195 | 65 | | | | | |
| CONTIG5674 | 23860951_f1_3 | 12784 | 26887 | 219 | 73 | | | | | |
| CONTIG5674 | 21537682_f2_4 | 12785 | 26888 | 240 | 80 | | | | | |
| CONTIG5674 | 10970437_f2_5 | 12786 | 26889 | 1026 | 342 | | | | | |
| CONTIG5674 | 24642300_c1_11 | 12787 | 26890 | 2082 | 694 | | | | | |
| CONTIG5675 | 32141900_f2_6 | 12788 | 26891 | 636 | 212 | | | | | |
| CONTIG5675 | 21898261_f3_10 | 12789 | 26892 | 1674 | 558 | | | | | |
| CONTIG5675 | 20426553_f3_11 | 12790 | 26893 | 210 | 70 | | | | | |
| CONTIG5676 | 6683567_f2_9 | 12791 | 26894 | 336 | 112 | | | | | |
| CONTIG5676 | 9895413_f3_13 | 12792 | 26895 | 375 | 125 | | | | | |
| CONTIG5677 | 13854005_f1_6 | 12793 | 26896 | 186 | 62 | | | | | |
| CONTIG5677 | 31379050_f3_11 | 12794 | 26897 | 201 | 67 | | | | | |
| CONTIG5677 | 39062_c1_18 | 12795 | 26898 | 639 | 213 | | | | | |
| CONTIG5677 | 23834635_c1_22 | 12796 | 26899 | 279 | 93 | | | | | |
| CONTIG5678 | 23672202_f2_1 | 12797 | 26900 | 213 | 71 | | | | | |
| CONTIG5678 | 41062_f2_4 | 12798 | 26901 | 216 | 72 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5678 | 14550008_f3_7 | 12799 | 26902 | 249 | 83 | | | | | |
| CONTIG5678 | 10744676_c3_18 | 12800 | 26903 | 501 | 167 | | | | | |
| CONTIG5680 | 115950_f3_19 | 12801 | 26904 | 252 | 84 | | | | | |
| CONTIG5681 | 625_c1_9 | 12802 | 26905 | 471 | 157 | | | | | |
| CONTIG5682 | 4400426_f2_11 | 12803 | 26906 | 474 | 158 | | | | | |
| CONTIG5682 | 9954682_c1_19 | 12804 | 26907 | 378 | 126 | | | | | |
| CONTIG5683 | 25635075_f3_10 | 12805 | 26908 | 186 | 62 | | | | | |
| CONTIG5683 | 11985002_c1_13 | 12806 | 26909 | 183 | 61 | | | | | |
| CONTIG5684 | 5880261_c2_15 | 12807 | 26910 | 183 | 61 | | | | | |
| CONTIG5685 | 20421875_c2_9 | 12808 | 26911 | 1275 | 425 | | | | | |
| CONTIG5686 | 13790912_c1_18 | 12809 | 26912 | 288 | 96 | | | | | |
| CONTIG5686 | 20742010_c2_22 | 12810 | 26913 | 1428 | 476 | | | | | |
| CONTIG5687 | 878752_f3_14 | 12811 | 26914 | 264 | 88 | | | | | |
| CONTIG5687 | 2441557_c1_17 | 12812 | 26915 | 210 | 70 | | | | | |
| CONTIG5687 | 19803590_c2_19 | 12813 | 26916 | 219 | 73 | | | | | |
| CONTIG5687 | 34088906_c3_21 | 12814 | 26917 | 198 | 66 | | | | | |
| CONTIG5687 | 35804715_c3_22 | 12815 | 26918 | 249 | 83 | | | | | |
| CONTIG5687 | 11142517_c3_24 | 12816 | 26919 | 219 | 73 | | | | | |
| CONTIG5688 | 4487667_f2_7 | 12817 | 26920 | 423 | 141 | | | | | |
| CONTIG5688 | 24394677_c1_14 | 12818 | 26921 | 624 | 208 | | | | | |
| CONTIG5688 | 24259687_c2_19 | 12819 | 26922 | 270 | 90 | | | | | |
| CONTIG5688 | 10603468_c3_24 | 12820 | 26923 | 318 | 106 | | | | | |
| CONTIG5689 | 62_f1_1 | 12821 | 26924 | 483 | 161 | | | | | |
| CONTIG5690 | 2539525_f3_11 | 12822 | 26925 | 207 | 69 | | | | | |
| CONTIG5690 | 93763_f3_12 | 12823 | 26926 | 210 | 70 | | | | | |
| CONTIG5690 | 19539075_c1_15 | 12824 | 26927 | 222 | 74 | | | | | |
| CONTIG5690 | 3629412_c1_16 | 12825 | 26928 | 297 | 99 | | | | | |
| CONTIG5690 | 4726416_c1_17 | 12826 | 26929 | 294 | 98 | | | | | |
| CONTIG5690 | 26351535_c3_29 | 12827 | 26930 | 426 | 142 | | | | | |
| CONTIG5690 | 19697765_c3_30 | 12828 | 26931 | 195 | 65 | | | | | |
| CONTIG5691 | 34085907_c2_25 | 12829 | 26932 | 414 | 138 | | | | | |
| CONTIG5691 | 15739027_c2_26 | 12830 | 26933 | 312 | 104 | | | | | |
| CONTIG5691 | 13016450_c3_31 | 12831 | 26934 | 261 | 87 | | | | | |
| CONTIG5693 | 2317_f1_3 | 12832 | 26935 | 195 | 65 | | | | | |
| CONTIG5693 | 10548275_c1_14 | 12833 | 26936 | 204 | 68 | | | | | |
| CONTIG5693 | 23594680_c2_17 | 12834 | 26937 | 759 | 253 | | | | | |
| CONTIG5693 | 34179000_c3_20 | 12835 | 26938 | 264 | 88 | | | | | |
| CONTIG5694 | 11114200_c1_14 | 12836 | 26939 | 249 | 83 | | | | | |
| CONTIG5694 | 22460938_c1_15 | 12837 | 26940 | 204 | 68 | | | | | |
| CONTIG5694 | 24645300_c1_16 | 12838 | 26941 | 528 | 176 | | | | | |
| CONTIG5694 | 33834677_c3_24 | 12839 | 26942 | 216 | 72 | | | | | |
| CONTIG5695 | 33319425_f1_1 | 12840 | 26943 | 237 | 79 | | | | | |
| CONTIG5695 | 4332180_f2_6 | 12841 | 26944 | 330 | 110 | | | | | |
| CONTIG5695 | 975027_f3_9 | 12842 | 26945 | 240 | 80 | | | | | |
| CONTIG5695 | 6542575_c2_12 | 12843 | 26946 | 216 | 72 | | | | | |
| CONTIG5695 | 6054687_c2_14 | 12844 | 26947 | 198 | 66 | | | | | |
| CONTIG5695 | 3301512_c3_16 | 12845 | 26948 | 192 | 64 | | | | | |
| CONTIG5696 | 2626925_f2_4 | 12846 | 26949 | 198 | 66 | | | | | |
| CONTIG5696 | 9788300_f3_7 | 12847 | 26950 | 210 | 70 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5696 | 9788312_c1_13 | 12848 | 26951 | 1038 | 346 | | | | | |
| CONTIG5697 | 11725056_f1_1 | 12849 | 26952 | 1179 | 393 | | | | | |
| CONTIG5697 | 10735301_f2_6 | 12850 | 26953 | 402 | 134 | | | | | |
| CONTIG5697 | 23632937_f3_8 | 12851 | 26954 | 279 | 93 | | | | | |
| CONTIG5697 | 31526957_f3_9 | 12852 | 26955 | 264 | 88 | | | | | |
| CONTIG5697 | 1986550_c1_15 | 12853 | 26956 | 198 | 66 | | | | | |
| CONTIG5697 | 6931677_c2_18 | 12854 | 26957 | 432 | 144 | | | | | |
| CONTIG5697 | 21753755_c2_20 | 12855 | 26958 | 369 | 123 | | | | | |
| CONTIG5697 | 26596928_c3_29 | 12856 | 26959 | 213 | 71 | | | | | |
| CONTIG5697 | 4018882_c3_30 | 12857 | 26960 | 186 | 62 | | | | | |
| CONTIG5705 | 26692758_f1_1 | 12893 | 26996 | 1251 | 417 | | | | | |
| CONTIG5705 | 35976703_c1_16 | 12894 | 26997 | 189 | 63 | | | | | |
| CONTIG5706 | 4688561_f1_5 | 12895 | 26998 | 231 | 77 | | | | | |
| CONTIG5706 | 26189801_f2_7 | 12896 | 26999 | 195 | 65 | | | | | |
| CONTIG5706 | 22457507_f2_8 | 12897 | 27000 | 201 | 67 | | | | | |
| CONTIG5706 | 24095313_c2_20 | 12898 | 27001 | 555 | 185 | | | | | |
| CONTIG5706 | 20704750_c2_22 | 12899 | 27002 | 219 | 73 | | | | | |
| CONTIG5706 | 33204806_c3_24 | 12900 | 27003 | 222 | 74 | | | | | |
| CONTIG5706 | 33439392_c3_26 | 12901 | 27004 | 204 | 68 | | | | | |
| CONTIG5707 | 22303381_f3_9 | 12902 | 27005 | 198 | 66 | | | | | |
| CONTIG5707 | 24878437_c1_15 | 12903 | 27006 | 198 | 66 | | | | | |
| CONTIG5708 | 14729642_f3_15 | 12904 | 27007 | 192 | 64 | | | | | |
| CONTIG5708 | 24641937_c2_23 | 12905 | 27008 | 303 | 101 | | | | | |
| CONTIG5708 | 969075_c3_25 | 12906 | 27009 | 192 | 64 | | | | | |
| CONTIG5708 | 16850433_c3_26 | 12907 | 27010 | 267 | 89 | | | | | |
| CONTIG5709 | 14234385_f1_1 | 12908 | 27011 | 204 | 68 | | | | | |
| CONTIG5710 | 600187_f1_1 | 12909 | 27012 | 351 | 117 | | | | | |
| CONTIG5710 | 56566_f3_7 | 12910 | 27013 | 189 | 63 | | | | | |
| CONTIG5710 | 12271886_c1_13 | 12911 | 27014 | 189 | 63 | | | | | |
| CONTIG5710 | 6062507_c3_22 | 12912 | 27015 | 234 | 78 | | | | | |
| CONTIG5711 | 14571011_c2_9 | 12913 | 27016 | 255 | 85 | | | | | |
| CONTIG5711 | 4006326_c3_15 | 12914 | 27017 | 702 | 234 | | | | | |
| CONTIG5712 | 194411_f1_3 | 12915 | 27018 | 255 | 85 | | | | | |
| CONTIG5712 | 6038317_f3_11 | 12916 | 27019 | 288 | 96 | | | | | |
| CONTIG5712 | 35788_f3_12 | 12917 | 27020 | 267 | 89 | | | | | |
| CONTIG5712 | 29695781_c2_20 | 12918 | 27021 | 267 | 89 | | | | | |
| CONTIG5712 | 1296926_c3_22 | 12919 | 27022 | 300 | 100 | | | | | |
| CONTIG5712 | 1173436_c3_25 | 12920 | 27023 | 1881 | 627 | | | | | |
| CONTIG5714 | 21770837_f1_1 | 12921 | 27024 | 231 | 77 | | | | | |
| CONTIG5714 | 24657927_c1_15 | 12922 | 27025 | 219 | 73 | | | | | |
| CONTIG5714 | 35781251_c3_22 | 12923 | 27026 | 192 | 64 | | | | | |
| CONTIG5714 | 863750_c3_24 | 12924 | 27027 | 231 | 77 | | | | | |
| CONTIG5715 | 33236256_f1_2 | 12925 | 27028 | 303 | 101 | | | | | |
| CONTIG5715 | 23524132_f3_6 | 12926 | 27029 | 207 | 69 | | | | | |
| CONTIG5715 | 204537_f3_7 | 12927 | 27030 | 237 | 79 | | | | | |
| CONTIG5698 | 14557812_f1_4 | 12858 | 26961 | 195 | 65 | | | | | |
| CONTIG5698 | 4022126_f1_5 | 12859 | 26962 | 225 | 75 | | | | | |
| CONTIG5698 | 6269068_f1_6 | 12860 | 26963 | 192 | 64 | | | | | |
| CONTIG5698 | 25655312_c1_17 | 12861 | 26964 | 381 | 127 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5698 | 6020801_c2_24 | 12862 | 26965 | 303 | 101 | | | | | |
| CONTIG5699 | 207943_c1_22 | 12863 | 26966 | 240 | 80 | | | | | |
| CONTIG5699 | 2425517_c1_24 | 12864 | 26967 | 258 | 86 | | | | | |
| CONTIG5700 | 11881253_f1_2 | 12865 | 26968 | 216 | 72 | | | | | |
| CONTIG5700 | 20804633_f1_3 | 12866 | 26969 | 483 | 161 | | | | | |
| CONTIG5700 | 23836002_f2_4 | 12867 | 26970 | 198 | 66 | | | | | |
| CONTIG5700 | 115687_f3_9 | 12868 | 26971 | 195 | 65 | | | | | |
| CONTIG5700 | 11015876_c1_18 | 12869 | 26972 | 234 | 78 | | | | | |
| CONTIG5700 | 3210933_c2_24 | 12870 | 26973 | 261 | 87 | | | | | |
| CONTIG5701 | 23633026_f2_4 | 12871 | 26974 | 195 | 65 | | | | | |
| CONTIG5701 | 34079686_c1_8 | 12872 | 26975 | 273 | 91 | | | | | |
| CONTIG5701 | 20583182_c1_9 | 12873 | 26976 | 270 | 90 | | | | | |
| CONTIG5701 | 4117837_c2_11 | 12874 | 26977 | 276 | 92 | | | | | |
| CONTIG5701 | 6023577_c3_14 | 12875 | 26978 | 204 | 68 | | | | | |
| CONTIG5701 | 6813900_c3_15 | 12876 | 26979 | 219 | 73 | | | | | |
| CONTIG5701 | 687_c3_17 | 12877 | 26980 | 252 | 84 | | | | | |
| CONTIG5703 | 21964141_f1_5 | 12878 | 26981 | 330 | 110 | | | | | |
| CONTIG5703 | 12301575_f1_6 | 12879 | 26982 | 270 | 90 | | | | | |
| CONTIG5703 | 20491627_f2_13 | 12880 | 26983 | 219 | 73 | | | | | |
| CONTIG5703 | 31751293_f2_14 | 12881 | 26984 | 192 | 64 | | | | | |
| CONTIG5703 | 15917932_f3_17 | 12882 | 26985 | 459 | 153 | | | | | |
| CONTIG5703 | 24667066_f3_22 | 12883 | 26986 | 303 | 101 | | | | | |
| CONTIG5703 | 957061_f3_23 | 12884 | 26987 | 225 | 75 | | | | | |
| CONTIG5703 | 33527_c2_33 | 12885 | 26988 | 225 | 75 | | | | | |
| CONTIG5703 | 26385962_c2_35 | 12886 | 26989 | 447 | 149 | | | | | |
| CONTIG5704 | 2682937_f1_1 | 12887 | 26990 | 294 | 98 | | | | | |
| CONTIG5704 | 14569408_f2_5 | 12888 | 26991 | 195 | 65 | | | | | |
| CONTIG5704 | 35167502_f2_6 | 12889 | 26992 | 198 | 66 | | | | | |
| CONTIG5704 | 13691965_f3_7 | 12890 | 26993 | 183 | 61 | | | | | |
| CONTIG5704 | 29477068_c2_16 | 12891 | 26994 | 219 | 73 | | | | | |
| CONTIG5704 | 2469006_c3_18 | 12892 | 26995 | 2019 | 673 | | | | | |
| CONTIG5715 | 26750952_c1_8 | 12928 | 27031 | 198 | 66 | | | | | |
| CONTIG5715 | 24273325_c2_17 | 12929 | 27032 | 246 | 82 | | | | | |
| CONTIG5716 | 25447183_c1_19 | 12930 | 27033 | 189 | 63 | | | | | |
| CONTIG5716 | 1962916_c2_24 | 12931 | 27034 | 294 | 98 | | | | | |
| CONTIG5716 | 23829125_c2_25 | 12932 | 27035 | 228 | 76 | | | | | |
| CONTIG5717 | 34182813_c3_19 | 12933 | 27036 | 564 | 188 | | | | | |
| CONTIG5718 | 3132636_f2_5 | 12934 | 27037 | 189 | 63 | | | | | |
| CONTIG5718 | 30084840_f2_7 | 12935 | 27038 | 210 | 70 | | | | | |
| CONTIG5719 | 19720150_f3_7 | 12936 | 27039 | 1635 | 545 | | | | | |
| CONTIG5719 | 19628956_f3_8 | 12937 | 27040 | 189 | 63 | | | | | |
| CONTIG5719 | 3931325_c1_9 | 12938 | 27041 | 195 | 65 | | | | | |
| CONTIG5719 | 20830378_c2_12 | 12939 | 27042 | 243 | 81 | | | | | |
| CONTIG5719 | 24398411_c3_17 | 12940 | 27043 | 210 | 70 | | | | | |
| CONTIG5719 | 34163952_c3_18 | 12941 | 27044 | 249 | 83 | | | | | |
| CONTIG572 | 13160953_f1_1 | 12942 | 27045 | 225 | 75 | | | | | |
| CONTIG5720 | 20986535_f1_1 | 12943 | 27046 | 207 | 69 | | | | | |
| CONTIG5720 | 26697180_f1_2 | 12944 | 27047 | 633 | 211 | | | | | |
| CONTIG5720 | 22851415_f3_11 | 12945 | 27048 | 693 | 231 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5720 | 16015625_c3_28 | 12946 | 27049 | 258 | 86 | | | | | |
| CONTIG5721 | 7039692_f2_3 | 12947 | 27050 | 255 | 85 | | | | | |
| CONTIG5721 | 24860007_f2_8 | 12948 | 27051 | 306 | 102 | | | | | |
| CONTIG5721 | 2790780_f3_11 | 12949 | 27052 | 219 | 73 | | | | | |
| CONTIG5721 | 2909430_f3_12 | 12950 | 27053 | 741 | 247 | | | | | |
| CONTIG5721 | 11807875_f3_15 | 12951 | 27054 | 555 | 185 | | | | | |
| CONTIG5721 | 42152_c1_19 | 12952 | 27055 | 213 | 71 | | | | | |
| CONTIG5721 | 24259506_c3_27 | 12953 | 27056 | 216 | 72 | | | | | |
| CONTIG5721 | 2402818_c1_11 | 12954 | 27057 | 189 | 63 | | | | | |
| CONTIG5722 | 29303425_c2_19 | 12955 | 27058 | 555 | 185 | | | | | |
| CONTIG5723 | 24241437_c1_20 | 12956 | 27059 | 183 | 61 | | | | | |
| CONTIG5723 | 24647875_c2_22 | 12957 | 27060 | 264 | 88 | | | | | |
| CONTIG5723 | 25396887_c3_33 | 12958 | 27061 | 198 | 66 | | | | | |
| CONTIG5723 | 35970636_c3_34 | 12959 | 27062 | 327 | 109 | | | | | |
| CONTIG5724 | 22292137_f3_11 | 12960 | 27063 | 201 | 67 | | | | | |
| CONTIG5724 | 9929652_c1_15 | 12961 | 27064 | 213 | 71 | | | | | |
| CONTIG5724 | 5972127_c1_19 | 12962 | 27065 | 228 | 76 | | | | | |
| CONTIG5724 | 11900015_c2_21 | 12963 | 27066 | 195 | 65 | | | | | |
| CONTIG5724 | 23612782_c2_22 | 12964 | 27067 | 1062 | 354 | | | | | |
| CONTIG5724 | 5267962_c2_23 | 12965 | 27068 | 552 | 184 | | | | | |
| CONTIG5724 | 35429578_c2_25 | 12966 | 27069 | 414 | 138 | | | | | |
| CONTIG5724 | 26756500_c3_28 | 12967 | 27070 | 198 | 66 | | | | | |
| CONTIG5725 | 20079517_f1_2 | 12968 | 27071 | 186 | 62 | | | | | |
| CONTIG5725 | 22444752_f1_3 | 12969 | 27072 | 195 | 65 | | | | | |
| CONTIG5725 | 21964140_f1_4 | 12970 | 27073 | 330 | 110 | | | | | |
| CONTIG5725 | 16820318_f2_5 | 12971 | 27074 | 282 | 94 | | | | | |
| CONTIG5725 | 24667066_f2_9 | 12972 | 27075 | 189 | 63 | | | | | |
| CONTIG5725 | 14259506_f3_12 | 12973 | 27076 | 360 | 120 | | | | | |
| CONTIG5725 | 22835781_f3_13 | 12974 | 27077 | 222 | 74 | | | | | |
| CONTIG5725 | 10570432_c2_23 | 12975 | 27078 | 183 | 61 | | | | | |
| CONTIG5726 | 24242177_f1_2 | 12976 | 27079 | 189 | 63 | | | | | |
| CONTIG5726 | 1406551_f3_14 | 12977 | 27080 | 216 | 72 | | | | | |
| CONTIG5726 | 24031336_c1_20 | 12978 | 27081 | 216 | 72 | | | | | |
| CONTIG5727 | 2757910_c2_26 | 12979 | 27082 | 183 | 61 | | | | | |
| CONTIG5727 | 2475277_f2_7 | 12980 | 27083 | 225 | 75 | | | | | |
| CONTIG5727 | 29718936_f2_8 | 12981 | 27084 | 222 | 74 | | | | | |
| CONTIG5727 | 4417640_f3_14 | 12982 | 27085 | 210 | 70 | | | | | |
| CONTIG5728 | 35156877_c3_31 | 12983 | 27086 | 213 | 71 | | | | | |
| CONTIG5728 | 14062760_f1_1 | 12984 | 27087 | 234 | 78 | | | | | |
| CONTIG5728 | 9773288_f1_2 | 12985 | 27088 | 327 | 109 | | | | | |
| CONTIG5728 | 14579975_f3_11 | 12986 | 27089 | 219 | 73 | | | | | |
| CONTIG5728 | 35359425_f3_12 | 12987 | 27090 | 237 | 79 | | | | | |
| CONTIG5728 | 10564031_c1_16 | 12988 | 27091 | 195 | 65 | | | | | |
| CONTIG5728 | 6145910_c2_19 | 12989 | 27092 | 222 | 74 | | | | | |
| CONTIG5728 | 878752_f2_5 | 12990 | 27093 | 282 | 94 | | | | | |
| CONTIG5729 | 10980181_f2_6 | 12991 | 27094 | 198 | 66 | | | | | |
| CONTIG5729 | 19652_f3_14 | 12992 | 27095 | 192 | 64 | | | | | |
| CONTIG5729 | 14297187_c1_18 | 12993 | 27096 | 237 | 79 | | | | | |
| CONTIG5729 | 30078411_c2_24 | 12994 | 27097 | 213 | 71 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5729 | 16191885_c3_32 | 12995 | 27098 | 189 | 63 | | | | | |
| CONTIG5729 | 24667066_c3_33 | 12996 | 27099 | 240 | 80 | | | | | |
| CONTIG5731 | 36610912_f1_2 | 12997 | 27100 | 198 | 66 | | | | | |
| CONTIG5731 | 24798432_f2_6 | 12998 | 27101 | 603 | 201 | | | | | |
| CONTIG5731 | 10553327_f2_8 | 12999 | 27102 | 321 | 107 | | | | | |
| CONTIG5731 | 11751251_f2_9 | 13000 | 27103 | 534 | 178 | | | | | |
| CONTIG5731 | 31489638_c3_28 | 13001 | 27104 | 273 | 91 | | | | | |
| CONTIG5732 | 24410927_f1_1 | 13002 | 27105 | 198 | 66 | | | | | |
| CONTIG5732 | 4111013_c2_28 | 13003 | 27106 | 372 | 124 | | | | | |
| CONTIG5732 | 4719011_c3_34 | 13004 | 27107 | 669 | 223 | | | | | |
| CONTIG5732 | 4103152_c2_21 | 13005 | 27108 | 330 | 110 | | | | | |
| CONTIG5733 | 172812_c3_28 | 13006 | 27109 | 201 | 67 | | | | | |
| CONTIG5733 | 23711001_c3_30 | 13007 | 27110 | 204 | 68 | | | | | |
| CONTIG5733 | 4104700_c3_34 | 13008 | 27111 | 318 | 106 | | | | | |
| CONTIG5734 | 14851527_f2_4 | 13009 | 27112 | 186 | 62 | | | | | |
| CONTIG5734 | 12500336_c1_8 | 13010 | 27113 | 378 | 126 | | | | | |
| CONTIG5734 | 29470157_c2_15 | 13011 | 27114 | 765 | 255 | | | | | |
| CONTIG5734 | 13679037_c3_18 | 13012 | 27115 | 186 | 62 | | | | | |
| CONTIG5735 | 22469582_f1_2 | 13013 | 27116 | 606 | 202 | | | | | |
| CONTIG5735 | 24422182_c1_12 | 13014 | 27117 | 303 | 101 | | | | | |
| CONTIG5735 | 2_c2_23 | 13015 | 27118 | 201 | 67 | | | | | |
| CONTIG5737 | 110125_f1_2 | 13016 | 27119 | 183 | 61 | | | | | |
| CONTIG5737 | 21641075_f2_6 | 13017 | 27120 | 273 | 91 | | | | | |
| CONTIG5739 | 35273411_c3_18 | 13018 | 27121 | 192 | 64 | | | | | |
| CONTIG5740 | 4898563_c2_24 | 13019 | 27122 | 276 | 92 | | | | | |
| CONTIG5741 | 24727187_f1_4 | 13020 | 27123 | 348 | 116 | | | | | |
| CONTIG5741 | 4720816_f2_7 | 13021 | 27124 | 267 | 89 | | | | | |
| CONTIG5741 | 548127_c1_14 | 13022 | 27125 | 204 | 68 | | | | | |
| CONTIG5741 | 6304713_c2_15 | 13023 | 27126 | 1422 | 474 | | | | | |
| CONTIG5741 | 21991563_c2_17 | 13024 | 27127 | 198 | 66 | | | | | |
| CONTIG5741 | 5285805_c3_18 | 13025 | 27128 | 750 | 250 | | | | | |
| CONTIG5742 | 31330025_c3_27 | 13026 | 27129 | 558 | 186 | | | | | |
| CONTIG5743 | 2531012_c3_30 | 13027 | 27130 | 210 | 70 | | | | | |
| CONTIG5743 | 3932775_f1_4 | 13028 | 27131 | 189 | 63 | | | | | |
| CONTIG5743 | 20431562_f2_7 | 13029 | 27132 | 183 | 61 | | | | | |
| CONTIG5743 | 22150075_f2_10 | 13030 | 27133 | 273 | 91 | | | | | |
| CONTIG5743 | 12375631_f3_13 | 13031 | 27134 | 429 | 143 | | | | | |
| CONTIG5743 | 10562761_c1_14 | 13032 | 27135 | 216 | 72 | | | | | |
| CONTIG5743 | 34157637_c2_22 | 13033 | 27136 | 594 | 198 | | | | | |
| CONTIG5743 | 35209700_c2_23 | 13034 | 27137 | 189 | 63 | | | | | |
| CONTIG5743 | 12925302_c2_24 | 13035 | 27138 | 198 | 66 | | | | | |
| CONTIG5743 | 4879025_c3_26 | 13036 | 27139 | 231 | 77 | | | | | |
| CONTIG5744 | 10947537_f1_7 | 13037 | 27140 | 297 | 99 | | | | | |
| CONTIG5744 | 26194000_f2_8 | 13038 | 27141 | 288 | 96 | | | | | |
| CONTIG5745 | 24613155_f1_2 | 13039 | 27142 | 192 | 64 | | | | | |
| CONTIG5745 | 26855326_c2_18 | 13040 | 27143 | 195 | 65 | | | | | |
| CONTIG5746 | 878752_f1_2 | 13041 | 27144 | 312 | 104 | | | | | |
| CONTIG5746 | 989162_f2_5 | 13042 | 27145 | 339 | 113 | | | | | |
| CONTIG5746 | 35804715_c1_13 | 13043 | 27146 | 249 | 83 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5746 | 21932625_c2_15 | 13044 | 27147 | 363 | 121 | | | | | |
| CONTIG5746 | 29493785_c2_18 | 13045 | 27148 | 201 | 67 | | | | | |
| CONTIG5747 | 26683428_f1_1 | 13046 | 27149 | 282 | 94 | | | | | |
| CONTIG5747 | 12584427_f2_22 | 13047 | 27150 | 192 | 64 | | | | | |
| CONTIG5748 | 30085913_f2_8 | 13048 | 27151 | 285 | 95 | | | | | |
| CONTIG5749 | 24414063_f2_6 | 13049 | 27152 | 288 | 96 | | | | | |
| CONTIG5749 | 9932311_c2_19 | 13050 | 27153 | 195 | 65 | | | | | |
| CONTIG5749 | 4978202_c3_27 | 13051 | 27154 | 222 | 74 | | | | | |
| CONTIG575 | 24688830_c3_1 | 13052 | 27155 | 255 | 85 | | | | | |
| CONTIG5750 | 40_f1_4 | 13053 | 27156 | 204 | 68 | | | | | |
| CONTIG5750 | 4151052_c1_14 | 13054 | 27157 | 234 | 78 | | | | | |
| CONTIG5751 | 11900015_f2_4 | 13055 | 27158 | 195 | 65 | | | | | |
| CONTIG5751 | 11900015_f3_6 | 13056 | 27159 | 195 | 65 | | | | | |
| CONTIG5751 | 3167325_f3_7 | 13057 | 27160 | 186 | 62 | | | | | |
| CONTIG5752 | 12538307_f1_3 | 13058 | 27161 | 195 | 65 | | | | | |
| CONTIG5752 | 2757930_c1_15 | 13059 | 27162 | 192 | 64 | | | | | |
| CONTIG5752 | 3157877_c2_21 | 13060 | 27163 | 1629 | 543 | | | | | |
| CONTIG5753 | 22289036_f1_1 | 13061 | 27164 | 255 | 85 | | | | | |
| CONTIG5753 | 13706557_f2_5 | 13062 | 27165 | 273 | 91 | | | | | |
| CONTIG5753 | 24035912_f2_6 | 13063 | 27166 | 315 | 105 | | | | | |
| CONTIG5753 | 24023326_f2_7 | 13064 | 27167 | 186 | 62 | | | | | |
| CONTIG5753 | 891937_f3_10 | 13065 | 27168 | 606 | 202 | | | | | |
| CONTIG5753 | 14882882_c3_24 | 13066 | 27169 | 183 | 61 | | | | | |
| CONTIG5754 | 14651430_f1_1 | 13067 | 27170 | 288 | 96 | | | | | |
| CONTIG5754 | 10964057_c1_22 | 13068 | 27171 | 561 | 187 | | | | | |
| CONTIG5754 | 29296875_c1_27 | 13069 | 27172 | 240 | 80 | | | | | |
| CONTIG5755 | 7035006_c2_31 | 13070 | 27173 | 207 | 69 | | | | | |
| CONTIG5755 | 24219082_f1_1 | 13071 | 27174 | 273 | 91 | | | | | |
| CONTIG5755 | 1181300_c3_17 | 13072 | 27175 | 204 | 68 | | | | | |
| CONTIG5755 | 9859393_c3_18 | 13073 | 27176 | 189 | 63 | | | | | |
| CONTIG5756 | 10548180_f1_6 | 13074 | 27177 | 732 | 244 | | | | | |
| CONTIG5756 | 5973453_c2_19 | 13075 | 27178 | 222 | 74 | | | | | |
| CONTIG5757 | 953936_f2_4 | 13076 | 27179 | 327 | 109 | | | | | |
| CONTIG5757 | 24007050_f3_6 | 13077 | 27180 | 204 | 68 | | | | | |
| CONTIG5758 | 14538927_f3_12 | 13078 | 27181 | 210 | 70 | | | | | |
| CONTIG5759 | 978128_f3_12 | 13079 | 27182 | 228 | 76 | | | | | |
| CONTIG5760 | 22689127_f3_18 | 13080 | 27183 | 273 | 91 | | | | | |
| CONTIG5760 | 2225925_c1_20 | 13081 | 27184 | 204 | 68 | | | | | |
| CONTIG5761 | 4152187_f3_11 | 13082 | 27185 | 222 | 74 | | | | | |
| CONTIG5761 | 4085931_c1_22 | 13083 | 27186 | 402 | 134 | | | | | |
| CONTIG5762 | 33137_f1_3 | 13084 | 27187 | 393 | 131 | | | | | |
| CONTIG5762 | 10594127_f3_18 | 13085 | 27188 | 198 | 66 | | | | | |
| CONTIG5762 | 11914078_c1_20 | 13086 | 27189 | 309 | 103 | | | | | |
| CONTIG5762 | 24408502_c1_25 | 13087 | 27190 | 204 | 68 | | | | | |
| CONTIG5762 | 26367837_c2_29 | 13088 | 27191 | 222 | 74 | | | | | |
| CONTIG5762 | 29489025_c2_31 | 13089 | 27192 | 243 | 81 | | | | | |
| CONTIG5763 | 26803436_f1_5 | 13090 | 27193 | 243 | 81 | | | | | |
| CONTIG5763 | 14851562_f2_8 | 13091 | 27194 | 231 | 77 | | | | | |
| CONTIG5763 | 3908313_c1_12 | 13092 | 27195 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5763 | 5268827_c1_18 | 13093 | 27196 | 198 | 66 | | | | | |
| CONTIG5764 | 35350088_f1_4 | 13094 | 27197 | 309 | 103 | | | | | |
| CONTIG5764 | 24297655_f2_7 | 13095 | 27198 | 234 | 78 | | | | | |
| CONTIG5764 | 11913875_f3_13 | 13096 | 27199 | 222 | 74 | | | | | |
| CONTIG5764 | 33289176_c1_20 | 13097 | 27200 | 186 | 62 | | | | | |
| CONTIG5764 | 4506910_c1_21 | 13098 | 27201 | 204 | 68 | | | | | |
| CONTIG5764 | 32089462_c2_29 | 13099 | 27202 | 192 | 64 | | | | | |
| CONTIG5764 | 12688886_c3_33 | 13100 | 27203 | 933 | 311 | | | | | |
| CONTIG5765 | 10579802_f1_3 | 13101 | 27204 | 315 | 105 | | | | | |
| CONTIG5765 | 4703587_f2_5 | 13102 | 27205 | 309 | 103 | | | | | |
| CONTIG5765 | 6642215_f2_10 | 13103 | 27206 | 192 | 64 | | | | | |
| CONTIG5765 | 3205006_f3_14 | 13104 | 27207 | 213 | 71 | | | | | |
| CONTIG5765 | 20191251_c1_23 | 13105 | 27208 | 213 | 71 | | | | | |
| CONTIG5765 | 24429642_c2_25 | 13106 | 27209 | 189 | 63 | | | | | |
| CONTIG5765 | 26620453_c3_29 | 13107 | 27210 | 1974 | 658 | | | | | |
| CONTIG5766 | 24081262_f1_3 | 13108 | 27211 | 213 | 71 | | | | | |
| CONTIG5766 | 978881_f2_15 | 13109 | 27212 | 207 | 69 | | | | | |
| CONTIG5766 | 158162_c2_27 | 13110 | 27213 | 228 | 76 | | | | | |
| CONTIG5766 | 6140751_c2_32 | 13111 | 27214 | 186 | 62 | | | | | |
| CONTIG5766 | 34157277_c3_34 | 13112 | 27215 | 240 | 80 | | | | | |
| CONTIG5766 | 4805340_c3_39 | 13113 | 27216 | 261 | 87 | | | | | |
| CONTIG5767 | 22054512_f1_3 | 13114 | 27217 | 840 | 280 | | | | | |
| CONTIG5767 | 24473390_c1_31 | 13115 | 27218 | 198 | 66 | | | | | |
| CONTIG5767 | 16051952_c1_38 | 13116 | 27219 | 330 | 110 | | | | | |
| CONTIG5767 | 2789765_c2_43 | 13117 | 27220 | 192 | 64 | | | | | |
| CONTIG5768 | 4034455_c1_18 | 13118 | 27221 | 282 | 94 | | | | | |
| CONTIG5768 | 19737875_c3_24 | 13119 | 27222 | 186 | 62 | | | | | |
| CONTIG5769 | 24256637_f1_2 | 13120 | 27223 | 309 | 103 | | | | | |
| CONTIG5769 | 156302_f3_9 | 13121 | 27224 | 192 | 64 | | | | | |
| CONTIG5769 | 1054687_c1_12 | 13122 | 27225 | 213 | 71 | | | | | |
| CONTIG5769 | 30353555_c2_15 | 13123 | 27226 | 228 | 76 | | | | | |
| CONTIG5769 | 24390887_c3_19 | 13124 | 27227 | 195 | 65 | | | | | |
| CONTIG5770 | 24257127_f1_4 | 13125 | 27228 | 210 | 70 | | | | | |
| CONTIG5770 | 30485250_f1_6 | 13126 | 27229 | 207 | 69 | | | | | |
| CONTIG5770 | 23635962_f3_19 | 13127 | 27230 | 315 | 105 | | | | | |
| CONTIG5770 | 35282932_c2_27 | 13128 | 27231 | 189 | 63 | | | | | |
| CONTIG5771 | 4062763_f1_2 | 13129 | 27232 | 276 | 92 | | | | | |
| CONTIG5771 | 14648252_f2_5 | 13130 | 27233 | 225 | 75 | | | | | |
| CONTIG5771 | 961567_f3_19 | 13131 | 27234 | 312 | 104 | | | | | |
| CONTIG5772 | 1990913_c2_39 | 13132 | 27235 | 195 | 65 | | | | | |
| CONTIG5772 | 32165825_f1_1 | 13133 | 27236 | 234 | 78 | | | | | |
| CONTIG5772 | 22316942_f2_11 | 13134 | 27237 | 255 | 85 | | | | | |
| CONTIG5772 | 24789037_f3_20 | 13135 | 27238 | 312 | 104 | | | | | |
| CONTIG5773 | 14297187_c2_38 | 13136 | 27239 | 240 | 80 | | | | | |
| CONTIG5773 | 13135575_c1_22 | 13137 | 27240 | 195 | 65 | | | | | |
| CONTIG5773 | 24735938_c1_23 | 13138 | 27241 | 303 | 101 | | | | | |
| CONTIG5774 | 10351588_f2_9 | 13139 | 27242 | 186 | 62 | | | | | |
| CONTIG5774 | 5978418_f3_12 | 13140 | 27243 | 225 | 75 | | | | | |
| CONTIG5774 | 266330_f3_15 | 13141 | 27244 | 1518 | 506 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5774 | 24064512_c2_25 | 13142 | 27245 | 189 | 63 | | | | | |
| CONTIG5775 | 969063_f1_1 | 13143 | 27246 | 453 | 151 | | | | | |
| CONTIG5775 | 78138_f1_9 | 13144 | 27247 | 231 | 77 | | | | | |
| CONTIG5775 | 14158436_c1_19 | 13145 | 27248 | 192 | 64 | | | | | |
| CONTIG5775 | 15787837_c1_22 | 13146 | 27249 | 243 | 81 | | | | | |
| CONTIG5775 | 25598762_c2_24 | 13147 | 27250 | 198 | 66 | | | | | |
| CONTIG5776 | 4101675_f1_2 | 13148 | 27251 | 276 | 92 | | | | | |
| CONTIG5776 | 34195437_f1_3 | 13149 | 27252 | 246 | 82 | | | | | |
| CONTIG5776 | 22900012_f2_8 | 13150 | 27253 | 411 | 137 | | | | | |
| CONTIG5776 | 13710751_f3_16 | 13151 | 27254 | 339 | 113 | | | | | |
| CONTIG5776 | 875251_c2_26 | 13152 | 27255 | 204 | 68 | | | | | |
| CONTIG5776 | 21878130_c3_31 | 13153 | 27256 | 186 | 62 | | | | | |
| CONTIG5776 | 787927_c3_35 | 13154 | 27257 | 210 | 70 | | | | | |
| CONTIG5777 | 22375807_f2_3 | 13155 | 27258 | 435 | 145 | | | | | |
| CONTIG5777 | 23471880_f3_10 | 13156 | 27259 | 264 | 88 | | | | | |
| CONTIG5777 | 81402_f3_15 | 13157 | 27260 | 222 | 74 | | | | | |
| CONTIG5777 | 29333512_c1_17 | 13158 | 27261 | 207 | 69 | | | | | |
| CONTIG5777 | 24322128_c2_24 | 13159 | 27262 | 183 | 61 | | | | | |
| CONTIG5778 | 31883388_c3_31 | 13160 | 27263 | 213 | 71 | | | | | |
| CONTIG5778 | 14866507_f2_17 | 13161 | 27264 | 252 | 84 | | | | | |
| CONTIG5778 | 7054677_f3_20 | 13162 | 27265 | 210 | 70 | | | | | |
| CONTIG5778 | 5329752_f3_21 | 13163 | 27266 | 402 | 134 | | | | | |
| CONTIG5778 | 31798388_c3_31 | 13164 | 27267 | 207 | 69 | | | | | |
| CONTIG5779 | 11909650_c1_16 | 13165 | 27268 | 279 | 93 | | | | | |
| CONTIG5779 | 34089026_c2_18 | 13166 | 27269 | 207 | 69 | | | | | |
| CONTIG5780 | 3945932_f1_4 | 13167 | 27270 | 1083 | 361 | | | | | |
| CONTIG5780 | 42305_c2_26 | 13168 | 27271 | 201 | 67 | | | | | |
| CONTIG5781 | 23594525_f2_12 | 13169 | 27272 | 285 | 95 | | | | | |
| CONTIG5781 | 4079661_f3_14 | 13170 | 27273 | 198 | 66 | | | | | |
| CONTIG5781 | 4489510_f3_16 | 13171 | 27274 | 237 | 79 | | | | | |
| CONTIG5782 | 24414142_f2_9 | 13172 | 27275 | 210 | 70 | | | | | |
| CONTIG5782 | 29881928_c1_16 | 13173 | 27276 | 249 | 83 | | | | | |
| CONTIG5782 | 20367250_c2_19 | 13174 | 27277 | 675 | 225 | | | | | |
| CONTIG5782 | 1991625_c3_26 | 13175 | 27278 | 198 | 66 | | | | | |
| CONTIG5783 | 26015953_f1_3 | 13176 | 27279 | 183 | 61 | | | | | |
| CONTIG5783 | 24492187_f2_11 | 13177 | 27280 | 225 | 75 | | | | | |
| CONTIG5783 | 34266952_c1_27 | 13178 | 27281 | 720 | 240 | | | | | |
| CONTIG5783 | 25401900_c2_29 | 13179 | 27282 | 201 | 67 | | | | | |
| CONTIG5784 | 23600678_f1_2 | 13180 | 27283 | 198 | 66 | | | | | |
| CONTIG5784 | 26609383_f2_4 | 13181 | 27284 | 240 | 80 | | | | | |
| CONTIG5784 | 10313125_f3_11 | 13182 | 27285 | 192 | 64 | | | | | |
| CONTIG5784 | 992187_c1_15 | 13183 | 27286 | 213 | 71 | | | | | |
| CONTIG5784 | 21672813_c1_16 | 13184 | 27287 | 279 | 93 | | | | | |
| CONTIG5784 | 14147838_c2_18 | 13185 | 27288 | 222 | 74 | | | | | |
| CONTIG5784 | 14256252_c2_19 | 13186 | 27289 | 192 | 64 | | | | | |
| CONTIG5784 | 29304635_c3_27 | 13187 | 27290 | 216 | 72 | | | | | |
| CONTIG5784 | 6835150_c3_28 | 13188 | 27291 | 207 | 69 | | | | | |
| CONTIG5784 | 24304682_c3_29 | 13189 | 27292 | 255 | 85 | | | | | |
| CONTIG5785 | 2445312_f1_2 | 13190 | 27293 | 192 | 64 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5785 | 19955386_f2_9 | 13191 | 27294 | 420 | 140 | | | | | |
| CONTIG5785 | 23516316_f3_18 | 13192 | 27295 | 192 | 64 | | | | | |
| CONTIG5785 | 11797161_f3_20 | 13193 | 27296 | 342 | 114 | | | | | |
| CONTIG5785 | 162575_c3_32 | 13194 | 27297 | 195 | 65 | | | | | |
| CONTIG5786 | 11767091_f3_15 | 13195 | 27298 | 213 | 71 | | | | | |
| CONTIG5786 | 35270037_f3_16 | 13196 | 27299 | 189 | 63 | | | | | |
| CONTIG5786 | 953375_f3_20 | 13197 | 27300 | 219 | 73 | | | | | |
| CONTIG5786 | 11725278_c1_22 | 13198 | 27301 | 210 | 70 | | | | | |
| CONTIG5786 | 13680262_c1_23 | 13199 | 27302 | 186 | 62 | | | | | |
| CONTIG5786 | 30272077_c2_32 | 13200 | 27303 | 228 | 76 | | | | | |
| CONTIG5786 | 4332887_c3_39 | 13201 | 27304 | 210 | 70 | | | | | |
| CONTIG5787 | 14277251_f2_6 | 13202 | 27305 | 183 | 61 | | | | | |
| CONTIG5787 | 35235880_f2_9 | 13203 | 27306 | 186 | 62 | | | | | |
| CONTIG5787 | 2848518_f3_17 | 13204 | 27307 | 258 | 86 | | | | | |
| CONTIG5787 | 24392158_c2_28 | 13205 | 27308 | 234 | 78 | | | | | |
| CONTIG5787 | 24235300_c2_31 | 13206 | 27309 | 231 | 77 | | | | | |
| CONTIG5788 | 20524036_c1_19 | 13207 | 27310 | 363 | 121 | | | | | |
| CONTIG5789 | 13829376_f1_5 | 13208 | 27311 | 552 | 184 | | | | | |
| CONTIG5789 | 5163377_f1_6 | 13209 | 27312 | 186 | 62 | | | | | |
| CONTIG5789 | 1953177_c1_20 | 13210 | 27313 | 393 | 131 | | | | | |
| CONTIG5789 | 977175_c2_29 | 13211 | 27314 | 1407 | 469 | | | | | |
| CONTIG5789 | 2814375_c3_31 | 13212 | 27315 | 513 | 171 | | | | | |
| CONTIG5789 | 2923463_c3_32 | 13213 | 27316 | 204 | 68 | | | | | |
| CONTIG5790 | 4881312_f2_12 | 13214 | 27317 | 405 | 135 | | | | | |
| CONTIG5790 | 160307_f2_14 | 13215 | 27318 | 495 | 165 | | | | | |
| CONTIG5790 | 23633286_c1_19 | 13216 | 27319 | 303 | 101 | | | | | |
| CONTIG5790 | 4901587_c3_27 | 13217 | 27320 | 306 | 102 | | | | | |
| CONTIG5790 | 327_c3_33 | 13218 | 27321 | 366 | 122 | | | | | |
| CONTIG5791 | 19734840_f2_6 | 13219 | 27322 | 375 | 125 | | | | | |
| CONTIG5791 | 22445186_f2_10 | 13220 | 27323 | 195 | 65 | | | | | |
| CONTIG5791 | 6664200_f2_11 | 13221 | 27324 | 363 | 121 | | | | | |
| CONTIG5791 | 2032786_f2_12 | 13222 | 27325 | 222 | 74 | | | | | |
| CONTIG5791 | 33298505_f3_13 | 13223 | 27326 | 891 | 297 | | | | | |
| CONTIG5791 | 20317053_c1_20 | 13224 | 27327 | 723 | 241 | | | | | |
| CONTIG5792 | 22271966_c1_27 | 13225 | 27328 | 183 | 61 | | | | | |
| CONTIG5792 | 1970130_c2_34 | 13226 | 27329 | 237 | 79 | | | | | |
| CONTIG5793 | 5273451_f3_14 | 13227 | 27330 | 225 | 75 | | | | | |
| CONTIG5794 | 10632056_f1_1 | 13228 | 27331 | 1002 | 334 | | | | | |
| CONTIG5794 | 11176876_c2_33 | 13229 | 27332 | 183 | 61 | | | | | |
| CONTIG5794 | 6641255_c3_40 | 13230 | 27333 | 273 | 91 | | | | | |
| CONTIG5795 | 24267893_f2_8 | 13231 | 27334 | 213 | 71 | | | | | |
| CONTIG5795 | 24026638_f3_17 | 13232 | 27335 | 192 | 64 | | | | | |
| CONTIG5795 | 4957682_c1_22 | 13233 | 27336 | 648 | 216 | | | | | |
| CONTIG5795 | 20897202_c3_37 | 13234 | 27337 | 348 | 116 | | | | | |
| CONTIG5795 | 23515688_c3_38 | 13235 | 27338 | 198 | 66 | | | | | |
| CONTIG5795 | 6691253_c3_43 | 13236 | 27339 | 243 | 81 | | | | | |
| CONTIG5796 | 24407640_f1_2 | 13237 | 27340 | 237 | 79 | | | | | |
| CONTIG5796 | 35647032_f1_3 | 13238 | 27341 | 201 | 67 | | | | | |
| CONTIG5796 | 11837715_f1_5 | 13239 | 27342 | 204 | 68 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5796 | 20520276_f2_9 | 13240 | 27343 | 195 | 65 | | | | | |
| CONTIG5796 | 24019002_f2_10 | 13241 | 27344 | 222 | 74 | | | | | |
| CONTIG5796 | 4902312_f3_13 | 13242 | 27345 | 234 | 78 | | | | | |
| CONTIG5796 | 891052_c1_15 | 13243 | 27346 | 183 | 61 | | | | | |
| CONTIG5797 | 19579637_c3_31 | 13244 | 27347 | 216 | 72 | | | | | |
| CONTIG5797 | 20501343_c3_32 | 13245 | 27348 | 198 | 66 | | | | | |
| CONTIG5797 | 204465_c3_35 | 13246 | 27349 | 315 | 105 | | | | | |
| CONTIG5798 | 24432181_c2_37 | 13247 | 27350 | 207 | 69 | | | | | |
| CONTIG5798 | 5078955_c2_38 | 13248 | 27351 | 336 | 112 | | | | | |
| CONTIG5799 | 878752_f2_7 | 13249 | 27352 | 282 | 94 | | | | | |
| CONTIG5799 | 10980181_f2_8 | 13250 | 27353 | 198 | 66 | | | | | |
| CONTIG5799 | 30553265_c1_18 | 13251 | 27354 | 237 | 79 | | | | | |
| CONTIG5799 | 34407180_c2_26 | 13252 | 27355 | 1968 | 656 | | | | | |
| CONTIG5799 | 19803590_c3_28 | 13253 | 27356 | 219 | 73 | | | | | |
| CONTIG5799 | 29493785_c3_29 | 13254 | 27357 | 201 | 67 | | | | | |
| CONTIG5799 | 10823811_c3_30 | 13255 | 27358 | 198 | 66 | | | | | |
| CONTIG5800 | 11900015_c1_6 | 13256 | 27359 | 195 | 65 | | | | | |
| CONTIG5800 | 24410666_c1_7 | 13257 | 27360 | 192 | 64 | | | | | |
| CONTIG5800 | 11900015_c1_8 | 13258 | 27361 | 195 | 65 | | | | | |
| CONTIG5800 | 35203432_c2_9 | 13259 | 27362 | 462 | 154 | | | | | |
| CONTIG5800 | 9929652_c3_10 | 13260 | 27363 | 192 | 64 | | | | | |
| CONTIG5800 | 3167325_c3_12 | 13261 | 27364 | 240 | 80 | | | | | |
| CONTIG5801 | 13753135_f2_7 | 13262 | 27365 | 504 | 168 | | | | | |
| CONTIG5801 | 29542502_f2_11 | 13263 | 27366 | 198 | 66 | | | | | |
| CONTIG5801 | 19726437_f2_15 | 13264 | 27367 | 192 | 64 | | | | | |
| CONTIG5802 | 24114062_f1_4 | 13265 | 27368 | 195 | 65 | | | | | |
| CONTIG5802 | 26199205_f1_5 | 13266 | 27369 | 204 | 68 | | | | | |
| CONTIG5802 | 22464087_f1_6 | 13267 | 27370 | 186 | 62 | | | | | |
| CONTIG5802 | 6136527_f1_9 | 13268 | 27371 | 252 | 84 | | | | | |
| CONTIG5802 | 16538432_f2_15 | 13269 | 27372 | 288 | 96 | | | | | |
| CONTIG5802 | 15032918_f2_16 | 13270 | 27373 | 342 | 114 | | | | | |
| CONTIG5802 | 11055383_c2_30 | 13271 | 27374 | 219 | 73 | | | | | |
| CONTIG5802 | 23844625_c2_35 | 13272 | 27375 | 189 | 63 | | | | | |
| CONTIG5802 | 2578200_c3_40 | 13273 | 27376 | 222 | 74 | | | | | |
| CONTIG5803 | 24394402_f1_1 | 13274 | 27377 | 195 | 65 | | | | | |
| CONTIG5803 | 21675010_f1_4 | 13275 | 27378 | 1092 | 364 | | | | | |
| CONTIG5803 | 5253762_c1_19 | 13276 | 27379 | 258 | 86 | | | | | |
| CONTIG5804 | 24634660_f1_5 | 13277 | 27380 | 492 | 164 | | | | | |
| CONTIG5804 | 24854681_f1_6 | 13278 | 27381 | 318 | 106 | | | | | |
| CONTIG5804 | 14846900_f1_7 | 13279 | 27382 | 651 | 217 | | | | | |
| CONTIG5804 | 24117250_f1_9 | 13280 | 27383 | 201 | 67 | | | | | |
| CONTIG5804 | 972155_f2_24 | 13281 | 27384 | 375 | 125 | | | | | |
| CONTIG5804 | 5865642_f3_33 | 13282 | 27385 | 216 | 72 | | | | | |
| CONTIG5804 | 26287555_c1_42 | 13283 | 27386 | 201 | 67 | | | | | |
| CONTIG5805 | 33395961_f2_9 | 13284 | 27387 | 276 | 92 | | | | | |
| CONTIG5805 | 35267811_c2_32 | 13285 | 27388 | 723 | 241 | | | | | |
| CONTIG5806 | 4875055_f2_11 | 13286 | 27389 | 519 | 173 | | | | | |
| CONTIG5806 | 5094087_f3_22 | 13287 | 27390 | 213 | 71 | | | | | |
| CONTIG5806 | 400453_c1_30 | 13288 | 27391 | 816 | 272 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5806 | 9859377_c2_36 | 13289 | 27392 | 897 | 299 | | | | | |
| CONTIG5806 | 4800125_c3_37 | 13290 | 27393 | 186 | 62 | | | | | |
| CONTIG5806 | 14267776_c3_39 | 13291 | 27394 | 276 | 92 | | | | | |
| CONTIG5806 | 20738825_c3_40 | 13292 | 27395 | 234 | 78 | | | | | |
| CONTIG5807 | 172055_f3_9 | 13293 | 27396 | 1026 | 342 | | | | | |
| CONTIG5808 | 22375030_f1_6 | 13294 | 27397 | 189 | 63 | | | | | |
| CONTIG5808 | 2000017_f2_9 | 13295 | 27398 | 189 | 63 | | | | | |
| CONTIG5808 | 5896900_f2_14 | 13296 | 27399 | 1716 | 572 | | | | | |
| CONTIG5808 | 29975942_f3_15 | 13297 | 27400 | 195 | 65 | | | | | |
| CONTIG5809 | 1056528_f2_11 | 13298 | 27401 | 1173 | 391 | | | | | |
| CONTIG5809 | 11754591_f3_14 | 13299 | 27402 | 630 | 210 | | | | | |
| CONTIG5809 | 10331386_c3_26 | 13300 | 27403 | 267 | 89 | | | | | |
| CONTIG5810 | 23636502_f2_10 | 13301 | 27404 | 333 | 111 | | | | | |
| CONTIG5810 | 24644026_f2_12 | 13302 | 27405 | 804 | 268 | | | | | |
| CONTIG5810 | 32320933_f3_14 | 13303 | 27406 | 183 | 61 | | | | | |
| CONTIG5810 | 20117811_f3_17 | 13304 | 27407 | 183 | 61 | | | | | |
| CONTIG5810 | 167661_c2_28 | 13305 | 27408 | 189 | 63 | | | | | |
| CONTIG5811 | 26428463_c3_40 | 13306 | 27409 | 210 | 70 | | | | | |
| CONTIG5811 | 12548430_c3_41 | 13307 | 27410 | 309 | 103 | | | | | |
| CONTIG5812 | 4881518_c3_27 | 13308 | 27411 | 390 | 130 | | | | | |
| CONTIG5812 | 6697843_c3_30 | 13309 | 27412 | 207 | 69 | | | | | |
| CONTIG5812 | 781375_c3_31 | 13310 | 27413 | 219 | 73 | | | | | |
| CONTIG5812 | 19726562_c3_34 | 13311 | 27414 | 777 | 259 | | | | | |
| CONTIG5813 | 20900_f3_20 | 13312 | 27415 | 210 | 70 | | | | | |
| CONTIG5813 | 33297261_f3_27 | 13313 | 27416 | 195 | 65 | | | | | |
| CONTIG5813 | 7050026_c2_53 | 13314 | 27417 | 318 | 106 | | | | | |
| CONTIG5814 | 1995306_f1_3 | 13315 | 27418 | 615 | 205 | | | | | |
| CONTIG5814 | 34234660_f3_15 | 13316 | 27419 | 216 | 72 | | | | | |
| CONTIG5814 | 14197183_f3_20 | 13317 | 27420 | 267 | 89 | | | | | |
| CONTIG5814 | 21759502_c1_32 | 13318 | 27421 | 294 | 98 | | | | | |
| CONTIG5814 | 2770182_c3_56 | 13319 | 27422 | 234 | 78 | | | | | |
| CONTIG5815 | 24259681_f1_2 | 13320 | 27423 | 1041 | 347 | | | | | |
| CONTIG5815 | 9860082_f1_4 | 13321 | 27424 | 216 | 72 | | | | | |
| CONTIG5815 | 24414061_f1_5 | 13322 | 27425 | 282 | 94 | | | | | |
| CONTIG5815 | 22750306_f2_13 | 13323 | 27426 | 270 | 90 | | | | | |
| CONTIG5815 | 26259682_f3_26 | 13324 | 27427 | 192 | 64 | | | | | |
| CONTIG5815 | 10944680_f3_27 | 13325 | 27428 | 639 | 213 | | | | | |
| CONTIG5815 | 30475280_c1_28 | 13326 | 27429 | 204 | 68 | | | | | |
| CONTIG5815 | 23725090_c2_37 | 13327 | 27430 | 279 | 93 | | | | | |
| CONTIG5816 | 11755015_f1_1 | 13328 | 27431 | 195 | 65 | | | | | |
| CONTIG5816 | 11900015_f1_2 | 13329 | 27432 | 195 | 65 | | | | | |
| CONTIG5816 | 11900015_f1_3 | 13330 | 27433 | 195 | 65 | | | | | |
| CONTIG5816 | 20709436_c1_7 | 13331 | 27434 | 267 | 89 | | | | | |
| CONTIG5816 | 31444658_c3_16 | 13332 | 27435 | 234 | 78 | | | | | |
| CONTIG5817 | 6031451_f1_3 | 13333 | 27436 | 252 | 84 | | | | | |
| CONTIG5817 | 30662750_c1_41 | 13334 | 27437 | 213 | 71 | | | | | |
| CONTIG5817 | 4335187_c2_49 | 13335 | 27438 | 327 | 109 | | | | | |
| CONTIG5817 | 24504652_c2_53 | 13336 | 27439 | 240 | 80 | | | | | |
| CONTIG5818 | 26206511_f2_13 | 13337 | 27440 | 762 | 254 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5818 | 21663430_f2_21 | 13338 | 27441 | 261 | 87 | | | | | |
| CONTIG5818 | 20879515_f2_22 | 13339 | 27442 | 183 | 61 | | | | | |
| CONTIG5818 | 3183302_c2_38 | 13340 | 27443 | 267 | 89 | | | | | |
| CONTIG5818 | 24351528_c3_48 | 13341 | 27444 | 222 | 74 | | | | | |
| CONTIG5818 | 4566252_c3_52 | 13342 | 27445 | 444 | 148 | | | | | |
| CONTIG5818 | 33314625_f1_4 | 13343 | 27446 | 189 | 63 | | | | | |
| CONTIG5819 | 116325_f2_6 | 13344 | 27447 | 216 | 72 | | | | | |
| CONTIG5819 | 430465_f2_12 | 13345 | 27448 | 312 | 104 | | | | | |
| CONTIG5819 | 23990937_f3_27 | 13346 | 27449 | 222 | 74 | | | | | |
| CONTIG5819 | 24429712_c1_30 | 13347 | 27450 | 282 | 94 | | | | | |
| CONTIG5819 | 9850632_c1_31 | 13348 | 27451 | 207 | 69 | | | | | |
| CONTIG5819 | 21645302_c3_54 | 13349 | 27452 | 372 | 124 | | | | | |
| CONTIG5819 | 32536393_c3_60 | 13350 | 27453 | 294 | 98 | | | | | |
| CONTIG5819 | 29475782_f1_5 | 13351 | 27454 | 231 | 77 | | | | | |
| CONTIG5820 | 23459625_f1_7 | 13352 | 27455 | 186 | 62 | | | | | |
| CONTIG5820 | 14507128_f1_8 | 13353 | 27456 | 225 | 75 | | | | | |
| CONTIG5820 | 812752_f1_9 | 13354 | 27457 | 195 | 65 | | | | | |
| CONTIG5820 | 35550068_f1_10 | 13355 | 27458 | 303 | 101 | | | | | |
| CONTIG5820 | 6147128_f1_13 | 13356 | 27459 | 249 | 83 | | | | | |
| CONTIG5820 | 19589425_f1_15 | 13357 | 27460 | 252 | 84 | | | | | |
| CONTIG5820 | 12549087_f2_18 | 13358 | 27461 | 237 | 79 | | | | | |
| CONTIG5820 | 24797305_f2_25 | 13359 | 27462 | 186 | 62 | | | | | |
| CONTIG5820 | 19818802_f2_26 | 13360 | 27463 | 240 | 80 | | | | | |
| CONTIG5820 | 4068801_f2_27 | 13361 | 27464 | 189 | 63 | | | | | |
| CONTIG5820 | 23554806_f3_35 | 13362 | 27465 | 207 | 69 | | | | | |
| CONTIG5820 | 25395266_f3_37 | 13363 | 27466 | 249 | 83 | | | | | |
| CONTIG5820 | 2220061_f3_38 | 13364 | 27467 | 288 | 96 | | | | | |
| CONTIG5820 | 4720633_f3_45 | 13365 | 27468 | 198 | 66 | | | | | |
| CONTIG5820 | 785337_f3_47 | 13366 | 27469 | 201 | 67 | | | | | |
| CONTIG5820 | 31534782_f3_50 | 13367 | 27470 | 183 | 61 | | | | | |
| CONTIG5820 | 4335018_f3_51 | 13368 | 27471 | 222 | 74 | | | | | |
| CONTIG5820 | 642167_f3_52 | 13369 | 27472 | 276 | 92 | | | | | |
| CONTIG5820 | 4070956_f3_58 | 13370 | 27473 | 189 | 63 | | | | | |
| CONTIG5820 | 2359803_c1_65 | 13371 | 27474 | 261 | 87 | | | | | |
| CONTIG5820 | 2828933_c2_69 | 13372 | 27475 | 192 | 64 | | | | | |
| CONTIG5820 | 26615910_c2_71 | 13373 | 27476 | 216 | 72 | | | | | |
| CONTIG5820 | 21885_c2_72 | 13374 | 27477 | 210 | 70 | | | | | |
| CONTIG5820 | 3259760_c2_76 | 13375 | 27478 | 198 | 66 | | | | | |
| CONTIG5820 | 812752_c3_77 | 13376 | 27479 | 195 | 65 | | | | | |
| CONTIG5820 | 10751388_c3_78 | 13377 | 27480 | 189 | 63 | | | | | |
| CONTIG5820 | 4162893_c3_79 | 13378 | 27481 | 213 | 71 | | | | | |
| CONTIG5820 | 6147757_c3_80 | 13379 | 27482 | 249 | 83 | | | | | |
| CONTIG5820 | 20727036_c3_81 | 13380 | 27483 | 234 | 78 | | | | | |
| CONTIG5820 | 2845257_c3_82 | 13381 | 27484 | 183 | 61 | | | | | |
| CONTIG5820 | 25886515_c3_84 | 13382 | 27485 | 303 | 101 | | | | | |
| CONTIG5820 | 19921890_f1_2 | 13383 | 27486 | 240 | 80 | | | | | |
| CONTIG5821 | 14895202_f1_12 | 13384 | 27487 | 255 | 85 | | | | | |
| CONTIG5821 | 12109393_f1_14 | 13385 | 27488 | 360 | 120 | | | | | |
| CONTIG5821 | 29551458_f2_23 | 13386 | 27489 | 210 | 70 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG5821 | 19921890_f2_31 | 13387 | 27490 | 276 | 92 | | | | | |
| CONTIG5821 | 19921890_f2_33 | 13388 | 27491 | 240 | 80 | | | | | |
| CONTIG5821 | 12237505_f3_42 | 13389 | 27492 | 183 | 61 | | | | | |
| CONTIG5821 | 25977218_f3_45 | 13390 | 27493 | 189 | 63 | | | | | |
| CONTIG5821 | 13847790_f3_49 | 13391 | 27494 | 288 | 96 | | | | | |
| CONTIG5821 | 24010290_f3_51 | 13392 | 27495 | 231 | 77 | | | | | |
| CONTIG5821 | 5331418_c1_60 | 13393 | 27496 | 261 | 87 | | | | | |
| CONTIG5821 | 679716_c1_63 | 13394 | 27497 | 192 | 64 | | | | | |
| CONTIG5821 | 25839417_c3_90 | 13395 | 27498 | 240 | 80 | | | | | |
| CONTIG5821 | 13799081_c3_91 | 13396 | 27499 | 264 | 88 | | | | | |
| CONTIG584 | 24022327_f3_2 | 13397 | 27500 | 192 | 64 | | | | | |
| CONTIG586 | 790700_f2_1 | 13398 | 27501 | 186 | 62 | | | | | |
| CONTIG587 | 25426626_f1_1 | 13399 | 27502 | 186 | 62 | | | | | |
| CONTIG587 | 2031950_f3_2 | 13400 | 27503 | 306 | 102 | | | | | |
| CONTIG590 | 878278_c2_2 | 13401 | 27504 | 225 | 75 | | | | | |
| CONTIG591 | 9802088_c2_1 | 13402 | 27505 | 822 | 274 | | | | | |
| CONTIG594 | 19725302_c3_3 | 13403 | 27506 | 210 | 70 | | | | | |
| CONTIG596 | 917192_c3_1 | 13404 | 27507 | 828 | 276 | | | | | |
| CONTIG597 | 2912636_f3_3 | 13405 | 27508 | 369 | 123 | | | | | |
| CONTIG599 | 20390713_f1_1 | 13406 | 27509 | 594 | 198 | | | | | |
| CONTIG60 | 24398512_c3_2 | 13407 | 27510 | 477 | 159 | | | | | |
| CONTIG600 | 26767788_c1_3 | 13408 | 27511 | 486 | 162 | | | | | |
| CONTIG601 | 13953301_f1_1 | 13409 | 27512 | 318 | 106 | | | | | |
| CONTIG604 | 4337838_f1_1 | 13410 | 27513 | 723 | 241 | | | | | |
| CONTIG605 | 24394500_c3_3 | 13411 | 27514 | 207 | 69 | | | | | |
| CONTIG610 | 16593790_c2_1 | 13412 | 27515 | 210 | 70 | | | | | |
| CONTIG613 | 36539193_c2_6 | 13413 | 27516 | 243 | 81 | | | | | |
| CONTIG618 | 14456500_c1_1 | 13414 | 27517 | 225 | 75 | | | | | |
| CONTIG619 | 9929787_c3_2 | 13415 | 27518 | 774 | 258 | | | | | |
| CONTIG62 | 6114387_f1_1 | 13416 | 27519 | 264 | 88 | | | | | |
| CONTIG620 | 9776885_f1_1 | 13417 | 27520 | 468 | 156 | | | | | |
| CONTIG625 | 21594051_f3_2 | 13418 | 27521 | 306 | 102 | | | | | |
| CONTIG626 | 4589833_f2_2 | 13419 | 27522 | 207 | 69 | | | | | |
| CONTIG627 | 23986287_f3_1 | 13420 | 27523 | 201 | 67 | | | | | |
| CONTIG63 | 25397187_f1_1 | 13421 | 27524 | 258 | 86 | | | | | |
| CONTIG630 | 2079125_c3_2 | 13422 | 27525 | 183 | 61 | | | | | |
| CONTIG632 | 21676692_c1_3 | 13423 | 27526 | 231 | 77 | | | | | |
| CONTIG633 | 4804056_f2_1 | 13424 | 27527 | 219 | 73 | | | | | |
| CONTIG634 | 10196957_f2_2 | 13425 | 27528 | 567 | 189 | | | | | |
| CONTIG636 | 24304661_c1_1 | 13426 | 27529 | 204 | 68 | | | | | |
| CONTIG637 | 12537506_c2_2 | 13427 | 27530 | 183 | 61 | | | | | |
| CONTIG638 | 2393967_f3_3 | 13428 | 27531 | 324 | 108 | | | | | |
| CONTIG641 | 24929650_f1_2 | 13429 | 27532 | 327 | 109 | | | | | |
| CONTIG642 | 15815653_f2_2 | 13430 | 27533 | 243 | 81 | | | | | |
| CONTIG642 | 4711677_c1_3 | 13431 | 27534 | 219 | 73 | | | | | |
| CONTIG643 | 14459437_f1_1 | 13432 | 27535 | 750 | 250 | | | | | |
| CONTIG644 | 15057966_c2_2 | 13433 | 27536 | 186 | 62 | | | | | |
| CONTIG646 | 4328755_f1_1 | 13434 | 27537 | 492 | 164 | | | | | |
| CONTIG646 | 31683142_f3_2 | 13435 | 27538 | 405 | 135 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG649 | 13782267_f1_1 | 13436 | 27539 | 285 | 95 | | | | | |
| CONTIG649 | 1968750_c1_3 | 13437 | 27540 | 210 | 70 | | | | | |
| CONTIG65 | 9957768_c3_2 | 13438 | 27541 | 402 | 134 | | | | | |
| CONTIG654 | 35633543_f2_1 | 13439 | 27542 | 753 | 251 | | | | | |
| CONTIG656 | 35792165_c2_5 | 13440 | 27543 | 198 | 66 | | | | | |
| CONTIG657 | 13096905_f1_1 | 13441 | 27544 | 942 | 314 | | | | | |
| CONTIG664 | 14562515_f1_1 | 13442 | 27545 | 777 | 259 | | | | | |
| CONTIG665 | 984439_c2_3 | 13443 | 27546 | 204 | 68 | | | | | |
| CONTIG666 | 25817187_f1_1 | 13444 | 27547 | 231 | 77 | | | | | |
| CONTIG667 | 85180_c2_3 | 13445 | 27548 | 387 | 129 | | | | | |
| CONTIG671 | 4181502_f1_1 | 13446 | 27549 | 384 | 128 | | | | | |
| CONTIG671 | 13859385_c2_2 | 13447 | 27550 | 252 | 84 | | | | | |
| CONTIG673 | 22457806_f2_1 | 13448 | 27551 | 339 | 113 | | | | | |
| CONTIG673 | 4765693_c1_2 | 13449 | 27552 | 192 | 64 | | | | | |
| CONTIG673 | 26359552_c3_3 | 13450 | 27553 | 240 | 80 | | | | | |
| CONTIG678 | 24666031_f2_2 | 13451 | 27554 | 474 | 158 | | | | | |
| CONTIG68 | 20392877_c3_2 | 13452 | 27555 | 249 | 83 | | | | | |
| CONTIG680 | 117825_f2_1 | 13453 | 27556 | 186 | 62 | | | | | |
| CONTIG681 | 24568811_f2_1 | 13454 | 27557 | 234 | 78 | | | | | |
| CONTIG682 | 5157515_c1_1 | 13455 | 27558 | 354 | 118 | | | | | |
| CONTIG682 | 23610062_c1_2 | 13456 | 27559 | 363 | 121 | | | | | |
| CONTIG684 | 5282878_f3_1 | 13457 | 27560 | 195 | 65 | | | | | |
| CONTIG684 | 24805442_c3_2 | 13458 | 27561 | 747 | 249 | | | | | |
| CONTIG686 | 9861317_f2_2 | 13459 | 27562 | 519 | 173 | | | | | |
| CONTIG692 | 25443842_c2_2 | 13460 | 27563 | 207 | 69 | | | | | |
| CONTIG693 | 26254813_c3_2 | 13461 | 27564 | 672 | 224 | | | | | |
| CONTIG694 | 31542708_f2_2 | 13462 | 27565 | 309 | 103 | | | | | |
| CONTIG694 | 240803_c3_3 | 13463 | 27566 | 459 | 153 | | | | | |
| CONTIG695 | 33714632_f2_2 | 13464 | 27567 | 204 | 68 | | | | | |
| CONTIG695 | 4068952_c2_3 | 13465 | 27568 | 258 | 86 | | | | | |
| CONTIG696 | 23910911_f3_3 | 13466 | 27569 | 192 | 64 | | | | | |
| CONTIG697 | 30469637_c1_3 | 13467 | 27570 | 246 | 82 | | | | | |
| CONTIG698 | 31683333_c1_2 | 13468 | 27571 | 360 | 120 | | | | | |
| CONTIG698 | 32041015_f1_1 | 13469 | 27572 | 210 | 70 | | | | | |
| CONTIG702 | 29690708_c3_4 | 13470 | 27573 | 201 | 67 | | | | | |
| CONTIG706 | 21907838_c1_2 | 13471 | 27574 | 348 | 116 | | | | | |
| CONTIG715 | 6019765_c3_5 | 13472 | 27575 | 576 | 192 | | | | | |
| CONTIG716 | 15675925_f3_1 | 13473 | 27576 | 369 | 123 | | | | | |
| CONTIG717 | 35189186_c3_3 | 13474 | 27577 | 189 | 63 | | | | | |
| CONTIG719 | 26257936_c1_2 | 13475 | 27578 | 195 | 65 | | | | | |
| CONTIG721 | 161267_c3_4 | 13476 | 27579 | 240 | 80 | | | | | |
| CONTIG725 | 24414555_c2_2 | 13477 | 27580 | 234 | 78 | | | | | |
| CONTIG727 | 24398463_c3_3 | 13478 | 27581 | 198 | 66 | | | | | |
| CONTIG729 | 36111012_c1_1 | 13479 | 27582 | 426 | 142 | | | | | |
| CONTIG732 | 6046883_c3_4 | 13480 | 27583 | 183 | 61 | | | | | |
| CONTIG733 | 34187765_f1_2 | 13481 | 27584 | 279 | 93 | | | | | |
| CONTIG733 | 16410912_c2_3 | 13482 | 27585 | 381 | 127 | | | | | |
| CONTIG736 | 965_f3_1 | 13483 | 27586 | 696 | 232 | | | | | |
| CONTIG739 | 24313191_c3_1 | 13484 | 27587 | 420 | 140 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG74 | 22304787_c2_2 | 13485 | 27588 | 213 | 71 | | | | | |
| CONTIG740 | 35719443_f1_1 | 13486 | 27589 | 633 | 211 | | | | | |
| CONTIG741 | 14625311_f2_2 | 13487 | 27590 | 333 | 111 | | | | | |
| CONTIG741 | 29339662_f3_3 | 13488 | 27591 | 510 | 170 | | | | | |
| CONTIG742 | 25595183_f1_1 | 13489 | 27592 | 489 | 163 | | | | | |
| CONTIG743 | 26204625_f1_1 | 13490 | 27593 | 192 | 64 | | | | | |
| CONTIG743 | 12676567_c1_3 | 13491 | 27594 | 261 | 87 | | | | | |
| CONTIG744 | 35188387_c2_2 | 13492 | 27595 | 690 | 230 | | | | | |
| CONTIG745 | 15897912_f1_1 | 13493 | 27596 | 195 | 65 | | | | | |
| CONTIG746 | 2037907_c3_1 | 13494 | 27597 | 441 | 147 | | | | | |
| CONTIG747 | 25556942_f3_3 | 13495 | 27598 | 183 | 61 | | | | | |
| CONTIG747 | 26304017_f3_5 | 13496 | 27599 | 204 | 68 | | | | | |
| CONTIG748 | 24428268_c3_1 | 13497 | 27600 | 195 | 65 | | | | | |
| CONTIG750 | 9926525_f3_3 | 13498 | 27601 | 237 | 79 | | | | | |
| CONTIG750 | 24803406_c1_4 | 13499 | 27602 | 603 | 201 | | | | | |
| CONTIG750 | 21881400_c3_5 | 13500 | 27603 | 327 | 109 | | | | | |
| CONTIG750 | 15632192_c3_6 | 13501 | 27604 | 315 | 105 | | | | | |
| CONTIG752 | 4097052_c3_1 | 13502 | 27605 | 420 | 140 | | | | | |
| CONTIG754 | 2350135_c1_1 | 13503 | 27606 | 201 | 67 | | | | | |
| CONTIG758 | 33289176_c1_2 | 13504 | 27607 | 222 | 74 | | | | | |
| CONTIG76 | 21651950_f2_1 | 13505 | 27608 | 456 | 152 | | | | | |
| CONTIG760 | 33477150_c1_5 | 13506 | 27609 | 792 | 264 | | | | | |
| CONTIG771 | 24256686_f3_3 | 13507 | 27610 | 543 | 181 | | | | | |
| CONTIG773 | 15041040_f3_1 | 13508 | 27611 | 558 | 186 | | | | | |
| CONTIG774 | 398311_c3_2 | 13509 | 27612 | 204 | 68 | | | | | |
| CONTIG775 | 24648307_f1_1 | 13510 | 27613 | 306 | 102 | | | | | |
| CONTIG778 | 962963_c2_1 | 13511 | 27614 | 225 | 75 | | | | | |
| CONTIG778 | 290693_f1_1 | 13512 | 27615 | 666 | 222 | | | | | |
| CONTIG779 | 29578176_f2_1 | 13513 | 27616 | 198 | 66 | | | | | |
| CONTIG782 | 24022176_c3_2 | 13514 | 27617 | 423 | 141 | | | | | |
| CONTIG782 | 516580_f3_2 | 13515 | 27618 | 195 | 65 | | | | | |
| CONTIG783 | 2757013_c2_2 | 13516 | 27619 | 564 | 188 | | | | | |
| CONTIG784 | 24320275_c1_1 | 13517 | 27620 | 189 | 63 | | | | | |
| CONTIG786 | 4719450_c1_3 | 13518 | 27621 | 231 | 77 | | | | | |
| CONTIG788 | 2519627_c3_9 | 13519 | 27622 | 225 | 75 | | | | | |
| CONTIG789 | 14332786_f1_1 | 13520 | 27623 | 324 | 108 | | | | | |
| CONTIG790 | 22292061_f1_2 | 13521 | 27624 | 396 | 132 | | | | | |
| CONTIG790 | 9923253_f2_1 | 13522 | 27625 | 204 | 68 | | | | | |
| CONTIG791 | 4693803_f3_1 | 13523 | 27626 | 261 | 87 | | | | | |
| CONTIG795 | 24287525_f3_2 | 13524 | 27627 | 1068 | 356 | | | | | |
| CONTIG796 | 9772637_c3_5 | 13525 | 27628 | 222 | 74 | | | | | |
| CONTIG797 | 22127312_f1_1 | 13526 | 27629 | 201 | 67 | | | | | |
| CONTIG799 | 23713961_c2_4 | 13527 | 27630 | 279 | 93 | | | | | |
| CONTIG799 | 23912811_c3_7 | 13528 | 27631 | 201 | 67 | | | | | |
| CONTIG8 | 36542965_c2_2 | 13529 | 27632 | 258 | 86 | | | | | |
| CONTIG80 | 2831512_f2_1 | 13530 | 27633 | 204 | 68 | | | | | |
| CONTIG80 | 4350186_c1_3 | 13531 | 27634 | 186 | 62 | | | | | |
| CONTIG805 | 5079750_f2_1 | 13532 | 27635 | 201 | 67 | | | | | |
| CONTIG805 | 1359507_f2_1 | 13533 | 27636 | 489 | 163 | | | | | |
| CONTIG807 | | | | 183 | 61 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG808 | 24698833_f1_1 | 13534 | 27637 | 759 | 253 | | | | | |
| CONTIG811 | 24416566_f2_1 | 13535 | 27638 | 204 | 68 | | | | | |
| CONTIG811 | 24406250_c1_4 | 13536 | 27639 | 390 | 130 | | | | | |
| CONTIG814 | 16822188_f2_2 | 13537 | 27640 | 249 | 83 | | | | | |
| CONTIG814 | 15744687_f3_3 | 13538 | 27641 | 465 | 155 | | | | | |
| CONTIG814 | 26464078_c2_4 | 13539 | 27642 | 192 | 64 | | | | | |
| CONTIG818 | 2048807_f2_2 | 13540 | 27643 | 186 | 62 | | | | | |
| CONTIG818 | 7886_f3_4 | 13541 | 27644 | 270 | 90 | | | | | |
| CONTIG821 | 22460077_c1_2 | 13542 | 27645 | 546 | 182 | | | | | |
| CONTIG826 | 24345252_f2_1 | 13543 | 27646 | 207 | 69 | | | | | |
| CONTIG826 | 171885_f3_2 | 13544 | 27647 | 720 | 240 | | | | | |
| CONTIG827 | 5157753_f2_1 | 13545 | 27648 | 336 | 112 | | | | | |
| CONTIG827 | 22364055_c3_2 | 13546 | 27649 | 207 | 69 | | | | | |
| CONTIG828 | 26369017_c3_3 | 13547 | 27650 | 216 | 72 | | | | | |
| CONTIG828 | 990937_c3_4 | 13548 | 27651 | 291 | 97 | | | | | |
| CONTIG829 | 31876526_f3_3 | 13549 | 27652 | 324 | 108 | | | | | |
| CONTIG829 | 4032590_c3_5 | 13550 | 27653 | 192 | 64 | | | | | |
| CONTIG832 | 22454813_f1_1 | 13551 | 27654 | 327 | 109 | | | | | |
| CONTIG834 | 34414152_f1_2 | 13552 | 27655 | 447 | 149 | | | | | |
| CONTIG837 | 4097200_c3_3 | 13553 | 27656 | 435 | 145 | | | | | |
| CONTIG839 | 30275630_c1_2 | 13554 | 27657 | 183 | 61 | | | | | |
| CONTIG84 | 20660053_f3_1 | 13555 | 27658 | 237 | 79 | | | | | |
| CONTIG842 | 6742887_f3_1 | 13556 | 27659 | 183 | 61 | | | | | |
| CONTIG842 | 24042561_c2_3 | 13557 | 27660 | 258 | 86 | | | | | |
| CONTIG845 | 4304652_f2_1 | 13558 | 27661 | 231 | 77 | | | | | |
| CONTIG846 | 25556587_c2_2 | 13559 | 27662 | 264 | 88 | | | | | |
| CONTIG848 | 16377757_f1_1 | 13560 | 27663 | 342 | 114 | | | | | |
| CONTIG848 | 34412811_f1_2 | 13561 | 27664 | 246 | 82 | | | | | |
| CONTIG851 | 24318953_f1_1 | 13562 | 27665 | 195 | 65 | | | | | |
| CONTIG851 | 4801468_c3_5 | 13563 | 27666 | 234 | 78 | | | | | |
| CONTIG852 | 4772177_f2_1 | 13564 | 27667 | 213 | 71 | | | | | |
| CONTIG855 | 36414138_c1_3 | 13565 | 27668 | 543 | 181 | | | | | |
| CONTIG856 | 21485927_c2_3 | 13566 | 27669 | 189 | 63 | | | | | |
| CONTIG857 | 11226588_c1_2 | 13567 | 27670 | 633 | 211 | | | | | |
| CONTIG858 | 878592_c3_2 | 13568 | 27671 | 864 | 288 | | | | | |
| CONTIG860 | 34629626_f1_1 | 13569 | 27672 | 294 | 98 | | | | | |
| CONTIG864 | 24448017_f1_1 | 13570 | 27673 | 348 | 116 | | | | | |
| CONTIG864 | 56338_c3_7 | 13571 | 27674 | 255 | 85 | | | | | |
| CONTIG866 | 991283_c1_2 | 13572 | 27675 | 183 | 61 | | | | | |
| CONTIG867 | 24892061_c2_2 | 13573 | 27676 | 204 | 68 | | | | | |
| CONTIG871 | 26562525_f3_1 | 13574 | 27677 | 276 | 92 | | | | | |
| CONTIG872 | 24806277_f3_2 | 13575 | 27678 | 186 | 62 | | | | | |
| CONTIG874 | 4331525_c3_3 | 13576 | 27679 | 186 | 62 | | | | | |
| CONTIG875 | 21912806_c1_6 | 13577 | 27680 | 234 | 78 | | | | | |
| CONTIG876 | 29375468_c1_2 | 13578 | 27681 | 291 | 97 | | | | | |
| CONTIG878 | 14707137_f3_2 | 13579 | 27682 | 279 | 93 | | | | | |
| CONTIG88 | 23925932_c3_4 | 13580 | 27683 | 204 | 68 | | | | | |
| CONTIG880 | 33625666_f2_1 | 13581 | 27684 | 189 | 63 | | | | | |
| CONTIG880 | 10549090_f2_3 | 13582 | 27685 | 318 | 106 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG881 | 15635162_f1_1 | 13583 | 27686 | 195 | 65 | | | | | |
| CONTIG881 | 23525300_f3_3 | 13584 | 27687 | 237 | 79 | | | | | |
| CONTIG881 | 163462_c2_4 | 13585 | 27688 | 330 | 110 | | | | | |
| CONTIG881 | 29586000_c3_5 | 13586 | 27689 | 210 | 70 | | | | | |
| CONTIG885 | 21682790_f1_1 | 13587 | 27690 | 198 | 66 | | | | | |
| CONTIG888 | 29457827_f2_1 | 13588 | 27691 | 204 | 68 | | | | | |
| CONTIG888 | 5101562_c1_2 | 13589 | 27692 | 195 | 65 | | | | | |
| CONTIG889 | 21879833_f3_1 | 13590 | 27693 | 198 | 66 | | | | | |
| CONTIG890 | 21484718_f3_3 | 13591 | 27694 | 186 | 62 | | | | | |
| CONTIG891 | 10939180_f1_1 | 13592 | 27695 | 315 | 105 | | | | | |
| CONTIG891 | 817811_f3_2 | 13593 | 27696 | 282 | 94 | | | | | |
| CONTIG893 | 6260187_c3_3 | 13594 | 27697 | 948 | 316 | | | | | |
| CONTIG896 | 24397178_f1_1 | 13595 | 27698 | 297 | 99 | | | | | |
| CONTIG896 | 19728187_f2_2 | 13596 | 27699 | 249 | 83 | | | | | |
| CONTIG896 | 23626551_f3_3 | 13597 | 27700 | 183 | 61 | | | | | |
| CONTIG898 | 24511442_c2_4 | 13598 | 27701 | 645 | 215 | | | | | |
| CONTIG90 | 24094627_f3_1 | 13599 | 27702 | 216 | 72 | | | | | |
| CONTIG904 | 19709637_c1_2 | 13600 | 27703 | 249 | 83 | | | | | |
| CONTIG905 | 14234775_f3_1 | 13601 | 27704 | 744 | 248 | | | | | |
| CONTIG906 | 29335186_c2_2 | 13602 | 27705 | 222 | 74 | | | | | |
| CONTIG907 | 23829387_c3_6 | 13603 | 27706 | 321 | 107 | | | | | |
| CONTIG909 | 10725812_f2_1 | 13604 | 27707 | 207 | 69 | | | | | |
| CONTIG909 | 24335902_f3_2 | 13605 | 27708 | 198 | 66 | | | | | |
| CONTIG91 | 2206258_f3_5 | 13606 | 27709 | 222 | 74 | | | | | |
| CONTIG911 | 23720250_f3_2 | 13607 | 27710 | 198 | 66 | | | | | |
| CONTIG913 | 25431526_c3_3 | 13608 | 27711 | 549 | 183 | | | | | |
| CONTIG914 | 4765700_f1_1 | 13609 | 27712 | 342 | 114 | | | | | |
| CONTIG914 | 24395143_f3_3 | 13610 | 27713 | 399 | 133 | | | | | |
| CONTIG915 | 24298830_f3_2 | 13611 | 27714 | 198 | 66 | | | | | |
| CONTIG915 | 9822530_f3_3 | 13612 | 27715 | 273 | 91 | | | | | |
| CONTIG917 | 183527_f3_1 | 13613 | 27716 | 264 | 88 | | | | | |
| CONTIG919 | 23722812_f1_1 | 13614 | 27717 | 198 | 66 | | | | | |
| CONTIG919 | 15036343_f3_2 | 13615 | 27718 | 183 | 61 | | | | | |
| CONTIG919 | 5907303_f2_2 | 13616 | 27719 | 198 | 66 | | | | | |
| CONTIG92 | 15037577_c1_1 | 13617 | 27720 | 291 | 97 | | | | | |
| CONTIG920 | 25820428_c2_2 | 13618 | 27721 | 252 | 84 | | | | | |
| CONTIG923 | 9964802_c2_3 | 13619 | 27722 | 219 | 73 | | | | | |
| CONTIG926 | 5267180_c3_3 | 13620 | 27723 | 513 | 171 | | | | | |
| CONTIG927 | 23632186_c2_4 | 13621 | 27724 | 189 | 63 | | | | | |
| CONTIG928 | 21520462_c2_1 | 13622 | 27725 | 798 | 266 | | | | | |
| CONTIG93 | 10335468_f3_1 | 13623 | 27726 | 228 | 76 | | | | | |
| CONTIG931 | 26448377_c1_5 | 13624 | 27727 | 279 | 93 | | | | | |
| CONTIG932 | 2788576_f2_1 | 13625 | 27728 | 273 | 91 | | | | | |
| CONTIG934 | 24414075_c3_7 | 13626 | 27729 | 186 | 62 | | | | | |
| CONTIG935 | 4728563_f2_2 | 13627 | 27730 | 186 | 62 | | | | | |
| CONTIG935 | 7073432_c1_4 | 13628 | 27731 | 627 | 209 | | | | | |
| CONTIG936 | 29332681_f2_1 | 13629 | 27732 | 465 | 155 | | | | | |
| CONTIG938 | 5984562_f1_1 | 13630 | 27733 | 288 | 96 | | | | | |
| CONTIG938 | 26459381_c3_5 | 13631 | 27734 | 882 | 294 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| CONTIG939 | 10352000_c3_3 | 13632 | 27735 | 669 | 223 | | | | | |
| CONTIG94 | 14509403_f1_1 | 13633 | 27736 | 213 | 71 | | | | | |
| CONTIG940 | 6407628_c1_2 | 13634 | 27737 | 897 | 299 | | | | | |
| CONTIG941 | 34656567_f2_1 | 13635 | 27738 | 198 | 66 | | | | | |
| CONTIG941 | 14457625_c3_2 | 13636 | 27739 | 468 | 156 | | | | | |
| CONTIG945 | 33437950_f2_3 | 13637 | 27740 | 195 | 65 | | | | | |
| CONTIG945 | 197151_c2_7 | 13638 | 27741 | 312 | 104 | | | | | |
| CONTIG946 | 26803753_c1_2 | 13639 | 27742 | 321 | 107 | | | | | |
| CONTIG947 | 23839387_c2_2 | 13640 | 27743 | 711 | 237 | | | | | |
| CONTIG949 | 4375875_f1_1 | 13641 | 27744 | 222 | 74 | | | | | |
| CONTIG95 | 38425_c2_3 | 13642 | 27745 | 825 | 275 | | | | | |
| CONTIG950 | 13906385_c1_2 | 13643 | 27746 | 213 | 71 | | | | | |
| CONTIG951 | 25501411_f2_1 | 13644 | 27747 | 216 | 72 | | | | | |
| CONTIG953 | 26225450_c3_1 | 13645 | 27748 | 183 | 61 | | | | | |
| CONTIG956 | 442583_f2_1 | 13646 | 27749 | 765 | 255 | | | | | |
| CONTIG957 | 23447305_c1_3 | 13647 | 27750 | 189 | 63 | | | | | |
| CONTIG957 | 5320202_c1_4 | 13648 | 27751 | 225 | 75 | | | | | |
| CONTIG960 | 36072187_c1_4 | 13649 | 27752 | 411 | 137 | | | | | |
| CONTIG964 | 3945127_f1_1 | 13650 | 27753 | 330 | 110 | | | | | |
| CONTIG964 | 29459638_f3_2 | 13651 | 27754 | 351 | 117 | | | | | |
| CONTIG964 | 19688760_c1_3 | 13652 | 27755 | 321 | 107 | | | | | |
| CONTIG967 | 13960092_c1_3 | 13653 | 27756 | 444 | 148 | | | | | |
| CONTIG97 | 35805150_f2_1 | 13654 | 27757 | 255 | 85 | | | | | |
| CONTIG970 | 12266886_f3_2 | 13655 | 27758 | 186 | 62 | | | | | |
| CONTIG972 | 3940760_f2_1 | 13656 | 27759 | 216 | 72 | | | | | |
| CONTIG975 | 33505_c1_1 | 13657 | 27760 | 225 | 75 | | | | | |
| CONTIG982 | 4188812_c1_2 | 13658 | 27761 | 189 | 63 | | | | | |
| CONTIG982 | 4015882_c1_3 | 13659 | 27762 | 234 | 78 | | | | | |
| CONTIG982 | 22455392_c2_5 | 13660 | 27763 | 213 | 71 | | | | | |
| CONTIG983 | 4710886_f1_1 | 13661 | 27764 | 315 | 105 | | | | | |
| CONTIG983 | 24022802_f3_3 | 13662 | 27765 | 201 | 67 | | | | | |
| CONTIG984 | 10345905_f3_1 | 13663 | 27766 | 972 | 324 | | | | | |
| CONTIG985 | 9782958_f3_2 | 13664 | 27767 | 270 | 90 | | | | | |
| CONTIG989 | 22085800_c1_2 | 13665 | 27768 | 189 | 63 | | | | | |
| CONTIG991 | 16969441_f1_1 | 13666 | 27769 | 600 | 200 | | | | | |
| CONTIG996 | 26210131_c3_2 | 13667 | 27770 | 246 | 82 | | | | | |
| CONTIG997 | 11803805_f3_1 | 13668 | 27771 | 213 | 71 | | | | | |
| CONTIG999 | 1255308_c3_3 | 13669 | 27772 | 312 | 104 | | | | | |
| b1x18255.y | 35348317_f3_1 | 13670 | 27773 | 288 | 96 | | | | | |
| b9x13v03.x | 14957127_c2_2 | 13671 | 27774 | 552 | 184 | | | | | |
| b9x13u01.y | 34101662_f2_1 | 13672 | 27775 | 246 | 82 | | | | | |
| b9x13t68.x | 1208157_f1_2 | 13673 | 27776 | 543 | 181 | | | | | |
| b9x13t36.y | 881635_f1_1 | 13674 | 27777 | 246 | 82 | | | | | |
| b9x13s82.x | 4787683_f3_1 | 13675 | 27778 | 189 | 63 | | | | | |
| b2x16582.x | 33406550_f1_1 | 13676 | 27779 | 294 | 98 | | | | | |
| b9x13f20.y | 22347163_f3_1 | 13677 | 27780 | 534 | 178 | | | | | |
| b9x13q46.y | 23866300_f3_1 | 13678 | 27781 | 744 | 248 | | | | | |
| b9x13q33.x | 4964392_f3_2 | 13679 | 27782 | 267 | 89 | | | | | |
| b2x16511.y | 11056425_f3_1 | 13680 | 27783 | 354 | 118 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x10334.x | 36617892_c2_1 | 13681 | 27784 | 207 | 69 | | | | | |
| b9x13m42.y | 9864092_c3_1 | 13682 | 27785 | 243 | 81 | | | | | |
| b1x10357.x | 20353500_c1_2 | 13683 | 27786 | 252 | 84 | | | | | |
| b9x13k53.y | 23625653_c1_1 | 13684 | 27787 | 324 | 108 | | | | | |
| b9x13k09.x | 22464751_c3_6 | 13685 | 27788 | 438 | 146 | | | | | |
| b1x10361.x | 4415893_f1_1 | 13686 | 27789 | 471 | 157 | | | | | |
| b9x18370.y | 23630260_f1_1 | 13687 | 27790 | 477 | 159 | | | | | |
| b9x13h46.x | 34022550_c1_1 | 13688 | 27791 | 510 | 170 | | | | | |
| b2x16278.x | 3363200_f3_3 | 13689 | 27792 | 723 | 241 | | | | | |
| b2x16264.y | 2141053_c3_5 | 13690 | 27793 | 378 | 126 | | | | | |
| b9x13g03.x | 29468785_f2_1 | 13691 | 27794 | 297 | 99 | | | | | |
| b1x11303.y | 33229666_f1_1 | 13692 | 27795 | 339 | 113 | | | | | |
| b9x13g02.x | 30163187_f1_1 | 13693 | 27796 | 477 | 159 | | | | | |
| b2x16118.x | 24298502_c2_2 | 13694 | 27797 | 198 | 66 | | | | | |
| b9x13f89.x | 23860912_f2_1 | 13695 | 27798 | 228 | 76 | | | | | |
| b9x13f47.y | 14922067_f3_3 | 13696 | 27799 | 309 | 103 | | | | | |
| b9x13e89.y | 12704410_c1_3 | 13697 | 27800 | 417 | 139 | | | | | |
| b9x13e70.x | 23837513_c2_2 | 13698 | 27801 | 225 | 75 | | | | | |
| b9x13e18.y | 5281661_c3_5 | 13699 | 27802 | 201 | 67 | | | | | |
| b9x13e18.y | 35188762_c3_6 | 13700 | 27803 | 222 | 74 | | | | | |
| b1x18436.y | 1006406_f3_1 | 13701 | 27804 | 201 | 67 | | | | | |
| b9x13d35.x | 30364566_f1_1 | 13702 | 27805 | 585 | 195 | | | | | |
| b9x13d16.y | 6348880_f1_1 | 13703 | 27806 | 216 | 72 | | | | | |
| b9x13d16.y | 22062812_c3_3 | 13704 | 27807 | 528 | 176 | | | | | |
| b9x13d08.x | 956580_c3_4 | 13705 | 27808 | 255 | 85 | | | | | |
| b9x13c92.x | 5360383_f1_1 | 13706 | 27809 | 192 | 64 | | | | | |
| b2x16057.x | 4726536_f2_1 | 13707 | 27810 | 603 | 201 | | | | | |
| b9x13c06.y | 11915925_f2_2 | 13708 | 27811 | 186 | 62 | | | | | |
| b9x13c06.y | 30265928_c3_4 | 13709 | 27812 | 183 | 61 | | | | | |
| b1x18443.x | 22558255_f3_1 | 13710 | 27813 | 492 | 164 | | | | | |
| b1x18443.x | 35969633_c3_3 | 13711 | 27814 | 243 | 81 | | | | | |
| b2x15980.y | 33644630_c3_3 | 13712 | 27815 | 564 | 188 | | | | | |
| b9x13a50.x | 4348957_f2_1 | 13713 | 27816 | 204 | 68 | | | | | |
| b9x13872.y | 15626282_c1_2 | 13714 | 27817 | 189 | 63 | | | | | |
| b9x13854.y | 21883437_f1_1 | 13715 | 27818 | 498 | 166 | | | | | |
| b9x13854.y | 6510906_f2_2 | 13716 | 27819 | 261 | 87 | | | | | |
| b1x18485.x | 4000338_c3_1 | 13717 | 27820 | 432 | 144 | | | | | |
| b9x13665.x | 10009626_c3_1 | 13718 | 27821 | 627 | 209 | | | | | |
| b9x13527.y | 19694066_c2_4 | 13719 | 27822 | 246 | 82 | | | | | |
| b2x15766.x | 6835838_f3_3 | 13720 | 27823 | 333 | 111 | | | | | |
| b2x15766.x | 35209750_c1_4 | 13721 | 27824 | 219 | 73 | | | | | |
| b2x15766.x | 25432825_c3_5 | 13722 | 27825 | 261 | 87 | | | | | |
| b9x13491.x | 59844467_f1_2 | 13723 | 27826 | 219 | 73 | | | | | |
| b9x13491.x | 29487557_c3_3 | 13724 | 27827 | 933 | 311 | | | | | |
| b2x15753.y | 25985317_f2_3 | 13725 | 27828 | 534 | 178 | | | | | |
| b9x13380.x | 1062693_f1_1 | 13726 | 27829 | 435 | 145 | | | | | |
| b9x13319.y | 35156537_c1_2 | 13727 | 27830 | 258 | 86 | | | | | |
| b2x15753.x | 14492337_f2_3 | 13728 | 27831 | 333 | 111 | | | | | |
| b9x13249.x | 12268763_f1_1 | 13729 | 27832 | 600 | 200 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x12z69.x | 4456550_f2_1 | 13730 | 27833 | 501 | 167 | | | | | |
| b9x12y87.y | 31407053_f3_1 | 13731 | 27834 | 492 | 164 | | | | | |
| b2x15727.x | 4880140_c2_1 | 13732 | 27835 | 210 | 70 | | | | | |
| b9x12w88.x | 829378_f1_1 | 13733 | 27836 | 195 | 65 | | | | | |
| b9x12w88.x | 21493761_f2_2 | 13734 | 27837 | 327 | 109 | | | | | |
| b9x12w72.x | 10350061_c1_4 | 13735 | 27838 | 510 | 170 | | | | | |
| b9x12w68.x | 24697555_c3_5 | 13736 | 27839 | 387 | 129 | | | | | |
| b9x12v46.x | 16531686_c2_1 | 13737 | 27840 | 480 | 160 | | | | | |
| b2x15689.y | 33258342_c2_3 | 13738 | 27841 | 189 | 63 | | | | | |
| b9x12v30.x | 24318171_c3_2 | 13739 | 27842 | 345 | 115 | | | | | |
| b9x12u82.x | 32225837_f2_1 | 13740 | 27843 | 243 | 81 | | | | | |
| b1x10645.x | 4775286_c2_4 | 13741 | 27844 | 204 | 68 | | | | | |
| b9x12u61.y | 5314677_f3_1 | 13742 | 27845 | 261 | 87 | | | | | |
| b1x13827.x | 23882951_c3_2 | 13743 | 27846 | 195 | 65 | | | | | |
| b9x12u17.y | 471040_f2_1 | 13744 | 27847 | 507 | 169 | | | | | |
| b2x12147.y | 13023593_c2_8 | 13745 | 27848 | 327 | 109 | | | | | |
| b9x12t15.y | 34573957_c2_6 | 13746 | 27849 | 237 | 79 | | | | | |
| b9x12t15.y | 24026578_c2_7 | 13747 | 27850 | 204 | 68 | | | | | |
| b9x12q68.y | 16408442_f3_2 | 13748 | 27851 | 711 | 237 | | | | | |
| b9x12n61.x | 3157180_f3_2 | 13749 | 27852 | 588 | 196 | | | | | |
| b9x12n61.x | 4892127_c3_5 | 13750 | 27853 | 306 | 102 | | | | | |
| b9x12n34.y | 10600307_f3_1 | 13751 | 27854 | 198 | 66 | | | | | |
| b2x15645.y | 24016567_f1_1 | 13752 | 27855 | 375 | 125 | | | | | |
| b2x15645.y | 957827_f2_2 | 13753 | 27856 | 390 | 130 | | | | | |
| b2x15645.y | 2924177_c2_4 | 13754 | 27857 | 360 | 120 | | | | | |
| b2x15632.y | 4694377_c1_2 | 13755 | 27858 | 363 | 121 | | | | | |
| b2x15632.y | 4864211_c2_3 | 13756 | 27859 | 507 | 169 | | | | | |
| b2x15632.y | 5282802_f1_1 | 13757 | 27860 | 582 | 194 | | | | | |
| b9x12k65.x | 3927008_c2_2 | 13758 | 27861 | 225 | 75 | | | | | |
| b9x12k65.x | 6094632_f1_1 | 13759 | 27862 | 183 | 61 | | | | | |
| b2x15443.x | 24801342_f2_2 | 13760 | 27863 | 198 | 66 | | | | | |
| b2x15443.x | 2166042_f3_3 | 13761 | 27864 | 192 | 64 | | | | | |
| b9x12h24.x | 13880181_f3_1 | 13762 | 27865 | 621 | 207 | | | | | |
| b9x12h24.x | 25630378_c3_3 | 13763 | 27866 | 327 | 109 | | | | | |
| b2x12l56.y | 21658462_f2_1 | 13764 | 27867 | 231 | 77 | | | | | |
| b9x12d49.y | 23632187_c2_1 | 13765 | 27868 | 690 | 230 | | | | | |
| b2x15502.x | 4031638_c1_1 | 13766 | 27869 | 582 | 194 | | | | | |
| b2x15473.x | 25586075_c1_1 | 13767 | 27870 | 339 | 113 | | | | | |
| b2x12989.y | 806599_c1_2 | 13768 | 27871 | 192 | 64 | | | | | |
| b9x12884.x | 5979140_c2_3 | 13769 | 27872 | 183 | 61 | | | | | |
| b9x12850.y | 36537580_f1_1 | 13770 | 27873 | 192 | 64 | | | | | |
| b9x12850.y | 10945200_f2_3 | 13771 | 27874 | 420 | 140 | | | | | |
| b9x12850.y | 1225305_c2_6 | 13772 | 27875 | 249 | 83 | | | | | |
| b9x12776.y | 24020312_c1_4 | 13773 | 27876 | 240 | 80 | | | | | |
| b9x12776.y | 34429652_c2_5 | 13774 | 27877 | 372 | 124 | | | | | |
| b2x12886.x | 2437665_c2_3 | 13775 | 27878 | 195 | 65 | | | | | |
| b2x12886.x | 25428135_c3_4 | 13776 | 27879 | 303 | 101 | | | | | |
| b9x12658.y | 24801561_f1_1 | 13777 | 27880 | 204 | 68 | | | | | |
| b9x12636.y | 22296875_c1_2 | 13778 | 27881 | 189 | 63 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9xl2636.y | 1174186_c1_3 | 13779 | 27882 | 183 | 61 | | | | | |
| b2xl2591.x | 2394167_f1_1 | 13780 | 27883 | 585 | 195 | | | | | |
| b9xl2387.y | 13944050_f1_1 | 13781 | 27884 | 267 | 89 | | | | | |
| b2xl2835.y | 1289280_f2_1 | 13782 | 27885 | 570 | 190 | | | | | |
| b2xl2220.x | 22267813_c2_2 | 13783 | 27886 | 201 | 67 | | | | | |
| b2xl2829.x | 3638002_f2_1 | 13784 | 27887 | 198 | 66 | | | | | |
| b9xl1y56.y | 14454757_c2_2 | 13785 | 27888 | 474 | 158 | | | | | |
| b9xl1x80.x | 31683200_c1_1 | 13786 | 27889 | 255 | 85 | | | | | |
| b1xl18647.x | 24008386_c1_1 | 13787 | 27890 | 444 | 148 | | | | | |
| b9xl1u44.x | 15051265_f1_1 | 13788 | 27891 | 222 | 74 | | | | | |
| b9xl1u44.x | 15791308_c1_4 | 13789 | 27892 | 285 | 95 | | | | | |
| b9xl1u44.x | 5292132_c1_5 | 13790 | 27893 | 183 | 61 | | | | | |
| b9xl1u44.x | 20045392_c1_6 | 13791 | 27894 | 306 | 102 | | | | | |
| b9xl1u19.y | 4776501_c2_5 | 13792 | 27895 | 237 | 79 | | | | | |
| b9xl1l77.y | 21954530_c2_1 | 13793 | 27896 | 381 | 127 | | | | | |
| b2xl2792.x | 22441402_f2_1 | 13794 | 27897 | 198 | 66 | | | | | |
| b2xl2792.x | 21490875_c1_2 | 13795 | 27898 | 204 | 68 | | | | | |
| b9xl1s25.x | 23469012_c2_1 | 13796 | 27899 | 405 | 135 | | | | | |
| b1xl1014.y | 8586_f1_1 | 13797 | 27900 | 387 | 129 | | | | | |
| b1xl1014.y | 4063135_f1_2 | 13798 | 27901 | 204 | 68 | | | | | |
| b9xl1r08.x | 114078_c1_1 | 13799 | 27902 | 195 | 65 | | | | | |
| b9xl1p67.y | 23617211_c1_2 | 13800 | 27903 | 189 | 63 | | | | | |
| b9xl1p67.y | 937_c2_3 | 13801 | 27904 | 531 | 177 | | | | | |
| b9xl1p67.y | 782807_c3_4 | 13802 | 27905 | 216 | 72 | | | | | |
| b9xl1m54.x | 14563427_f2_1 | 13803 | 27906 | 627 | 209 | | | | | |
| b9xl1m02.x | 3937812_c1_3 | 13804 | 27907 | 186 | 62 | | | | | |
| b9xl1k38.y | 11798151_c3_1 | 13805 | 27908 | 276 | 92 | | | | | |
| b2xl2587.x | 35759750_f3_2 | 13806 | 27909 | 195 | 65 | | | | | |
| b2xl3483.y | 12213275_c1_4 | 13807 | 27910 | 183 | 61 | | | | | |
| b2xl2566.x | 4688812_c3_4 | 13808 | 27911 | 276 | 92 | | | | | |
| b9xl1j77.y | 25516626_c2_4 | 13809 | 27912 | 474 | 158 | | | | | |
| b9xl1j77.y | 13709675_c3_5 | 13810 | 27913 | 207 | 69 | | | | | |
| b9xl1g23.x | 14460137_f2_2 | 13811 | 27914 | 294 | 98 | | | | | |
| b9xl1f43.x | 6817182_c2_5 | 13812 | 27915 | 573 | 191 | | | | | |
| b9xl1f34.x | 22470438_c2_1 | 13813 | 27916 | 570 | 190 | | | | | |
| b9xl1f26.x | 10345443_c2_2 | 13814 | 27917 | 432 | 144 | | | | | |
| b2xl2437.x | 32304200_f3_2 | 13815 | 27918 | 237 | 79 | | | | | |
| b9xl1e17.x | 433332_f2_1 | 13816 | 27919 | 609 | 203 | | | | | |
| b1xl18781.x | 9652_c2_1 | 13817 | 27920 | 399 | 133 | | | | | |
| b9xl1c47.x | 29886501_f3_1 | 13818 | 27921 | 198 | 66 | | | | | |
| b9xl1c30.y | 14464782_c3_2 | 13819 | 27922 | 273 | 91 | | | | | |
| b9xl1956.x | 6412535_f3_3 | 13820 | 27923 | 213 | 71 | | | | | |
| b9xl1954.y | 4006930_c1_5 | 13821 | 27924 | 474 | 158 | | | | | |
| b9xl1910.y | 15735002_f3_2 | 13822 | 27925 | 213 | 71 | | | | | |
| b9xl1910.y | 21678402_c2_3 | 13823 | 27926 | 234 | 78 | | | | | |
| b9xl1677.x | 24413962_c2_3 | 13824 | 27927 | 228 | 76 | | | | | |
| b9xl1364.y | 10001557_f3_1 | 13825 | 27928 | 288 | 96 | | | | | |
| b9xl1233.y | 34199187_c1_3 | 13826 | 27929 | 219 | 73 | | | | | |
| b9xl1209.x | 390755_f3_2 | 13827 | 27930 | 231 | 77 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b9x11209.x | 35214067_c2_3 | 13828 | 27931 | 309 | 103 | | | | | |
| b9x11203.y | 4082031_f2_1 | 13829 | 27932 | 228 | 76 | | | | | |
| b9x11203.x | 10977127_c2_2 | 13830 | 27933 | 348 | 116 | | | | | |
| b9x11160.x | 10945950_c1_5 | 13831 | 27934 | 255 | 85 | | | | | |
| b9x11137.x | 3235386_f3_1 | 13832 | 27935 | 378 | 126 | | | | | |
| b9x11074.x | 26384712_c1_2 | 13833 | 27936 | 186 | 62 | | | | | |
| b9x11044.y | 25875430_c2_6 | 13834 | 27937 | 789 | 263 | | | | | |
| b9x10y60x | 4688952_f3_2 | 13835 | 27938 | 201 | 67 | | | | | |
| b9x10w84.y | 1203125_c3_2 | 13836 | 27939 | 462 | 154 | | | | | |
| b9x10v59.x | 22848532_c2_2 | 13837 | 27940 | 216 | 72 | | | | | |
| b9x10v30.y | 23548425_c3_2 | 13838 | 27941 | 360 | 120 | | | | | |
| b1x18786.x | 24414132_c1_2 | 13839 | 27942 | 261 | 87 | | | | | |
| b9x10u31.x | 6412687_f3_1 | 13840 | 27943 | 192 | 64 | | | | | |
| b9x10t79.x | 15627_f2_1 | 13841 | 27944 | 318 | 106 | | | | | |
| b9x10t79.x | 30663212_c2_2 | 13842 | 27945 | 219 | 73 | | | | | |
| b9x10r19.x | 4890713_f3_1 | 13843 | 27946 | 870 | 290 | | | | | |
| b2x11969.y | 33469040_f3_1 | 13844 | 27947 | 210 | 70 | | | | | |
| b2x11959.y | 25413263_c3_2 | 13845 | 27948 | 516 | 172 | | | | | |
| b9x10p88.x | 24870777_f3_1 | 13846 | 27949 | 567 | 189 | | | | | |
| b1x18823.x | 5275337_c1_1 | 13847 | 27950 | 243 | 81 | | | | | |
| b2x13860.y | 22863178_c3_2 | 13848 | 27951 | 189 | 63 | | | | | |
| b9x10j44.x | 428192_f1_1 | 13849 | 27952 | 420 | 140 | | | | | |
| b2x11862.y | 16925255_f2_1 | 13850 | 27953 | 531 | 177 | | | | | |
| b2x13867.y | 6485916_f2_1 | 13851 | 27954 | 198 | 66 | | | | | |
| b9x10g01.y | 2000141_f2_1 | 13852 | 27955 | 192 | 64 | | | | | |
| b2x11832.y | 3910156_f2_1 | 13853 | 27956 | 516 | 172 | | | | | |
| b2x13879.x | 21492000_c3_2 | 13854 | 27957 | 210 | 70 | | | | | |
| b9x10f68.y | 3142312_f1_1 | 13855 | 27958 | 183 | 61 | | | | | |
| b2x13887.x | 433332_f3_2 | 13856 | 27959 | 603 | 201 | | | | | |
| b9x10e19.y | 19689442_c2_1 | 13857 | 27960 | 195 | 65 | | | | | |
| b2x11681.x | 236538_f3_3 | 13858 | 27961 | 756 | 252 | | | | | |
| b9x10d47.x | 212937_c3_4 | 13859 | 27962 | 207 | 69 | | | | | |
| b9x10c06.x | 16832782_c2_4 | 13860 | 27963 | 432 | 144 | | | | | |
| b9x10b37.y | 24228303_f1_1 | 13861 | 27964 | 201 | 67 | | | | | |
| b9x10b37.y | 5099050_f3_3 | 13862 | 27965 | 303 | 101 | | | | | |
| b9x10b27.y | 2395762_f2_2 | 13863 | 27966 | 282 | 94 | | | | | |
| b9x10b25.y | 5975306_f1_1 | 13864 | 27967 | 312 | 104 | | | | | |
| b1x18857.y | 14196925_c1_2 | 13865 | 27968 | 282 | 94 | | | | | |
| b9x10a29.y | 20082527_c2_4 | 13866 | 27969 | 336 | 112 | | | | | |
| b2x11578.y | 16854567_f2_1 | 13867 | 27970 | 462 | 154 | | | | | |
| b9x10895.x | 9922050_c2_1 | 13868 | 27971 | 492 | 164 | | | | | |
| b2x13929.x | 20597825_f3_3 | 13869 | 27972 | 384 | 128 | | | | | |
| b9x10747.x | 9928153_c3_4 | 13870 | 27973 | 444 | 148 | | | | | |
| b9x10689.y | 4734713_f1_1 | 13871 | 27974 | 213 | 71 | | | | | |
| b9x10689.y | 6376949_c1_2 | 13872 | 27975 | 180 | 60 | | | | | |
| b1x18871.y | 13678760_c3_3 | 13873 | 27976 | 492 | 164 | | | | | |
| b9x10620.y | 7040750_f3_1 | 13874 | 27977 | 294 | 98 | | | | | |
| b9x10620.y | 396925_c1_2 | 13875 | 27978 | 237 | 79 | | | | | |
| b1x11420.y | 22394525_f2_1 | 13876 | 27979 | 204 | 68 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x11420.y | 25572202_f2_3 | 13877 | 27980 | 204 | 68 | | | | | |
| b9x10571.y | 12695282_f3_2 | 13878 | 27981 | 183 | 61 | | | | | |
| b9x10571.y | 29510925_c3_3 | 13879 | 27982 | 687 | 229 | | | | | |
| b9x10568.x | 19956912_c3_3 | 13880 | 27983 | 729 | 243 | | | | | |
| b9x10470.y | 24431917_f3_1 | 13881 | 27984 | 186 | 62 | | | | | |
| b9x10424.y | 26455437_c2_3 | 13882 | 27985 | 537 | 179 | | | | | |
| b2x11126.x | 24431626_f1_1 | 13883 | 27986 | 183 | 61 | | | | | |
| b9x10140.y | 2756885_c1_3 | 13884 | 27987 | 414 | 138 | | | | | |
| b9x10113.y | 20348180_f3_3 | 13885 | 27988 | 264 | 88 | | | | | |
| b4x10394.x | 12678137_c3_1 | 13886 | 27989 | 192 | 64 | | | | | |
| b4x10393.x | 14100932_c2_2 | 13887 | 27990 | 621 | 207 | | | | | |
| b4x10274.y | 35238387_c1_2 | 13888 | 27991 | 333 | 111 | | | | | |
| b4x10106.x | 36132087_c1_4 | 13889 | 27992 | 645 | 215 | | | | | |
| b3x19646.y | 885386_f2_1 | 13890 | 27993 | 246 | 82 | | | | | |
| b3x19646.y | 14953427_c2_2 | 13891 | 27994 | 186 | 62 | | | | | |
| b3x19605.y | 5350325_c2_2 | 13892 | 27995 | 186 | 62 | | | | | |
| b3x19517.y | 30504813_c3_5 | 13893 | 27996 | 228 | 76 | | | | | |
| b2x11002.y | 5338561_f3_2 | 13894 | 27997 | 606 | 202 | | | | | |
| b3x19470.y | 5116406_f1_1 | 13895 | 27998 | 183 | 61 | | | | | |
| b3x19283.y | 36385062_f1_1 | 13896 | 27999 | 384 | 128 | | | | | |
| b3x19243.x | 32663974_c1_4 | 13897 | 28000 | 213 | 71 | | | | | |
| b3x19234.y | 28800030_f3_1 | 13898 | 28001 | 186 | 62 | | | | | |
| b1x11554.y | 23625305_f3_1 | 13899 | 28002 | 387 | 129 | | | | | |
| b1x11554.y | 13703450_c3_3 | 13900 | 28003 | 420 | 140 | | | | | |
| b3x18982.y | 4725030_c1_4 | 13901 | 28004 | 225 | 75 | | | | | |
| b3x18807.y | 4038442_f3_1 | 13902 | 28005 | 267 | 89 | | | | | |
| b3x18737.y | 781250_c1_2 | 13903 | 28006 | 657 | 219 | | | | | |
| b3x18642.x | 29410681_c3_3 | 13904 | 28007 | 411 | 137 | | | | | |
| b3x18592.x | 2048755_f1_1 | 13905 | 28008 | 405 | 135 | | | | | |
| b3x18592.x | 4453127_f3_2 | 13906 | 28009 | 192 | 64 | | | | | |
| b2x10717.x | 23718765_f2_1 | 13907 | 28010 | 489 | 163 | | | | | |
| b3x17956.y | 21746013_c3_3 | 13908 | 28011 | 501 | 167 | | | | | |
| b3x17714.x | 26562500_c1_1 | 13909 | 28012 | 324 | 108 | | | | | |
| b3x17684.y | 15735155_f3_2 | 13910 | 28013 | 183 | 61 | | | | | |
| b3x17370.x | 4568762_f2_1 | 13911 | 28014 | 441 | 147 | | | | | |
| b3x17064.y | 4821950_f1_1 | 13912 | 28015 | 459 | 153 | | | | | |
| b3x16962.y | 23476425_f1_1 | 13913 | 28016 | 207 | 69 | | | | | |
| b3x16871.y | 3907783_f1_1 | 13914 | 28017 | 486 | 162 | | | | | |
| b2x14264.y | 1048312_c1_2 | 13915 | 28018 | 207 | 69 | | | | | |
| b3x16673.x | 291663_f2_1 | 13916 | 28019 | 648 | 216 | | | | | |
| b3x16673.x | 13939087_f2_2 | 13917 | 28020 | 243 | 81 | | | | | |
| b1x19249.x | 433332_f1_1 | 13918 | 28021 | 579 | 193 | | | | | |
| b1x19249.x | 2112877_c2_2 | 13919 | 28022 | 234 | 78 | | | | | |
| b2x10230.x | 9782967_f3_1 | 13920 | 28023 | 207 | 69 | | | | | |
| b3x16529.y | 22447260_f3_1 | 13921 | 28024 | 231 | 77 | | | | | |
| b3x16483.x | 23709678_c3_3 | 13922 | 28025 | 309 | 103 | | | | | |
| b1x19259.y | 21520002_c3_1 | 13923 | 28026 | 765 | 255 | | | | | |
| b3x16120.y | 35807758_f1_1 | 13924 | 28027 | 498 | 166 | | | | | |
| b3x16113.x | 24415637_c2_2 | 13925 | 28028 | 234 | 78 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x16093.y | 16532836_c1_4 | 13926 | 28029 | 246 | 82 | | | | | |
| b3x16089.y | 15103550_f1_1 | 13927 | 28030 | 765 | 255 | | | | | |
| b3x16083.y | 5337801_f1_1 | 13928 | 28031 | 198 | 66 | | | | | |
| b3x16069.y | 22150053_c2_3 | 13929 | 28032 | 222 | 74 | | | | | |
| b3x16067.y | 11180135_f1_1 | 13930 | 28033 | 204 | 68 | | | | | |
| b3x16067.y | 29690641_f2_2 | 13931 | 28034 | 240 | 80 | | | | | |
| b3x16062.y | 4176290_c1_1 | 13932 | 28035 | 213 | 71 | | | | | |
| b3x16061.y | 5942261_c1_5 | 13933 | 28036 | 348 | 116 | | | | | |
| b3x16058.y | 5370182_f2_2 | 13934 | 28037 | 399 | 133 | | | | | |
| b3x16054.y | 26850392_f2_1 | 13935 | 28038 | 207 | 69 | | | | | |
| b3x16050.y | 6723214_c1_3 | 13936 | 28039 | 183 | 61 | | | | | |
| b3x16050.y | 12125043_c2_4 | 13937 | 28040 | 222 | 74 | | | | | |
| b3x16048.y | 1175375_c2_4 | 13938 | 28041 | 210 | 70 | | | | | |
| b1x11921.y | 29564002_c1_2 | 13939 | 28042 | 183 | 61 | | | | | |
| b3x16046.y | 26692801_f1_1 | 13940 | 28043 | 189 | 63 | | | | | |
| b3x16043.y | 24025288_f2_3 | 13941 | 28044 | 279 | 93 | | | | | |
| b3x16043.y | 30277288_c2_6 | 13942 | 28045 | 270 | 90 | | | | | |
| b3x16042.y | 32243965_f3_3 | 13943 | 28046 | 240 | 80 | | | | | |
| b3x16041.x | 478166_f3_1 | 13944 | 28047 | 189 | 63 | | | | | |
| b3x16039.y | 23915660_f3_1 | 13945 | 28048 | 258 | 86 | | | | | |
| b3x16039.y | 480436_c1_3 | 13946 | 28049 | 195 | 65 | | | | | |
| b3x16035.y | 29334635_f3_4 | 13947 | 28050 | 249 | 83 | | | | | |
| b3x16035.y | 36598936_c2_6 | 13948 | 28051 | 231 | 77 | | | | | |
| b3x16032.y | 19631632_f1_1 | 13949 | 28052 | 660 | 220 | | | | | |
| b1x11963.y | 23603442_f1_1 | 13950 | 28053 | 192 | 64 | | | | | |
| b1x11963.y | 9853430_f1_2 | 13951 | 28054 | 603 | 201 | | | | | |
| b1x11963.y | 4766385_c2_5 | 13952 | 28055 | 207 | 69 | | | | | |
| b3x16011.y | 32610410_f1_1 | 13953 | 28056 | 186 | 62 | | | | | |
| b1x11972.x | 2193758_c1_2 | 13954 | 28057 | 846 | 282 | | | | | |
| b3x16010.y | 4193933_f3_2 | 13955 | 28058 | 285 | 95 | | | | | |
| b1x11984.y | 36525947_f3_3 | 13956 | 28059 | 861 | 287 | | | | | |
| b3x16005.y | 11062677_c2_4 | 13957 | 28060 | 225 | 75 | | | | | |
| b3x16004.y | 31698941_f1_1 | 13958 | 28061 | 240 | 80 | | | | | |
| b3x16002.y | 32518761_f3_4 | 13959 | 28062 | 270 | 90 | | | | | |
| b3x15960.y | 29296925_c3_2 | 13960 | 28063 | 258 | 86 | | | | | |
| b3x15773.y | 7157826_c1_2 | 13961 | 28064 | 210 | 70 | | | | | |
| b3x15701.x | 24422152_c3_2 | 13962 | 28065 | 465 | 155 | | | | | |
| b3x15687.x | 23486632_c3_2 | 13963 | 28066 | 543 | 181 | | | | | |
| b3x15661.y | 191038_f2_1 | 13964 | 28067 | 246 | 82 | | | | | |
| b1x19595.y | 208325_f2_1 | 13965 | 28068 | 591 | 197 | | | | | |
| b9x13v91.x | 14570262_f1_1 | 13966 | 28069 | 246 | 82 | | | | | |
| b3x15457.y | 34027307_c3_1 | 13967 | 28070 | 561 | 187 | | | | | |
| b1x14536.y | 5088533_f1_1 | 13968 | 28071 | 504 | 168 | | | | | |
| b3x15367.x | 16663391_f3_1 | 13969 | 28072 | 219 | 73 | | | | | |
| b3x15361.y | 14563885_f3_1 | 13970 | 28073 | 357 | 119 | | | | | |
| b3x15328.x | 2430812_f1_1 | 13971 | 28074 | 264 | 88 | | | | | |
| b1x14543.y | 9812625_c2_2 | 13972 | 28075 | 201 | 67 | | | | | |
| b1x14543.y | 274082_c3_3 | 13973 | 28076 | 312 | 104 | | | | | |
| b2x14358.y | 10985075_f2_1 | 13974 | 28077 | 231 | 77 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1xl4555.y | 5914687_c1_1 | 13975 | 28078 | 261 | 87 | | | | | |
| b1xl4555.y | 26367630_c2_2 | 13976 | 28079 | 255 | 85 | | | | | |
| b3xl5141.y | 2150800_c1_1 | 13977 | 28080 | 189 | 63 | | | | | |
| b3xl5121.y | 3955377_f2_1 | 13978 | 28081 | 201 | 67 | | | | | |
| b3xl5082.x | 29334842_f1_1 | 13979 | 28082 | 210 | 70 | | | | | |
| b1xl4944.x | 23554625_c2_1 | 13980 | 28083 | 522 | 174 | | | | | |
| b1xl4905.y | 21878843_f1_1 | 13981 | 28084 | 504 | 168 | | | | | |
| b1xl4919.y | 2010414_f1_1 | 13982 | 28085 | 186 | 62 | | | | | |
| b3xl4811.x | 21657636_c2_2 | 13983 | 28086 | 204 | 68 | | | | | |
| b3xl4807.x | 22445181_c3_5 | 13984 | 28087 | 510 | 170 | | | | | |
| b1xl4928.x | 6359842_c2_3 | 13985 | 28088 | 183 | 61 | | | | | |
| b2xl3268.x | 13143782_f3_1 | 13986 | 28089 | 570 | 190 | | | | | |
| b1xl5013.x | 13830301_c3_1 | 13987 | 28090 | 189 | 63 | | | | | |
| b1xl2474.x | 3140777_c3_2 | 13988 | 28091 | 195 | 65 | | | | | |
| b3xl4569.x | 861627_c2_1 | 13989 | 28092 | 267 | 89 | | | | | |
| b2xl3268.x | 34117127_c1_1 | 13990 | 28093 | 192 | 64 | | | | | |
| b2xl3268.x | 25823437_c2_2 | 13991 | 28094 | 276 | 92 | | | | | |
| b3xl4433.y | 21538877_c1_3 | 13992 | 28095 | 441 | 147 | | | | | |
| b2xl4441.y | 24406937_f2_2 | 13993 | 28096 | 390 | 130 | | | | | |
| b3xl4418.y | 22837578_f3_4 | 13994 | 28097 | 297 | 99 | | | | | |
| b1xl2521.y | 33382282_c1_2 | 13995 | 28098 | 690 | 230 | | | | | |
| b3xl4292.y | 662887_f1_1 | 13996 | 28099 | 213 | 71 | | | | | |
| b1xl5077.y | 4101562_c2_3 | 13997 | 28100 | 288 | 96 | | | | | |
| b3xl4239.y | 9805406_f1_1 | 13998 | 28101 | 393 | 131 | | | | | |
| b1xl5145.y | 188385_c1_1 | 13999 | 28102 | 645 | 215 | | | | | |
| b1xl4330.x | 4415937_c2_1 | 14000 | 28103 | 360 | 120 | | | | | |
| b3xl3926.x | 14143762_f2_1 | 14001 | 28104 | 204 | 68 | | | | | |
| b3xl3893.x | 22673766_f3_1 | 14002 | 28105 | 351 | 117 | | | | | |
| b1xl5375.x | 585811_f2_1 | 14003 | 28106 | 402 | 134 | | | | | |
| b1xl5375.x | 15762_c3_4 | 14004 | 28107 | 360 | 120 | | | | | |
| b3xl3751.y | 22266893_c1_3 | 14005 | 28108 | 810 | 270 | | | | | |
| b3xl3728.y | 454752_c2_1 | 14006 | 28109 | 264 | 88 | | | | | |
| b1xl5451.x | 14335937_f2_1 | 14007 | 28110 | 207 | 69 | | | | | |
| b3xl3525.x | 24397802_c2_1 | 14008 | 28111 | 213 | 71 | | | | | |
| b3xl3430.x | 34111378_f3_3 | 14009 | 28112 | 186 | 62 | | | | | |
| b3xl3315.y | 20334687_f1_1 | 14010 | 28113 | 288 | 96 | | | | | |
| b3xl3305.y | 23625187_f2_1 | 14011 | 28114 | 198 | 66 | | | | | |
| b3xl3305.y | 24414633_c3_4 | 14012 | 28115 | 198 | 66 | | | | | |
| b3xl3296.y | 36584432_c2_2 | 14013 | 28116 | 480 | 160 | | | | | |
| b2xl4580.y | 10657512_c2_1 | 14014 | 28117 | 561 | 187 | | | | | |
| b1xl5611.x | 14845125_f3_1 | 14015 | 28118 | 192 | 64 | | | | | |
| b2xl4584.x | 14453557_c2_2 | 14016 | 28119 | 387 | 129 | | | | | |
| b3xl3229.x | 6024000_c2_1 | 14017 | 28120 | 204 | 68 | | | | | |
| b3xl3229.x | 22836406_f1_1 | 14018 | 28121 | 240 | 80 | | | | | |
| b3xl3227.y | 1381932_c3_4 | 14019 | 28122 | 186 | 62 | | | | | |
| b1xl2619.x | 24313408_f2_3 | 14020 | 28123 | 261 | 87 | | | | | |
| b1xl2619.x | 12911410_f3_4 | 14021 | 28124 | 189 | 63 | | | | | |
| b3xl3156.x | 26375187_c3_2 | 14022 | 28125 | 480 | 160 | | | | | |
| b3xl3155.x | 11182316_f1_1 | 14023 | 28126 | 465 | 155 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b3x12876.x | 838535_f2_1 | 14024 | 28127 | 633 | 211 | | | | | |
| b3x12330.x | 23984437_f2_3 | 14025 | 28128 | 300 | 100 | | | | | |
| b3x12330.x | 34651567_c3_7 | 14026 | 28129 | 345 | 115 | | | | | |
| b1x12671.y | 14667661_c3_6 | 14027 | 28130 | 207 | 69 | | | | | |
| b3x12303.y | 19744825_f3_2 | 14028 | 28131 | 558 | 186 | | | | | |
| b3x12302.x | 23444552_f1_1 | 14029 | 28132 | 810 | 270 | | | | | |
| b3x12037.x | 22125275_f3_2 | 14030 | 28133 | 753 | 251 | | | | | |
| b3x12037.x | 36218766_c3_3 | 14031 | 28134 | 216 | 72 | | | | | |
| b1x16215.y | 19704752_c1_2 | 14032 | 28135 | 204 | 68 | | | | | |
| b1x1907.x | 35172342_f2_1 | 14033 | 28136 | 186 | 62 | | | | | |
| b3x1387.y | 10678400_f2_1 | 14034 | 28137 | 183 | 61 | | | | | |
| b2x14667.x | 24808302_c3_3 | 14035 | 28138 | 519 | 173 | | | | | |
| b3x11306.x | 26443828_c3_4 | 14036 | 28139 | 186 | 62 | | | | | |
| b1x16457.x | 13157780_f2_1 | 14037 | 28140 | 399 | 133 | | | | | |
| b1x11148.x | 34037932_c3_2 | 14038 | 28141 | 192 | 64 | | | | | |
| b1x16748.y | 34570187_c3_5 | 14039 | 28142 | 183 | 61 | | | | | |
| b3x11108.y | 2944057_f3_1 | 14040 | 28143 | 462 | 154 | | | | | |
| b1x10861.y | 14485132_f2_1 | 14041 | 28144 | 210 | 70 | | | | | |
| b3x10133.x | 2365963_f3_1 | 14042 | 28145 | 210 | 70 | | | | | |
| b3x10122.x | 961543_c2_4 | 14043 | 28146 | 204 | 68 | | | | | |
| b1x16965.y | 5110687_c1_2 | 14044 | 28147 | 636 | 212 | | | | | |
| b2x19530.y | 2925652_c2_2 | 14045 | 28148 | 480 | 160 | | | | | |
| b1x16974.y | 2832031_f2_1 | 14046 | 28149 | 456 | 152 | | | | | |
| b2x19433.x | 35203325_f1_1 | 14047 | 28150 | 216 | 72 | | | | | |
| b2x14743.x | 22711700_c2_2 | 14048 | 28151 | 198 | 66 | | | | | |
| b2x14743.x | 24335787_c3_3 | 14049 | 28152 | 462 | 154 | | | | | |
| b2x19171.y | 4860936_c3_1 | 14050 | 28153 | 270 | 90 | | | | | |
| b2x14756.y | 20080082_c2_2 | 14051 | 28154 | 225 | 75 | | | | | |
| b2x19077.y | 7126905_f1_1 | 14052 | 28155 | 264 | 88 | | | | | |
| b2x19038.x | 23475676_f2_1 | 14053 | 28156 | 465 | 155 | | | | | |
| b2x18992.y | 20113392_f1_1 | 14054 | 28157 | 186 | 62 | | | | | |
| b1x17289.y | 19923126_f2_1 | 14055 | 28158 | 192 | 64 | | | | | |
| b1x17289.y | 16578765_c2_2 | 14056 | 28159 | 198 | 66 | | | | | |
| b1x17289.y | 33314438_c3_3 | 14057 | 28160 | 195 | 65 | | | | | |
| b2x18774.y | 21486017_f1_1 | 14058 | 28161 | 321 | 107 | | | | | |
| b2x18614.y | 7156558_f3_1 | 14059 | 28162 | 654 | 218 | | | | | |
| b1x18990.y | 16900755_f1_1 | 14060 | 28163 | 627 | 209 | | | | | |
| b2x18896.y | 26842204_f2_1 | 14061 | 28164 | 369 | 123 | | | | | |
| b2x18564.y | 9845035_f2_1 | 14062 | 28165 | 183 | 61 | | | | | |
| b1x18561.y | 4901878_f2_1 | 14063 | 28166 | 270 | 90 | | | | | |
| b2x18550.y | 23865802_c1_3 | 14064 | 28167 | 216 | 72 | | | | | |
| b1x17564.y | 24339078_f2_1 | 14065 | 28168 | 228 | 76 | | | | | |
| b1x17564.y | 6831678_f3_2 | 14066 | 28169 | 297 | 99 | | | | | |
| b1x17564.y | 1990880_c3_3 | 14067 | 28170 | 201 | 67 | | | | | |
| b1x17567.y | 19970192_f1_1 | 14068 | 28171 | 198 | 66 | | | | | |
| b2x18389.x | 24851537_f1_1 | 14069 | 28172 | 390 | 130 | | | | | |
| b1x17708.y | 642665_f3_1 | 14070 | 28173 | 468 | 156 | | | | | |
| b2x18370.y | 32204787_f1_1 | 14071 | 28174 | 528 | 176 | | | | | |
| b2x18261.y | 22461532_f1_1 | 14072 | 28175 | 285 | 95 | | | | | |

TABLE 2-continued

| Contig | Orf | ntID | aaID | nt Length | aa Length | Subject Name | Blast Score | Blast Probability | Subject Taxonomy | Subject Definition |
|---|---|---|---|---|---|---|---|---|---|---|
| b1x17784.y | 6700_c3_1 | 14073 | 28176 | 210 | 70 | | | | | |
| b2x18181.y | 32609552_f1_1 | 14074 | 28177 | 576 | 192 | | | | | |
| b2x18172.x | 22454432_f1_2 | 14075 | 28178 | 429 | 143 | | | | | |
| b2x18172.x | 14096936_c2_4 | 14076 | 28179 | 279 | 93 | | | | | |
| b1x14078.y | 127_c2_1 | 14077 | 28180 | 183 | 61 | | | | | |
| b1x13049.y | 2776442_c3_2 | 14078 | 28181 | 570 | 190 | | | | | |
| b2x18152.x | 578437_f2_3 | 14079 | 28182 | 192 | 64 | | | | | |
| b1x17788.y | 32454675_f2_1 | 14080 | 28183 | 714 | 238 | | | | | |
| b2x18065.x | 11735267_f2_1 | 14081 | 28184 | 219 | 73 | | | | | |
| b2x18056.x | 33634562_f1_1 | 14082 | 28185 | 516 | 172 | | | | | |
| b2x18053.x | 16835943_f2_1 | 14083 | 28186 | 276 | 92 | | | | | |
| b1x17830.y | 33259813_c3_1 | 14084 | 28187 | 306 | 102 | | | | | |
| b2x17956.x | 30267327_f2_1 | 14085 | 28188 | 183 | 61 | | | | | |
| b2x17871.y | 34181300_f1_1 | 14086 | 28189 | 183 | 61 | | | | | |
| b1x17954.y | 24414057_c3_2 | 14087 | 28190 | 402 | 134 | | | | | |
| b1x17864.y | 20595816_c2_1 | 14088 | 28191 | 489 | 163 | | | | | |
| b2x14964.y | 470641_f3_1 | 14089 | 28192 | 780 | 260 | | | | | |
| b2x17609.y | 25422252_f1_1 | 14090 | 28193 | 207 | 69 | | | | | |
| b1x17954.y | 34618753_c3_4 | 14091 | 28194 | 540 | 180 | | | | | |
| b1x17976.y | 20046901_f1_2 | 14092 | 28195 | 354 | 118 | | | | | |
| b1x17976.y | 23594000_c1_3 | 14093 | 28196 | 252 | 84 | | | | | |
| b2x17388.y | 7079206_f2_1 | 14094 | 28197 | 456 | 152 | | | | | |
| b2x17371.y | 4812501_f2_1 | 14095 | 28198 | 282 | 94 | | | | | |
| b2x17371.y | 14569682_c3_2 | 14096 | 28199 | 504 | 168 | | | | | |
| b2x17301.y | 4171903_c2_1 | 14097 | 28200 | 243 | 81 | | | | | |
| b2x17276.y | 4840902_f2_2 | 14098 | 28201 | 507 | 169 | | | | | |
| b2x17229.x | 10580253_c2_4 | 14099 | 28202 | 204 | 68 | | | | | |
| b2x15106.y | 25586442_f3_1 | 14100 | 28203 | 189 | 63 | | | | | |
| b2x15106.y | 48855965_c2_2 | 14101 | 28204 | 348 | 116 | | | | | |
| b2x17138.y | 32628776_f2_1 | 14102 | 28205 | 537 | 179 | | | | | |
| b2x15171.y | 24329705_f2_1 | 14103 | 28206 | 195 | 65 | | | | | |

SEQUENCE LISTING (28206 sequences)

SEQ ID NO: 1 - DNA, 732 bp, Candida albicans
cgatataatactcccatcatttatcttatcgaactaactataaatgatgtatcaaaatcaggatttggatacaatccgtccataggaccaatatcaaatactattaccctagaatcttcactggtattattaaataaacgtacaatatcattaacaccaacatcatctgactccatttatgatagaaatattatcacgaaaaagccacacgaaatcaacttatcttcgttatcatttttgttttgtgagattattagttgggcacactctaattccaaaggcattcaagatttagaaaatcgtttaaacggattaggttatcaaataggtcaacgatatctcgaattgtgtaaaataagagaaggttttaaaaacagtaaacgagagattagacttttggaaatgttacaatttattcatggtccgttctggaaattgatttttggtaaaactgctaatgaattagaaaaatcgcaagatttgcccaatgaatatatgattgtggagaatgtgccattattaaatagatttattagtatacctaaggagtatggcgacttaaattgttcagcatttgttgcgggtataattgagggagcacttgataatagtggattcaatgccgatgttacagcacacacggtcgctacagatgcaaatccattaagaacagtatttttgatcaagtttgacgattctgttttaattagagagagtttgagatttggataa

SEQ ID NO: 2 - DNA, 531 bp, Candida albicans
caattttcccattcaatcttccttccagtttattcaatgtcatcaacacaatttcctactttaacattagaagaatttaaaactgccattcaagatatatcacaatttgaattagagtccaaaaaaaatcaacaaaaacatttcattttcaaattaattgataccaataatgaattatggcaagaaataaataatataaaacaattacaagatctgtcatcttttgaaaataaagagaatttaatattatatcaagaaactttatgggaaaataaacatagtttattagaacaaatagctcgaattgaaagtattaatgatgaattgattcgtcgaaatcttattagtgaacaagataaattacaagaaaaaactaaattaatggaagaaataaataaaaaagatattgaaaatgaaacccaacaaaaagatggaaccgaaggaaaagaagaagaggaaaaggctaatggcgaaggtgaagatgaaggcgaaggtgaaggcaaaggcgaaggcgaaggagtgtatttatga

SEQ ID NO: 3 - DNA, 1206 bp, Candida albicans
tcgacatctcccatcaaaccaatagcattagctgcgtttgatttatcactttataaagatggtgctgggaatttaccaattagacataaattagcaactcaaattgcaaaatgtcttttcacatatggttttatcatggttacaaatcatggatttcctcatgataaattggaatttcttacatcattagctcatgggattttagaagttcctcttgaaagtctcaaaccatatttggcaggagcgtttaaatctgatttagaagatcgatcaatttcattaggtgctgagagaggtgctggttataaacctaataaatattggtcaatgagaaatggagttgaagattcaattattcattataattttaataatatgcaacatccactgtttttccaaggatcaggtaatgccaataataataatcaatatcctcctatagtgcaagaccatttatcacaagttgcggaatattatcgatatttacataatgatgtattaaggaaactttgtaatttaactgatattgttttagaacttccagaaggtttcatttgggacaattattataaagttacacctaatgattatgaaaattctggtggtggtgctggtcgattcatgttatatgaaggtatggatcctcaagatcgtgaaaaagtcggtgatacatggttaaggggtcattccgatagtggaggattcacatttattacgtctcaaccaattctttcattacaaattcgagattatttcactggtgaatggaattatgttggccatactccagatggattgattgttaatattggtgatgccatggaatttatcacgggtggatatttcaaatcttctattcatagagttgttggtccaccagatgatcaaaaagaattccgtcgattagtattgatctatttttgtaaacctaaatcaacttgtattttggatccagaacctttacaatcacctaagttgaatcgtttaggtattggtaaacctaaagaatgggaaaaaattgattttgctgcttggaataatgaaaaatcacgtttatttggtaagaaaaatgttaatgatactcaatctgaagaaccaaaattagttttactttatggaagattacatgaaagatggcatcaagcagaaactgattttagtttagaagaagccgagaaaaaatttcaagtcattaaattaacctaa

SEQ ID NO: 4 - DNA, 390 bp, Candida albicans
tgtttatgccaaccacatttggtcgatgtcgagcaacctggtgttggagaaaccctttttaatactattcaatctgcagatgtggatattagatcatcattatacaaagcaattgtcttatccggaggttcttccatgtaccccggcttaccttcaagattggaaaaggaattaaaacaattgtggctaactagagtgttgcagggtgatgcttctagattggataaatttaaggtgagaattgaggatccaccaagacgaaaacatatggttttcattggaggtgcagtgttagccaatatcatggctgataaggatcatatgtggatctcaaaacaagaatgggaagaacaaggaccaagagtgttggaaaagttaggacctagataa

SEQ ID NO: 5 - DNA, 1011 bp, Candida albicans
tcgtatcctatagagcatggaatagtcaacaattggtctgacatggaaaaattatggtatcatacatatactcaagatttgaaaactcaatcagaagatcatccattgttgattacagaagcacctttgaatcctcgatcaaatcgaaataaaatgtgtcaaatattatttgaaaattttaatatcccttgcatatatatatcgattcaagcagtgttgtcattatatgcttcaggtagaactactggtgtggttatagacagtggtgatggggtgactcacgtagttccagtatacgaaggatttgcattgccgccgtcaataaagagaatggatattgctgggagagatataaccgaatctttggcattcaatattcgaagaatgacaggggttgcgttacagagcagttctgaattggaaattgtcaggttgattaaagaacaaaattgtttcatatcaaaggacccggtaagagatgaaaagaaatatggaagtcattatagtagaaataaccctaataacgaattgatgtctacttataaattgcctgatggacatgaaattcaattgggagttgaaagattcagagccacggaaattttgtttaatcctcaactcattggacatgagtcacctgggattcatgaattgacttcattggcaattgccaagactgatttggatttaagatcaactttgtatcaaaatataatattatctggtggcaacactttgttaaagaattttggtgatagaatgttgaaagaattaaaagatttacaacaaccactacaagaagatcaaaaaatgagtatttggaataagaatgttcaaaatgatgtgtataatacgaaaatgaaagtgaaaatctatgcaccaccggaaagaaagtattctacttggattggtggttctatattggcagggttgtcgacttttaagaaaatgtgggttacatcggaagaatatcatgaaaatccagatatagtacatgtaaagtgtatgtaa

SEQ ID NO: 6 - DNA, 1134 bp, Candida albicans
cccatttttatagaagaagttgctgctttagttatcgataacggttctggtatgtgtaaagccggttttgccggtgacgacgctccaagagctgttttcccatctcttgttggtagaccaagacatcaaggtatcatggttggtatgggtcaaaaagattcttatgttggtgatgaagcccaatccaaaagaggtattttgaccttgagatacccaattgaacacggtattgtttccaactgggacgatatggaaaaaatctggcatcacactttttacaatgaattgagagttgctccagaagaacatccagttttgttgaccgaagctccaatgaatccaaaatccaacagagaaaagatgactcaaattatgtttgaaacttttaatgttccagctttctacgtttccattcaagctgttttgtctttgtactcttctggtagaaccaccggtattgttttggattctggtgatggtgttactcacgttgttccaatttacgctggtttctctttaccacatggtattttaagaattgatttggctggtagagacttgaccaaccatttgtccaagattttgtctgaacgtggttacagtttcactactagtgctgaaagagaaattgtcagagacattaaagaaagattgtgttacgttgctttggatttcgaacaagaaatgcaaacttcttctcaatcttctgccattgaaaaatcttatgaattaccagatggtcaagttatcactattggtaacgaaagattcagagctccagaagctttgttcagaccagctgatttaggtttggaagctgctggtattgaccaaaccactttcaactccatcatgaagtgtgacatggatgttagaaaagaattatacggtaacattgttatgtctggtggtactaccatgttcccaggtattgctgaacgtatgcaaaaggaaattactgctttggctccatcttctatgaaagttaagattattgctccaccagaaagaaaatactctgtctggattggtggttctatcttggcttcattgtctactttccaacaaatgtggatttcaaaacaagaatacgacgaatctggtccatccattgttcaccacaaatgtttctaa

SEQ ID NO: 7 - DNA, 1842 bp, Candida albicans
aacatgagttcattcaattctaattccaatccggcgaatgctcagaatttgtctagttttcaatttcaaccccctaaagaagacgttatatttgatacccatcaaatgctgctatcggtaccacagctgaggtactacgcttcatcaatgatgcaacaatcacaacaagggcaaccacagtcgcaaacttcgcagcaacagcaacaacagcctttcttgatgaatattcctccagcatttacccaaacccagcctcaacaaatgctttatgccatgccacctcttcaaacccaacaaccgtcttcttcgtcagcaacgacaaataatgtagttccacctcatcattacaatcaacaacagctgcaacaacaacaacagcagcagcaacaataccagcaaatgcaaccgcagccaaataatatgcagttctttgataacaccatacctaattatttaattatgaaccaaactatttctcccagtcaaacgcaaacaactgctcaaccaaatatttcttactacaattattcaacccaacctcagttacagctggctcaaccaatatcacatagtcagccacaaccacaaccacaagcaacacaaccaagatcaaatagaagtagactgcaaacgagcttttctaaaccaagaggtagcaggcaagttagtggcagtggcaggtcaaccggggccaagaaacaatcagcaatcacactgggcagtactggtactggccctgcccgaaatgctgatacaggtatgacatcagttgctaatagcacttccacaaccactatgacaaccaccaacaataacaacaaattgtctgtttcagccccagtaaatgtgatatatgctaatcttcctgagagacttcaacaggtgttaccagcaccgccgttatcacgtgctccagtaagacctgatgtaacggtcaatttgacatcaaaacgagccaaaagaaaatcaaaattcactccggaacaagatgacatgatcgtgaatttgaagaaaaaggggaaatcatgggttgaaattgccgaaatcactggtgttggatcatatttagcggcacggaatcgatttcaagttattgttggacagcaaggaaataacaattcgagtgcatgggataatactgataaattatttttgaatcaattattagatgctggagaaatagaaaaatggagatttatatgttgtgaattgaataaactgacaaataaaaatttcaccgattatgaatgtcgagaaatgattcgacaattgttttggttgaatcctgctagctttggagttaatgaggaaaccattattgagtcccaaaaggaaaagaaattgactgagaaaacaattgaacaacgtgaacaacaacgtaaaaagagagcttctgctaaccattcacctcctgattctgattccatcactaatactaataataaccaacaagaggttaaatatatcgatcctcaatataaaaattatcaaagccaattgatgccaaatcagaatactggatctggtgctaccaagatttcctcaacgacacccccacctccatcacaagcgttatccaataacgtcaatactatgaataaaaatattgtgtcatctgcccttggtggtacatctttttctcaagaacaacattcattgcattcaaaccagcatcatcataaccatcagcaacatccactcatccatcatcatcagtaccagcagcaatcttcattacctcctccaccaactatcccatctacaattcccacatcttcacttagcatacaacagcagcagcaacaacagcagcaacagttgtataataaacagttttactaa

SEQ ID NO: 8 - DNA, 525 bp, Candida albicans
ggtatcaaacatattgaatcatggtatgaatattttaatgccaacaatgtcaaatcagaagaacgtttaaaaaattataaagttgaagtttggggtcgacaattaaatgtaccaatttgttcacctcattatgttgctcaatttacatttcatgaattatgtggtacacctatggcagctggtgattatttggcattagcacaaagtttccaatcatttataatcaccgatattccttatttaagtattgatgttcgtgatcaagtaagaagatttataacatttttagatgcaatttatgataatcatggtagaattgctgtaactagtgctaattcatttaaagatttatttgttgaaccagaaaatatcgaaaaagataattattatgaattgcaccaaaaaaagaaggaacagattgaaacagatccttcttcggaggaggaggaggaggaggaagaagacgaagaagacgatgccttggtgtcttcacctaccggagctgcacggtaccgcaatagtatt

SEQ ID NO: 9 - DNA, 717 bp, Candida albicans
cagaagaagaaggagagagagaggaaaaaaaaaagtgtacccagtctgaaaacaaatcttcgatccaattgtttcttttaccaattgtatactatcaaccccccctcagcaacagatattttcttcatagaatatcacccaattaatcaaactcaactcaatatggctaaaaagaaaagcaaactgaaatcttcttctccgaaaccaaaagtatcttctactgctgccaaaccagtggaaattgacaaccaacaaaatattgaaaatgttcaagattctccactggcacttcaacaacaatcagcaacagcagaagaatcagaaaacacagcaacaacagcgacacctctggaagggactacggctacaacagaatcatcaccagtaacaacatcaaatgaaaccgaccccatagaattatcagtattagataatgccgatcacgctattgactcaaattcaatcaaatcaactgaagcagtattagaaactttagacagtgaattgaatactattgccgacacaaaaactgaaccaccaacagaacaagaattgaatccaacattagcgaaatatatgcgcagttgtcaagaagggaatttaactatagttaaagaattgatttcatcaggtcaagtattggtaaatgatacttttagtgatgaaattacgggattacattgggcatgtataaataatcgattatctttagttaaa

SEQ ID NO: 10 - DNA, 1395 bp, Candida albicans
aagaataggaattgtttccaaaaacttgggaaaaagttattgatcgaaaccggtagagatcctgaaattaattgggcccttcttaaaccttgggtattggccaaattaggtaaaattattacatttttaacaccatatttcttattaccacttctgtttaatgttttatcaatgggtggtgatcaaggagggtttataatacctaaattaatcttggccattggtatattaggtggtggtatttatttattaaacaaattaattatttcacaatatatctttgatgataagaaattagccaaatcaccaattttagccggagtgttttctgccacggcgttttggagtgttttggtttggttatataatattttaccaactacatttattcataatttttttgccaatgttattatggcaattttaattgcaattttcacttggtcatttttcaaagccatgtttataaacccaggttttgttcctactccagctgataataatgtcatattatctcaagtggctcaattgatagaattggggaaatttgatactgaccatttttgtgttaatagttttgttagaaaaccattaagatcaagatattcaaaacataataaaagacttattgctagatttgatcattcttgtccatgggtatataatgatattggggttagaaatcataaaatttttatcacatttgtttattcattaaacatggcaatatttgtgtttttatatttatcattacaatattttgataaagttaaagatcaatatgattctgatgacgagggagaaggagaaggatttgtttgttctattttaggagatgatatgtgttatggatataaaaatcatcattttcatttcaatgttttcatgtgggatttatttcaatgtgtatgggtttcatttttatgtattgttcaaacatttcaaattcttaaaggattaacaacatgggaatttagttcattaaataaacaattacaaactaatcgattcaatcattctactgttcctagagattttgaagctggtgaagggatttcattagatcaaacccaaccttcagatggtcaacatagacataatcataatgaatttcaaacgtgtatgaatttattaggtattgatcaattcatattgactttgaaaatgagtttaaaatcacttttttctaatactcgtcatggcaataacaatactaattatgatccattaacttcattacatatccccactgatcatggaattaaacaaaattggttagatttttggattattggtgaagagaaatggagaaatgtattttatttacctattgatggcgaaaataatttaaatgggaaagtggtagattattatacattatatagttaccattga

SEQ ID NO: 11 - DNA, 1278 bp, Candida albicans
acccaactgtcaccacccccgagtattggtcccaattctaagccaaccacaaatactgtgattgttccgccgggtggtactgactcagtgattatcagagaacctccaaacccaactgtaaccaccactgaatattggtcacagtcctttgctactactactacagtcaccgctcctccaggaggcactgactcagtgattatcagagaacccccaaacccaactgtaaccaccaccgagtattggtcacagtcgtacgcaactacaactactgtaactgcccctccaggtggtactgacactgtgattattagagagccaccaaactacacggtcactactactgaatactggtcacaatcatatgctacaaccactacagtcactggtccaccaggaggtaccgatactgttattattagggagccaccaaatccaactgtaaccactactgaatactggtctcaatcgtacgctaccaccaccactgttactagtccaccgggaggcactgatatcgttatcattagagaacctccaaacccaactgtcaccaccactgaatattggtcacagtcctttgctactactactacagttactgctcctccaggtggtactgactcagtaattatcagagaacctccaaatccaactgtcaccaccaccgagtattggtctcaatcttatgctactactactacagttactgctcctccaggaggcactgactcagtaattatcagagaacctccaaacccaactgtcaccaccaccgagtattggtcccaatcttacgcaaccacaactactgtgactgctccgccgggtggtactgactcagtaattatcagagaaccaccaaatccaactgtcactacaaccgagtattggtctcaatcctttgttagtactactactgttactgctcctccaggtggtactgactcagtgattatcagagaacctccaaacccaactgtaaccaccactgaatattggtcacagtcctttgctactactactacagttactgctcctccaggtggtactgactcagtgattatcagagaacctccaaacccaactgtcaccaccactgaatattggtcccaatcttacgcaaccacaactactgtgactgctccgccgggtggtactgactcagtaattatcagagagccaccaaacccaactgtcaccaccactgaatattggtctcaatcctttgctactactactactgttacttgttcagcccccggggctgaaaggaac

SEQ ID NO: 12 - DNA, 303 bp, Candida albicans
  unsure (14),(85): Identity of nucleotide sequences at the above locations are unknown.
tacccaaggttcanggatacagctggtggcggcaattgtaatggatgtactgctaccaccaatatacaaggtggcaataatgaancaggaaatcaaccaggtactaatacaactggagaccttttgggtattactgatacccaaagtgttgaatcaatttctcaaccaactacattaagtcaacaaacaacaagttcgttgatcagtacgcctttggcttctacatttgatggttctggttctattgtccaacattcaggttggttgtatgtgttacttactgctatttctatattcttttag

SEQ ID NO: 13 - DNA, 1347 bp, Candida albicans
ggtactacgaccgaatattggacacaatcctatgccaccactaccactgttactgctcctccaggtggtaccgatactgtgattattagagaaccaccaaatccaacagttactactactgaatattggtcacaatcatatgctaccactaccactgtaactgcaccaccaggtggtactgacactgttcttatcagagagccaccaaaccacactgtcactactactgaatactggtctcaatcatatgctacaaccaccactgttactgcaccaccaggaggtaccgatactgttatcattagagaaccaccaaactacacggttactactactgaatattggtcacaatcatttgccaccactaccactgtaactgcaccaccacgtggtactgacactgttcttatcagagagccaccaaaccacactgtcactactactgaatactggtctcaatcatatgcaaccactactaccattaccgctccacctggtgaaaccgatactgttcttatcagagaaccaccaaaccacactgtcactactactgaatactggtctcaatcatatgctacaaccaccactgttactgcaccaccaggtggtactgactcagtaattatcagagagccaccaaaccacactgtcactactactgaatactggtctcaatcatatgctacaaccaccactgttactgcaccaccaggtggtactgacactgttcttatcagagagccaccaaaccacactgtcactactactgaatactggtctcaatcatatgctacaaccaccactgttactgcaccaccaggaggtaccgatactgttatcattagagaaccaccaaaccacactgtcactactactgaatattggtcacagtcctttgctacaactactacagtcacagctcctccaggaggtaccgatactgttatcattagagaaccaccaaaccacactgtcactactactgaatattggtcacagtcctttgctacaactactacagtcactgctcctccaggaggcactgacactgttcttatcagagaaccaccaaaccacactgtcactactactgagtactggtcacaatcatatgctaccactaccactgtaactggtccaccaggtgaaactgataccgttatcattagagaaccaccaaatcacactgttactactactgaatactggtcacaatcctatgccaccactaacactgtaactgcaccaccaagtggttatgacactgttatcattagagaaacaccaaaccacactgtcactaacaatgaatattggtccaaacaattgccacaaccacacagttaa

SEQ ID NO: 14 - DNA, 723 bp, Candida albicans
tttcgccggcgtggtgaaaatccatcacgtgaggatatcaccacatctcaacctacaggtgataatggagacaatacttcatcaaccaatccagttccaactgtggcaacaagtactttagcatctgcaagtgaagaagacaacaaaagcggttctcatgaatcagcatccacaagtttgaaaccaagtatgggtgaaaattctggattaactacttctactgaaattgaagctacaacaaccagtcctacagaagctccatcacctgctgtttcttctggtactgatgtaactactgaaccaactgatactagagaacaacctactacattatcaactacttcaaaaacaaacagtgaactggttgctactacacaagctactaatgaaaatggtggtaaatctccatcaactgatttaacatcaagcttgacaacaggcacctcagcatctacaagtgctaatagcgaacttgttactagtggatctgttactggtggagctgttgccagtgcttcaaatgatcaatcacattctacttctgttaccaacagcaacagcattgtatctaataccccacaaactacattgagtcaacaagttacctcatcctcaccttcaaccaacacattcattgcttctacatacgatggctctggttctattatccaacattctacttggttgtacggtttgatcacattattgtccttgttcatttag

SEQ ID NO: 15 - DNA, 1506 bp, Candida albicans
ccatacgacccaactgtgacaaccactgaattttggtctgaatcatttgctagtactaccactgtcaccaacccacctgatggtataaactcagttattgttatggaaccatacaacccaactgtgacaaccactgaattttggtctgaatcatttgctattactaccactgtcaccaacccacctgatggtagaaactcagttattgttatggaaccatacaacccaactgtgacaaccactgaattttggtctgaatcatttgctattactaccactgttactaacccaccagacggtacaaactcagtcattgttaaggaaccatacaacccaactgtgacaaccactgaattttggtctgagtcatttgctagtactaccactgtcaccaacccacctgatggtactaacagtgtgatcatcaaagaaccatacaacccaactgtgacaaccactgaattttggtctgaatcatttgctagtactaccactgtcaccaacccacctgatggtactaacagtgtgatcatcaaagaaccatacaacccaactgtgacaactactgaattttggtctgagtcatttgctagtactaccactgttactaacccacctgatggtactaacagtgtgatcatcaaagaaccatacaacccaactgtgacaaccactgaattttggtctgaatcatttgctagtactaccactgtcaccaacccacctgatggtactaacagtgtgatcatcaaagaaccatacaacccaactgtgacaaccactgaattttggtctgaatcatttgctagtactaccactgttactaacccaccagacggtacaaactcagtcattgttaaggaaacatacaacccaactgtcacaaccactgaattttggtctgaatcatttgctagtactaccaccatcactaacccacctgacggtactaatagtgtgatcatcaaagaaccatacaacccaactgttactacaaccgaattttggtctgaatcatttgctagcactaccaccatcactaacccacctgacggtactaatagtgtgatcatcaaagaaccatacaacccaactgttactacaactgaattttggtctgaatcatttgctagcactaccaccatcactaacccacctgacggtactaatagtgtgatcatcaaagaaccatacaacccaactgttactacaaccgaattttggtctgagtcatttgctagtactacaccaagtgtttcaagttttgaatcaacaatatttcactcgtcagaaccacattatagctcagactttgattccagtgattcctttgttactttgatttcagttaccacggcatcatcatatgatgaaagttcaaccattgtatcatctacattcccaactttgcacctttcttcatacacatggtcatcaggtttgggttccacccgtcacttttccgcgctatgtcaacaccacaatctccaatttgccaacatttga

SEQ ID NO: 16 - DNA, 462 bp, Candida albicans
agagaattgccaggaagttcagaatcattttcttacacgaaaacttgtacgtcaaccagtattacagttgaatttcaaaatgttcctgctgggtatcgcccttttgttgatgcatatatttctgcagaaaatattgataaatataccttgacgtacgcaaatgagtatacttgtgaaaatggcaatactgtggttgatccatttactttaacatggtgggggtataaaaactctgaagcagactctgacggggatgtgatcgtagttacaaccagaactgtcacagacagtacaacagctgtgactactttacctttcaatccaagtgtcgataaaaccgaaacaattgaaattttgcaacccattcccacgaccacaattacaacttcatatattggtatttccacttcctatgaaacattaaccggaacaattggtggtactgcgacagtcattgtcgat

SEQ ID NO: 17 - DNA, 513 bp, Candida albicans
actgacacggttatcatcagagaacctccaaattacacggttaccacaactgaatactggtctcaatcctttgctactactactacagttactgctccaccaggtggcactgactcagtaattatcagagaacctccaaacccaactgtcaccaccactgaatattggtcccagtcatatgctactactacaaccgtgactgctcctccaggtggtactgctactgttatcataagagagccacctaattacactgtgaccactactgaatactggtctcaatcttacgcaaccacaactaccgtgactgctcctccaggaggtaccgctactgtgattattagagagccacctaattatactgtaaccactactgaatactggtctcagtcctatgatacgaccaccactattactgcaccaccgggtgacactgacacggttatcatcagagaacctccaaatcacacggttaccagttttcaccagccggatgagccaacatgtggggaa

SEQ ID NO: 18 - DNA, 1569 bp, Candida albicans
gctccaccaggaggtactgataccgtgattatcagagaaccaccaaaccatactgtaaccacaactgaatactggtcacaatcttacactacaaccaccactgttattgccccaccaggtggcactgattcggttatcattagagaacctccaaatccaactgtcacaaccactgagtactggtctcaatcttacgcaactaccactaccattaccgctcctccaggtgaaaccgatactgtccttattagggaaccaccaaatcacactgtcactactactgaatactggtcacaatcatttgctacaaccacaactgtaactgcaccaccaggtggtactgacactgttatcattagagaaccaccaaaccacactgtcactactactgagtattggtctcaatcttacgcaaccactactaccattaccgctccacctggtgagaccgatactgtccttattagagaaccaccaaaccatactgtcactacaactgagtattggtctcaatcctatgcaactactaccactatcatcgcaccaccaggtgaaactgatactgttttaatcagagagccaccaaacccaactgtgaccaccaccgaatactggtctcaatcctataccactgctactaccgttactgcaccaccaggtggaactgatactgtgattatttatgacaccatgtcaagttcagaaatttcttcattttctcgtcctcattacaccaaccatacaactttgtggtctacaacttgggttattgaaacaaaaacaattacagaaactagctgtgaaggtgataaaggttgttcttgggtttctgtttctactcgtattgtcacaattcctaataatatcgaaactcctatggttactaatactgttgatactacaaccacagaatccactttacaatccccatctggtattttttcagagtcaggagtatctgttgaaacagaatcttctacttttactactgctcaaacaaatccaagtgttccaacaactgaaagtgaggttgtatttactactaaaggaaacaacggaaatggtccttatgaatcaccatctactaatgtgaaatcaagtatggatgaaaattctgaatttactacttccacagctgcttccacttctactgatattgaaaatgaaaccatagcaacaaccggttccgtggaagcttcatcgcctatcatttcttctagtgctgatgaaactactactgttactactactgctgaatcaaccagtgtcattgaacaacaaaccaataataatggtggtggtaatgctccatctgcaacttcaacttcaacttcatctccatctacaactacaactgctaataatgactctgttattactagtacaacatcaatcaaccaatctcaatcgcaatccaattctgatacccaacaaactacattgagtcaacaaatgacttcatctttggttagtttacatatgcttactacatttgatggatctggttctgttattcaacattatacttggttatgtggtttgatcacattattatccttatttatttaa

SEQ ID NO: 19 - DNA, 699 bp, Candida albicans
aagatcatctcaattcgtgatagaaaagtgaagaataatgattctgttgacattgataaaaaaaaatatataaaaggcatctatttccatgcagagggacgtgttttgcaatcttttcatttttgttgtttgaaaacccttaatcaccaagaatttcaaatgcttccacaattcatattgttattcatatctttgacagtgtcgactgcaaaaactattactggtgttttcaatagttttgactcattgacatggactagatccgttgaatatgtttacaaaggaccagagactccaacttggaatgcagttttagggtggtccttaaatagtaccactgctgacccaggagacacattcaacttgattttgccttgtgtgtttaaatttataactacccaaacatctgttgatttgactgctgatggtgttagctatgccacttgtgactttaatgctggtgaagaatttacgacattttcttccttatcatgtactgtgaacagtgtttcggtatcatatgctagggtttctggtacggtcaaattgcccattacattcaatgtaggtggaacaggttcttcagttgatttggcagattccaaatgttttactgccggaaaaaacactgtgactttcatggatggcgatacaaagatttctaccactgttgattttgacgcgtctccagtatcgtga

SEQ ID NO: 20 - DNA, 3180 bp, Candida albicans
tcacttaagcgcggaccgcccagtcccgtggtgaagaatgtaggtggaactggttcttctgttgatttggaagattctaaatgttttactgctggtactaacacagttacatttaatgatggtggcaagaaaatctcaattaatgttgattttgaaaggtcaaatgtcgatccaaaagggtacttaactgattccagagttataccaagtctcaacaaagtgtcaactctttttgttgcaccacaatgtgcaaatggttacacatctggtacaatgggattcgctaacacttatggtgatgttcaaattgactgttcaaatattcatgttggtattacaaaaggattgaatgattggaattatccggtttcatctgaatcatttagttacaccaaaacttgttcatctaatggtatctttatcacatataaaaacgttcctgccggttatcgtccatttgttgacgcttatatttctgctacagatgttaattcgtacaccttgtcgtatgctaatgaatatacttgtgctggtggttattggcaacgtgcacctttcacattaagatggactggatacagaaatagtgatgctggatctaacggtattgttattgtggctactaccagaacagttacagacagtactaccgccgtgaccaccttaccattcgatcctaaccgcgacaaaactaagacaattgaaattttgaaacctattccaacaactacaatcacaacatcatatgttggtgtgactacttcctacctgaccaaaactgcaccaattggggaaactgctactgttattgttgatattccatatcacactaccactactgttaccagtaaatggacaggaacaattacttccaccacaacacatactaatccaactgactcaatagacactgtcattgtacaagttccactgccaaacccaactgttactaccactgaatattggtctcaatcatttgctaccaccaccaccattactggaccaccaggaaacactgatactgttttaatcagagagccaccaaaccatactgtcactacaaccgagtattggtcagaatcttacactactactagtactttcactgctcctccaggtggaactgattcagttattatcaaggaacctccaaatccaactgttacaactaccgagtactggtcagaatcttacactaccactactactgtcaccgctccaccaggaggtactgataccgtgattatcagagaaccaccaaaccatactgtaaccacaactgaatactggtcacaatcttacactacaaccaccactgttattgccccaccaggtggcactgattcggttatcattagagaacctccaaatccaactgtcacaaccactgagtactggtctcaatcttacgcaactaccactaccattaccgctcctccaggtgaaaccgatactgtccttattagggaaccaccaaatcacactgtcactactactgaatactggtctcaatcttacgcaactaccactaccattaccgctcctccaggtgaaaccgatactgtccttattagggaaccaccaaatcacactgtcaccactactgaatactggtcacaatcttacactacaaccaccactgttattgccccaccaggtggcactgattcagttatcatcaaggaaccaccaaatccaactgtcactacaactgaatattggtcccagtcatatgcaaccactactaccattaccgctcctccaggtggtaccgatactgtgattattagagagccaccaaaccacactgtcactagtactgaatattggtctcagtcatatgctactactactactgttactgctcctgcaggtggtactgactcagtaattatcagagaacctccaaacccaactgtcaccaccactgaatattggtcacaatcttacacaaccacaaatactgtgactgctcctccaggtggtactgactcagtgattatcagagagccaccaaacccaactgtaacaaccaccgagtattggtcacagtcgtacgcaactacaattactgtaactgccactccaggtggtactgacactgtgattattagagagccacctaattatactgtcaccacaactgaatattggtctcaatcgtacgctaccaccaccactgttactgcccctccaggtggcactgatactgttattattagggagccaccaaattacacggttaccacaactgaatactggtctcagtcgtacgcaactacaactactgtaactgctcctccaggtggtactgataccgttatcattagggagccaccaaactatactgtgacaactactgaatactggtcacagtcgtacgcaactacctcaactatcacagccccaccgggaggcactgacactgtgattattagagagccaccaaattacacggttactacaactgaatattggtcccaatcttatgctacgaccaccactgttactgcaccaccgggaggcactgacacggttatcatcagagaacctccaaattacacggttaccacaactgaatactggtctcagtcatatgctacaaccactactgttactgctcctccaggtggtactgacactgtgattattagagagccacctaattatactgtcaccactactgaatactggtcacaatcttatgctacaaccaccactgttactgctccaccaggaggtaccgctactgttatcattagggagccaccaaactatactgtcaccactactgaatattggtctcaatcatatgctactacaactactgtgactggtccaccgggaagcactgataccgttatcattagagaaccaccaaatccaacagttaccaccaccgagtattggtctcagtcatatgctactacaactactgtaactgccccaccaggaggtaccgctactgtgattattagagaaccaccaaattacacggttaccactactgaatactggtctcaatcttatgcaaccaccactactgttactggtccaccgggaggcactgacactgtgattattagagaacctccaaacccaacagttacaacaactgagtactggtcactatcttatacgagactgtcttcagccaatgctggaagatcaacgcttggt

SEQ ID NO: 21 - DNA, 330 bp, Candida albicans
agattagaagattctactgccaccctgagttccataactgcagctaatcaagattcattaaacccttcaagtgtcagcaaataccctcatggatctgagactattgataatggatcaaatggttcttcacattctagttctgccttagcatatactatttcagctagccacagtattaaatttagtgctcatcagactacattaagtcagctgttgatatcatcttcaaccaaaacagttattgcttctacatacgatggttctggttcggttatcaaactccattcttggttttatggattggtcacaatattctttttgtttatttaa

SEQ ID NO: 22 - DNA, 1536 bp, Candida albicans
ccatctatcaccaaaacatttcaaatgcttttacaatttttgttgctaagcctctgtgtatcagttgctacggcaaaggttattacgggcattttcgatagttttaattcgttaacttggaccaatgctgcttcttattcatatagaggtccagctaatcctacttggaccgctgtaataggatggtctttagatggagctactgctagtgctggtgacacattcacgttagacatgccatgtgttttcaaatttattactgatcaaacgtcaattgatttagttgctgatggtcgtacttatgctacttgtaatttgaactctgccgaagagtttactactttttctagtgtgtcatgtactgtgactactacaatgactgctgacaccaaagccataggaactgtaacattacctttctcattcagtgtggggggatcaggttcagatgttgatttggcaaattctcaatgttttactgcaggaatcaatacagttacttttaatgatggtgacactagcatttccgcaacagttgattttgaaaaatcaaccgtggcctccagcgatcgtatcttgttgtcaagaattttacccagtctttcacaagcagtaagtctttttcttccccaagaatgtgcaaatggttatacttctggtacaatgggattttcaactgctggtactggtgctactatagattgttccacagttcatgtcgggatatcaaatgggttgaatgattggaattatccaatttcactggaatctttttcttacacaaagacctgtacatcaacaagtgttttagtaacttatcagaatgttcctgccggatatcgtccatttgtcgatgcttatgtttctgcaacacgagtcagctcatatgctatgagatacactaatatatatgcttgtgttggtgcggcttctgttgatgactcatttactcatacttggctgggatatagtaatagtcaagctggttctaatggtattaccattgtggtaacaactagaacagttacagacagtaccactgctgtgactactttaccattcaattccgaatctgacaaaaccaaaacaatcgaaattttacaacctattccaacaactaccattacaacttcatatgttggtgtgacaacttcctacctgactaagactgcaccaattggtgaaacagctactgttattgttgatgtgccatatcatactactacaactgttaccagtgaatggacaggaacaattactaccactacaactcgtaccaatccaactgattctatagatactgtcgttgtgcaagttccactgccaaatccaactgtcactacaaccgagtattggtctcagtcatatgctactactactacagttactgctcctccaggtggtactgactcagtaattatcagagagccaccaaatccaactgtcactacaaccgagtattggtctcagtcatatgctactactactactgttactgctcctccaggtggtactgactcaatgattatcagataa

SEQ ID NO: 23 - DNA, 1158 bp, Candida albicans
cccccaaacccaactgtaaacaccaccgaatattggtcacaatcttatgctacaactactacagtcaacgctcctccaggtggtactgactcagtaattattagggagccaccaaatccaactgtaaccactactgaatactggtctcaatcctttgctactactactacagttactgctcctccaggtggtactgactcagtaattatcagagaacctccaaacccaactgtcaccaccactgaatattggtcccaatcttacgcaaccacaactactgtgactgctcctccaggtggtactgactcagtgattatcagagaacctccaaacccaactgtaaccaccactgaatattggtcacagtcctttgctactactactacagttactgctcctccaggtggtactgactcagtgattatcagagaacctccaaacccaactgtcaccaccactgaatattggtcccaatcttacgcaaccacaactactgtgactgctccgccgggtggtactgactcagtaattatcagagagccaccaaacccaactgtaaccaccactgaatattggtcccagtcatatgctactactacaaccgtgactgctcctccaggtggtactgctactgttatcataagagagccacctaattacactgtaaccactactggatactggtctcagtcctatgctacgaccaccactattactgcaccaccgggaggcactgacacggttatcatcagagaacctccaaattacacggttaccacaactgaatactggtctcaatcgtacactaccaccaccactgttactggtccaccaggaggcactgataccgttatcattagagagccaccaaattacacggttactacaactgaatattggtcccaatcttatgctacgaccaccactgttactggtccaccgggaggcactgacaccgttatcattagagagccaccaaattacacggttactacaactgaatattggtcccaatcttatgctacgaccaccactgttactggtccaccgggaggcactgacactgtgattattagagaacctccaaacccaacagttacaacaactgagtactggtcacaatcttatgcaactactttgaccatcactgccccacca

SEQ ID NO: 24 - DNA, 2034 bp, Candida albicans
ataactttgaaaatatcctaccttcttttcaattattgtagacctcaccaagttttcttcaacatcaatctttcaaacttattcaattatacaatggagagattatctcaattagctattcaaaccacaaactcaagtgctgctcctgctgctcccgggcatcctttggatccattatcccccgctgaaattaaatcagtttccaatattgttaaatccaaattccctaacaagtcaatcagctttaataccgttactttgaaagaaccaatcaagagagcttactacgaatggaaagaaaaaaaaggcccattgccctcacgtttagcttattatgttgttgttgcagatggtgattctggtgtacatgaaggttttgttgatattggtgcacaagaactcattgaaatcaagcacactgaaggtgttcaacctatcttgactcctcatgatttgcaagtaactgaagaaatcattagaaatgacccagaagttcaaaggcaatgtgagttgagtggtgttccacctaattcaatgcaccaaatctattgtgatgcttggactattggttacgatgaaagatggggtgcttcaagaagattgcaacaagcattgatgtactggagatcagacgaagatgattcccaatactcacatcctttagatttctgtccaattgttgatatgaatgccaaaaaagttgtttttattgatatcccacaaagaagaagaaaagtttctaaacacaaacattccagcttccatccaaagcatgttgctgataaatacggatctaaggaaaacccttctgggtatagacaggaagatttcccaatcaacattactcaaccagaaggtgtttcatttaaattggacaaccatgtcatgtcttggtcaaacttcaatttccatattggtttcaactaccgtgaaggtattgttttgagtgatattacctacaatgaccatggcaacgtaagaccactttttcaccgtatttccctttgtgaaatggtggttccatatggtgctccagatttcccacatcaaagaaagcatgcccttgatattggtgaatacggtgcgggtaatatgactaacccattggcattgggttgtgactgtaaaggtgttatccattacttagatggtcatgttgtggacagaagtggtgatgcagcaaccatcagaaatgcaatctgtattcacgaagaagatgatggtgtgttattcaagcattcagactttagagatgatttccaaaccactgttaccaccagaggtaaaaaattgataatttctcaaatcttcactgctgccaattatgaatactgtgtttattggatccttagacaagacggtactatcaaattagaaattagattgactggtatcttaaacacgtatatctgtgctgatggtgaagacattggtccatggggtactgttgtttatccaaatgttaatgctcataaccatcaacacttgttctccttgagaatacatccaagaattgatggggataacaactcggctgctacaagtgatgcaaaaccttctccattccccactggctctactcaaaatatgtatggtaatgccttttactgtgaaaagactaccttcaaaacagtcaaagagtctattaccaattttgaaagtgccactgccagaacttgggatatgtataatccaagctctattcacaaatattcaggcaagcctgcaacttataaattatggtctactttctgctcaccattattagctcaagaaggttctttggtcaaaaagagagcaccatgggctgctagtcacactcaagttgtgccatacgttgacgacaagcttggttatggtagattatatccttctggtgatcatgttcctcaatggagtggtgatggattgagacgtatgagagaatggattggtgatggtacagataaagttgacaacactgatattttgttgttccacacttttggtattactcatttccctgctccagaagatttcccagttatgccaacc

SEQ ID NO: 25 - DNA, 246 bp, Candida albicans
tattgtgatccggctgtggcgagtgaagactccagaacattcccagtaatgccaacggaaattttcgatttgcaattaagaccaagaaatattcacacagaaaacccagttttggatgtgaaaccatcatatgctagaaccacctctgaagtcaaagctggtgctaaaggtgttgatacttgtactttgaatgtcgacaaatcttctagattagcctttgatgatggttcatgttgtaaaaaataa

SEQ ID NO: 26 - DNA, 825 bp, Candida albicans
acgttcatcatttggctgaatcttgtaaaaacatggttcaattggggaggtgataactatgctgactataatatgatgtacttgtctattcttcaagctttatcaatgggtctttctggtatcccattctttggtgtggatgcatgtgggttcaatggtaacactgatatggaattatgttctagatggatgcaattggcttcattcttcccattctacagaaaccataatgttttgggtgctattccacaagagccatatgtctgggaaggtgttatgaacgcaactaagacatccattaatgtcagatattctttgttgccatactattacactttgttacacgaatcacacgttactggtattccaattatgcgtgctttcaactggcaattcccttacaacaaagaattggctggcgttgaaactcaatttttcgttggtgatgcattattggtcacaccagttttagaaccaggtgtcaaccatactaaaggtgttttcccaggtgagaatgttgtgtactatgatttttacactcataagaaacaaaaattcactgctggcaagaacgaaactttggctgctcctttgggtcacattccattacacattaaaggtggtaacatcattccaactcaagaaccaggttatactaccactgagtcaagaaagaatccatttggattgttggttgccttggatgctgaaggtactgcttctggtaaattgtatctcgatgatggtgaatccgtagatgttgaagaagcattatatgttgacttagttgcatccaagtataaattgtggcctctttttcgtgtt

SEQ ID NO: 27 - DNA, 1347 bp, Candida albicans
caaaattcatttgttctgtatcttttgaatcaagacaaaccaaaccaacaaaatatgaaattattatcaaaattcattgttactgctttgggtcttactttaattgtcagtgctgctccgacaagcagcagtagcgccgagaacgcccaaaaaactgttcctactgaactcactttaggtgtcaaacaagttcctaacatcttaaatgatactgctgttgacgccaatgttgccgctaaaggttattctttggtaaatgttactttaacaggtagaggtttaactggtattttgaaacttaaagaagctacaaacatttatggttacgactttgagtacttgaacttgtcggttgaataccaaagtgatacaagattaaatgttcatattgaacctactgatttgactgatgtttttgttttgccagaagaacttgttgttaagccaaaacttgaaggtgatgctaacacttttaattttgaaaactccgacttggtttttgaatatgatgaagaagattttggatttgaagttttaagaagctctactcgtgaagtattgttctccactaaaggtaatccattggttttctccaatcaattcattcaattcaatactactttaccaaaaggtcactcaattactggattaggcgaatccattcatggatctttgaatgaaccaggtgttgtcaaaacattatttgctaacgatgttggtgatccaattgatggtaacatctatggtgtacatccagtgtactatgatcaaagatataacacaaacactacacatgctgtttattggagaacttcagctattcaagaagttgtcgttggtgagacttctctcacatggcgtgctctttctggtgtcattgatctttatttctttagtggtccagatccaaaagatgttatccaacaatatgtttctgaaattggtttacctgctatgcaaccatactgggcattgggttaccatcaatgtagatggggttacgacactgttgaatcccttgaaactgttgttgaaaatttcaaaaaatttgatattcctttggaaaccatttggtcagatattgattatatggatggatacaaggatttcactaatgatccacatagatttcctcttgataagtacagaaaattcttggacgacattcacaacaacagtcaacattatgttcctatatttgatgctgcaatttatgttcctaacccaaacaatgccactgataatgattatgaaccattccacttgggtaatgaatcagacgtgttcttgaaaaatccagatggatccttgtcttcaccacggggatgggccgatcggcgcttcgat

SEQ ID NO: 28 - DNA, 1638 bp, Candida albicans
acttttttcaaaaagaagatgaaatttttaactttaactacttctttatcaataattgtatcaatcaatgcattaccaacttcttttggattttggaaaaattggttcaacttgggtgaagaattagcccaagaagttatcatggatgatatttctgaccaatttattaataatgacgaaaatgaaaacaacaacaacgacaacaacttgataattgatggtgttattgatgaaactgtttataattcattaccagaaattgatactgaatctttacaaagtttaatcaatgaaaaaggattacgttctcgtgctgaagatttatttgaaattgctcaacgttcaattggcaaatatgatcatccaactagagttattggttcaccaggtcattggggtactattggttatattatatcagaaattaaaaaattgaaagggtattataatgttaaaactcaaagttttaaagctcttgatgggaaagttaaatcattttccttattaatcgatggagtagaaccaaaatcattatcaccatttagtttgaccccacctactgttgatggaaaaccagctcatggtaatttggttttagttgatgattttggatgtaagcctgacaatttcccagaattcactaaagggaatattgttttaattaaacgtggtgaatgtgcctttggtgataaatcaagaaatgcaggtattgctggtgcattgggggcaattatttatgacgatgaaccggtacgtggaacattgggtaatccaactgggaaagaagtcgccacagtttcagttgccaagaaagacgtggaaaaatacattgaaaaattatctaaagacccaaaatatgcatttgaaactactttatatgttgattcctacgttaaatatatcaaaacattaaatgtcattgctgattcagtttttggtgatcatgacaatattgtttctttaggtgctcattctgattctgttgctgaaggacctggtattaatgacgatggatcaggtaccatttccttattggaagttgccacacatttgacacagttcaaattaaacaatgctgttagatttgcttggtgggcagctgaagaagaaggtttattgggatcaacttattatgctgaacatttaactgctgaagaaaactctaaactaagacttttcatggattatgatatgatggcatctccaaattatgaataccaagtctatgatgctaataacaaggatcatccaaatggttcaggaaatttgaaagatttatatattgattggtacacttcgcatggattaaactatacattaaccccattcgatggtagatctgattatgtgggttttattgaaaatggtattccaggtggtggtattgctactggggccgaaggtgtcaaagatgctaaaggtcaagaaaaatttggtggtaaagttggtgaatggtttgatccttgctaccatcaattgtgtgacaatttagataatccagattatgaagcttgggttattaacactaaattaattgctcattctgtggccgtttatgccaaatcattcgaaggattcccaaaaagagaacccaaagaaggaagttgccagtgcatccaattcagaaaaaccaaatga

SEQ ID NO: 29 - DNA, 846 bp, Candida albicans
atcttcggtagaactaacatttctctcggtgcattcatacataacaatttttataatcttcccgaaaagaaaacattgaggcggtcatctcctcccagaaaatatatagacacactcatatcaccgtttttttttcgatttttcctccccatacaacttacttctttattctcactacacataatggattccgcatactggtcatacgataacatagtcccaagcttccgtttggatggaaaactagtcatattaaccggtggctctggtggtttggctgccgtggtatcaagagctttattagccaaaggtgccgatgttgcattagtcgatatgaacttggaaagaacacaacaagctgctagagacgtcttacaatggggcgaagagcaaatgaaaggtaaatacgaatcaccaatcggtcaggtgagtgcttggtcatgtaatattggcgatgctgaagctgtcgacttgacattcaaagccatcaacgaacaccacggcaaaatctcaagtgtcttggtcaacactgccggttacgctgaaaacttcccagctgaagagtacccagccaagaacgctgaaaaccttatgaaagttaacgggttggggtcattctacgtttcccaagcttttgctagaccattaatccaaaacaacatgaccggatcgatcattttgatcgggtcaatgtccggtaccatcgtcaacgacccacaaccacaatgcatgtacaacatgtccaaagccggtgtcattcatttagccagatcattggcctgtgaatgggctaaatacaatatcagagtcaacacattgtcgcccgggcacatcttgttttcatcg

SEQ ID NO: 30 - DNA, 2091 bp, Candida albicans
ataacatgggaccatgtcaaaaatggtggttcgttcaaagacgccatcacaaattttgatcaatacgtacaagaacacataatttccaagaaaaaggagttttcaattgtgatgtttgacatttccaaattgagagttcagttggttcgtgaagctagagacaaatccgtggttttaccctcgtatttacaacatccaaggatttttgatttaccaagagaatatttaaattggcaatctagccaccctgaaacattatcataccccccaatttctttaactaatattattactgcattagaagttgaggttgagaatatatctgaatatgtcgacttgccaaacttttcttccacaccatcaccatcaaaagcttcagcaacaacgacgacgacaactgcaaatgtcacagccattgacgtcctttccagtgaaacagaaccaaatggtaaagtcattgcaaatttgcacgccaaaattgccaaacaattgatcaaaaaatccatccctgttgagaatcaccctaatgtatttacaagaccttttgattcggctcaagatatcactgcttttacatcagaaagatcaaaagtactctatctttccaacttgccaaacgacaccacacaatcagagttggaatcatggttcactcagtatggtggaagaccaggtgggttttggacttttaagtctgcagatgataacaataataataacaacaacaatagcaatggcgggaaaggatatcagaatgcgagaaaatatggtatttcagggtttgtggcctttaatactcatgaggaagcagttgattgtttagctttgaatgggagagtgttgaatgatcgtcctattgaagttcaagcgtcttctagtaaagtgtttgatatggccatggataaattgttgttgactctgttcccactctcaaagaacagacctagacccggggattggacttgtttatcttgtgggttttccaatttccagagaagaacacactgtttcaggtgctcttttgcggcagtggcgtttcaggatgtttttaacagtaatacaggcaatgccaacggtaatggcaatgttagcggcaaccacaaccacaaccacaatagtggagctcgccgtggcatgaatttacagcctgctcaagctaatgagaaaattggaacaggcaatattagtattccttcttacaacgatccaatcaagggtccaacaggtaatgtcactaatcacctcaacaattctgagaccaatttactgaacaacactaatcttaacaacaacaatcatcatagtaataattatcacaataactaccatcaccacaacaacaataataacaatcatgggaatagcaatggtaacaccatacatggtcgttcccattataacaatagtgttccatttagagcaggtgactggaaatgtgaaaattgcatgtatcacaatttcgccaaaaatttgtgttgtttaaaatgtggtgtcgccaaacctgctattaacaatcaacaaaataatacaattcattcggtgaattcaacggccgctgccatagctgcagcaacagccagtggtcaacctttaaacttgaataataatgcatttttgaaccttcagcaacaacagtctcagtcacaaccccaaggtcagcaccattacaaccaacattctcgtaacaacaatgcttctggggcatcaaagttcaacaatggctacaacccaaagaatcagtattacaataataatagcaagaatcttagcaacaattttggtcttaatggtatgcatcagcaaaaccaaaatcaaattttgatgtattcacaacaattgcaacaacaacagcaacagcaacaacatgatttaaatggaagtagctcttcacaccaactgaaacttcaattgaataatactgaaggattatacagaacaagcggacaaccaaacttaggatatcctagtatcaatcatgaagtatccggtcctgctactttaagagatgtttcaaacaactcacctgcattgaatagctcatcacttaactcattagccaatcatatgaattcattaaatttaaatcaatag

SEQ ID NO: 31 - DNA, 1188 bp, Candida albicans
aaattaatttcactggataaagccatggaatttattaaagaaacccctgaaggtaaaccatttttcggaatgattacttatacagctcctcattggccttatcaagcaccacaagataaaattgccaaatataatggagtttatgataatggaccagaagaattacgtcaaaaaagattacaatctgccaaaaatttaggattaattgatacaaatataattcctcatccaattaaaactattcgtaaatcatgggatgaattaactctgttggaaaaattgaaagaaattaaaatcatgcaaacttatgctgctatggtggaaattttagatgaaaatattggtcgattaattgatcatttaaattcaattgatgaattaaataatacatttattttatttatgtcagataatggagctgaaggtatgttaatggaagcattacctttaactaatcaaagaattaataaatttatcgatgaatattatgataatagtttatctaatattggtaataaaaattcattcacttattatggtgatcaatgggctcaagcagcaactgctcctcatgcaatgtataaaatgtggtctactgaaggagcaattgtatgtccattaatcattcattatccaaatttattttcttcttctgccgtttctggtggtggtagcggtgatggtgatggtgacggtgacggtggcaagattcttaaagaattcacaacggtgatggatattttacctacaatattagaattagctaatgtatcacatccaggagaaacttataaaggtcgtcaagttgttaaaccaagaggtaaatcatgggttaattatttgattaataaaactgatcaagttcatgatgaaaataccgttactggttgggaattatttggtcaacaagcaattagaaaaggttcatttaaagccatttacattccaaaaccatttggaccggaaaaatggcaattatttaatataattgaagatccgggtgaaattaatgatttaagtgaatcatcatcagagtatcaaaccattttaaatgaattattagatcattgggcggtttatgctgctgaaacgggattaattgaattaggtagtgatttatttgaaaaagaaaaaattgaaggtgaatcaaatgaagttgtttatagaaccatccttgataataattga

SEQ ID NO: 32 - DNA, 2088 bp, Candida albicans
  unsure (2083): Identity of nucleotide sequences at the above locations are unknown.
ttacagcaagtgcggatgcctccttcgcccgtgtgtgaaaacaatatcgatgccgccaacgacttgaatgaatgtatgacatgtaaaactcgtttgcaagttgccaagtttattagtttaacccgtcctgatttagtgccacaaatattctccacttggtgtgttgaatctggttttgatgaaatccaatgtcatatgaattacggttatcccagtgaagattactgtactatgggtaatgactttaccaagatggttagcctcatgaatccatcaggtttggatggcgattatttctgttattatcatgataaaaactgtggggtattacccgagactccacttgttgacatgagtagattgtggccactgaaaccacgtaattatttaccgccagacaacagtggcgagaccttccatgtattgcacataagtgatatcaacctccaaccagattacaaaatgtttgctgaagccaattgtacccaaagtttatgttgttcccctcattgtagaaatttgcaaggttcagctcctaactttaatgaaaatttagaaggtgggtattttgatagtagctatagtagaaaccattttgaaaaaggatcatatatggatatcaccaaaatcaaaaaaccgacttggagaccagctcgacaatttggcgaatataactgtgattcaccagcgttgttattaaacagtaccatgcaaggtatacgtgatttgcatcaaaaccatctttcgtttgaatttgcattattcactggagggacagttgaccattctgacagactgtttatgagcaaaacaaaaaacatcatttcccaagatactagttatagaattcttaaacattatttggatactgttgacgtaatcccgacttttggtacaagagatattttcccaatgaatcaattgccgcaaaaacatctaacagaaaattccaattcgtaccaatggcaatctgatttcttagcagatctctggttggaatcaggatggattgatcatgaatcttccaaacaagttagatattcgcaaattggttattcactactcacttctcgtggtttgaaaatcatttgtttaaactccaatgtttggaatgtgaaaaacttgtatgccttttgggaagtattatcaattgattcatttggtatgtggaaatttcttatcgaagaattgattgaaagtgaaagaatacatcaacgagtatggatagttgctcacttgccaacaaatcaccaatcattgccattaccaacgagagtgtttgcccaaattatcgaacggttttcaccacaagtgattgctgccatatttttcggccacattcaagttgatacatttatgattcaatatgggggtgatggaacagacaccaaggagttggagagtgccattaatcatgcccttgttggtcctctgattagtccatatctgggagtaaaccctgcctggaggtattatgccatagacctgaaaagttttagtgtggttaattccttcacttattataccaaattagataacacattcatcaatgatggggctgaaccagtgtgggaattcgggtattctgctcgagatgtctatgaccctgaacaaatgtggcccatggaatggtgtttaaatactgagtggtggcatcatgtcagtgaaaaaatcaaacaagtaccagaaatggatttaatgtatcaacgattggatactcgatggttttctcaaaatgagttggatggcaatagttattgtaaagtgactagtttcaccatggaagccaaaaagcagtgtatgttaactggggaccaagatgattatgttgaacccaaacagcctaatgattatgttccgtttattcatgttggaagtaaagttgaatatattgataaacaagtggcatatccacctgatgaagaagaggaatctgagtctgaagaagttgacgaagattatcaaccagggaaaaaaataggcacaggggaaaacaatactaatgttggtcagggtttgaatggtggtggtaatggtgagtctgatgcgacaataaagttttttaccgagccgccggaaggancatga

SEQ ID NO: 33 - DNA, 2133 bp, Candida albicans
cactcagatatcaacaaaaagatgctcttgtctaaattattcacattaagtgtcattattgttggtgcaacagctgatttccatttacgtaaccaagttattgtgaatcacggatattctgatatttctgatgaaatatttgacaacttgtctcgtgaagatggtgatttcatcaatttcaacattaacaaagttcaaattgccaatgggagtgcttgtgataaatgtaaaagtagaatcatcaatgccaaaaatttggtagaacaaaaccctgacaaagaacatttggttggtttattattgtttaaaaattgtttgaacactcaatggagagaagcttgtcaatggactgatttctttgtcaccacctcatccagaaatgaacaaagatttaatgatgatggtcctgatgccggtatttcctctattagtaatgtcaatttctatgataatgatttccttcaaataatcaaaagattcaacacttcgagtgaatatgatttagaaacttattgttatttcaaggggaacaaagcttgtaagttaccagcaactccaaatgtcacggaattatttgaccttgaaagttggtggcctaaaaaagatagcaaatataacaagcctccagtttacaccaataattcagaaacatttaatgttttacatgccagtgatttccatattcaattagattataaactaggtgctgaaggtaactgtaccctggttccatgtggtacttctagctcgtactccaaagatgctccaggaaaggcatacaatttcacagactattacaaatcattcaatagtgatgtatccggtaatgatatctccttctatcctgattcccattatgatgaaaatgccaaattctccaaaggagactactacgatttccctcaatactttggctggtctttcaataaagcacctgcaacttcattcggtgcatatttatctgatgctccatacttgcttgttaacaattcaattgttgaaatgaaaaagcttcatcaagagaagaactttgaatctattattttcacaggggacagcttctctcataatggtgaacttgccaaccctgatgagttgaaattctccgaagcagctattttcaatctgatcaatcattatttaaatggtgtacaagttttccctgcattgggtaaccacgataccatgttcagatatgccgaagttgccccacgtatttacgtaagcaatgctagttattattggaatgaagattatgtgactgatctttgggtaaataatggttggtttgataaaaaagatgccgacgcaattaaaacccattatactggatattcatttaccaccaagagaggattgaaagttattggactcaattccaatttctattatggtgacaatctttggagttatggagaaacaactactaaaccggacaaatttggtatttggaaattcttgattgatgaattggttgatagtgaatctcatggtcaaagagtttggattttggctcatattccttcaaacaattatgatgttttgccaattcaatcacatatttttgctgccattgtcaaacgattctctccttacactatagccaatttgttttttggacacacccatagaacccagtattctgtctactattcaacaaatgacaccagcaagatcgaggatgcccttactgtgtcttgggtgaatccttctgtgactccatacacaaacttcaaccccggattcagatactatgaggtggaaaatgaaagtttcaacattcgtaactcatttagttactattttgatttaaacggaacatttaccaacagtggtaatgaaccaacatggaaattggaatattcagctagagaatcatatgaccctaaggggacttggccaaaagatgctcctctcaatggtactttctggcattcatatgtctccaaatacttgtggaataccactgatacccatttcaatcaaaaatttatgaataacaagtacagacaaagtccacttactccaaattgtaccacagccaaaaatgcccttgataacaaatgtttcaacgataataattgtttcctttactttttatccgatgacaacattaattgtcaaaaaggctag

SEQ ID NO: 34 - DNA, 960 bp, Candida albicans
cgcggccggctactccgaggtgaagaggatggtagtaataattggactttttttgaaacggggttattttggtttaaagatgaattacaccaatttgataaagagcttaattttgacactattaccaacacagacgggttgaccagttatattactgacaaaatattagaattagagattcaaatcggtgaacagttagaaaagaaaagcaatggcaatgataattatgttgttaatgaaaactatttcatcaatttgataaaacttattcgttataaagaattattcactattttagagaaactcaaagataatgaatcattatcactattaaaacaatttaaaaatattatcaaattatccaaatatcaatattatagatacttatcaatcaacgaatttcttagcaataatggcaaaacaggttatagcaatctggatgatcttagtatggatgagttttattattatttgatatcgacaaatacaatcaatattacacaaaccgataattactataaaatttgtccgaaattatatcaaatttcacaaagttcaattttccccagtaatataattgccaaacaattgttagaaatgataactgagttgaaattaagatatggtaaagatgaaacaatcatgccatggcaaaaagttaataaacaagagatctctttgttaccattaccaatttatcatattactaatgattccattaataattatattttcagctttttggtactggttgaatttgataattttgaaatattaatggatgatgcttgttttggtgatatttataaattcaaacaagcttttggtctgacccttgttgaaccgagtaaaaaaactatgctttatattatattacaagatcaaaaaagaatcagagagttgtttaacgatcctagaattttcgagtcttatcgtgagttgttatcaaagcaaaactga

SEQ ID NO: 35 - DNA, 333 bp, Candida albicans
ggtttctttgccttattcgtacctagtggtactccattacctctagttccaatactagtccttatcgaagcattatcttattcttcacgtgctatatcactaggtctacgtcttggtgctaatatattatctggacatttacttatgttaatcttaggttcattaattgttaacttaatgtcatcatctatcttaggatttatcggaggtattgtaccaatagtggctgttattgctattactatcttagaagtaggtattgctattatacaagcttatgtatttagtatcttattatctggatatattaaagattcagtatcattacattag

SEQ ID NO: 36 - DNA, 201 bp, Candida albicans
ggtgtagctattatcgctatctatgatactatcttaaacttagtttactcacaaataggtaaagctggaggtcatttcttccctctaatatttactatatttaacttaatctttgctgctaacttaatctctatgataccttactcatttgctatctcagctcaattagtagctattgtatcatttagtttagctttatga

SEQ ID NO: 37 - DNA, 273 bp, Candida albicans
cccacccgggatcaaagatcccgggtgggccctaccttaccactatgtctggcctttcttaatcccctatataacctgtatcctatacggtaccttttatttataatgttctattcacctttagatcaattcgaaattaaaccattacttatggttaataatatcttaactttagccttaactaactatactctatacttaattatagttgttagtatcatattcggttatacatctattattagtaatggacgtttaggttctacacgttga

SEQ ID NO: 38 - DNA, 1269 bp, Candida albicans
agtcgtgagtttgactttttattgaaattggatgaatcattagtgaatcaacaaaatcttagagaattttctcctgttgacaaagctgaaattttccaaagaattatgaaagatcaacatcaaattttagttgttgataatcaaaagaaacatattagagattctaaaagactcattaagggtacaaacaatttatctattcgttctgccaccaatagcagtttcagtaatgttcatagtggaattagtgccagcactagcaacactaccactgctgccggcaataccaataacaataacaataacaataacaacaacttcaacaacaacaacaataataatgcattaagtggaatgcacaatttgacgagaaaaacatcaaatacatctttgaaacgtcaatcattatcatacaaatcaagctcatcatctagattcaaaataagtggattatttaccaaatcaaggccattttctttaactggaaacacatccactccagaaagagttgttaatattgaagaattaccaaatccagaagattcgatcgaaccaaagcaaaagccagttgttgtgatacctttaaaaaacagaaagattttccctgtataccttatgccattgtgttttaaaattgattctgaaacaactaatgatcattattttttccaagctacaaatgacactgacttgaatgaatggttaattaaattaaattacgctaatagacattggttttattcacgtattcttaacaacaaaactacaaacaataatcttgtctttggcgttccaattagttttatttgtgttagagaattatctgttgttccgaaatttttggaagccatattccaagaaattgaatccgaaggaatcaaagatgttggtatttatcgtatcagttcttccattagtgagttgactagtattaaacaaacgattgatagaacaggtactatcaatttcaatgatcggggatatgatactcatgctttgaccagtattgtcaaatcctatttccgtgaattaccagattcattaataactgatgatgctattagtcaattttatgaattgaagttggaacaagaaaataaaaaccaaaccccagatcgtgatgcatttgatttgaatgcttatcaaaaaattttacattcattaccagtggtcaatttcaacactttaaaaattttggtaaagcatttgaataaaatcagtgaacataaagaaatttataaaatgacccatccaatattgctacggtga

SEQ ID NO: 39 - DNA, 957 bp, Candida albicans
aagaagattgtcaaggaaatgtcatcattacgtaagttgcgtaaagatttcggatcaattgaaaaaactcaagaattgattgatcaagacaaagccaagattgctgaattgaaaaagaaattgtctgctactcataacaaagaggtccaagctcaattcgaaaccattcaaaaagaattggatgccattaacgaatataacaagaccattatttctaaaagagacgaattgcgtgacaaaagaactgaaatcaaaaagcaaaaggatgccaaatatgagcaaattagaaaaattagaagtgactttgatgaaaaatttgcttcttttaagaaacaattagctgaagaaaaaaagagacgtgatgaagaatacaaacaaagattgttggaagaaaaacaacaaaagaagaaagaacaagctgaaaaggaattggctgaagcttccattccagctttcaccgaggaaatcaattccatccacactttgttgtcttactttgacccatcttatgtcaaaccaaccaagaaaaccgaaaccaatggtgctttaccaatcaataacaacattagaaaggttgaattcccagaagactttgttgtcattaaaaaggaacaagaagagttttttgctggtaccaaaggtaaaaagggtaaacaacaccaaaagaaatctactaaacacaagaatttcactgttgctccagaagttgttgttgccttaagtgacttgaccattgctttcccaactaaagaagaggaagtcccagaaaccatcaagactttgaaagaaaccttgactgcccttgaagaaaaacaagaagaacaaaccaaaatcaacattgaaagagccaaggccagaattgctaaattggaagcagaagaagacgaagaagaagaatttgaaactactgccgaagaaaaagaccaaaaagttgaagaacaatcaactgatgcttaa

SEQ ID NO: 40 - DNA, 549 bp, Candida albicans
gtatattttactttttttttgttctgcttgcaagccatcatgtcctccgttaaatctgctactacttccacttcagctgctccaagaagaagagaaatcaaacgtccagatgataaagctatcaaggaagaaattgaaaagttgaaggatgagattaaaaaattagatctcaccaacaatgaaatctatgctcaaattgccaaagctcaaattgatcaaaaagtcatggacaagagaaacaaattgcaaactgaattgaagtctttgattgccaaacaatctcaaggtaaaaacgaacgtcaattaatcaatgaccaaatcaaagccattgatgcttccatgaagaaaagaattgccgaaattcaacaactaacttctaaaaacaactttaagaatgttgctgagattgattctagaatcaactacttggatggattgattgatgctggtaatttgaaattggccgatgaaagaagattgtcaaggaaatgtcatcattacgtaagttgcgtaaagatttcggatcaattgaaaaaactcaagaattga

SEQ ID NO: 41 - DNA, 1098 bp, Candida albicans
  unsure (36): Identity of nucleotide sequences at the above locations are unknown.
tctccacatatgattttccatcccgcccgcgttcangatatgtatgcctataagcgcatcgatcatacttatgcctgtgaaaactcgtatttattgaattatcttttgaaagctgaattatcgttccaaggttttgtggtttctgattggggggctcaacatactggtgtcaattcggcactcgctggactagatatgaccatgcctggagaagtgtttgatgattggctcacggggaaatcgtattggggtccattattaactcgtgcagtgtataatggcaccatttgtcaggagcgattaaatgacatggtaatgagaatattagcaccatttttcgctcttgagaatgttcaattaccactggaagatgatgtacccaatttcagctcatggacccatcacacatatggccaagaatttccctatcaacattatggtcctatagtgcaaaagaattggcacgtagaagcacgttctgaatttagtgataatacggcattgacagtggccagagaagccattgttttactcaaaaatagtggacataatttaccaattgataaaaatgatggcgtaagacgacttttcatatcgggacaaggtgctggacctgactctaaagggttcaattgcaaagaccagcgatgcgtaaatggtgtattgacaagtggctgggggtcagctgctgttggtaatccatttgtaatcaccccctatgaagcagtagcgagaaaggcaagagaacgaagcattgttgtcgattattgtcgcgataactgggattgtgaaaccaatgctgatttggctgattacgctgacctttccattgtgtttgtcaattcattttctggtgaaggatatgtgtatcttgaaaaaaattttggtgatcgacaaaacttgtcattatggcataatggagacgaattgattgaaaaaattgctgataaatgtcataaaaccgtggttgtagtttcatcaacggggccaatcaatatggagcgatggattgagcacgataatgttgtggcagtattatttgccccaccattggggacaatttgttggtcaagcaatagcagatctcttatttggtga

SEQ ID NO: 42 - DNA, 525 bp, Candida albicans
atatgttttatatcaaacaatactaacaattactttaaagctcttggtggtagaattgaaggtgcatggcagaaagcatttgataaagttcgtaaattgattgaaaaaatgtcatttgcagaaaaagtcaatttgacaacgggcaccggatgggggtctggcccatgtgttggtaataccggtagtgttccaagattaggaatccccaatctttgtcttcaagacggtcctaatggagttcgatttactgattttgtcactcattttccgtcagggttggcaacggctgccacatttaataaaggattaatgtatcttcgtggcaaagccatgggaaaagaacataaaaaaaagggagtccatattgccttgggcccagtgattggtcccatgggattgaaagctgctgctggtcgtaattgggaatcatttggcgccgatccatacttgcaaggaattggtggtgccgccactgttgaaggattacaggatgaaggttcttcaccacgggtgaaaatccagtcg

SEQ ID NO: 43 - DNA, 939 bp, Candida albicans
tttcatcaacggggccaatcaatatggagcgatggattgagcacgataatgttgtggcagtattatttgccccaccattggggacaatttgttggtcaagcaatagcagatctcttatttggtgatgttaatccatcaggaaaattaccatttactatagctcggaaaagacaacattatgtaccaattattgatgatttaactgctggtgatatggagcctcaagacaattttgatcgggatatttatttggattatcggtttttcgataaacataatattaaaccccgatttgattttggatacggattatcttttaccagtttcaaagtttccaatttgaaaatcaatgaaatcaacccaccttcagaatatttaccctatcctctggaatatttgccaactattaaaaccgtagaagatgatgtttgtgatcctgaagatgcattatttcctcatgacgattttgatcctagtcctggatatatatatccatatttatacaatgaaaatgtgcgactgattgatgaagaagatacttttgaatatccgggagattttaaccctgatcaggcaacttcaccaccattagctggtggtggacttggtggtaatcctgcattatgggaagtgttatatgaagttagtgttgaaatccaaaatgtgggtaaaattaaaggtggatatgtgagtcaattatatattgaatttcctagtacattattgatatcaccacctaaagtattacgaggatttgaaaaagtatttttggaatctggcaaatcaacaaaaatatatttcaatattttacatcgagatttgagtatatgggattctgaatcacaacaatggattatacaaacggggacttataagatatatatttcttcatctagtcgacgggttgaattatgtggagaaattgatattgggtgttaa

SEQ ID NO: 44 - DNA, 300 bp, Candida albicans
tcaaatatatatatatttatatataacatttttaacacaatgactgattcatttgatattgataatatattatctcaattgacattagaagaaaaaattggattagtaagtggaattgatttttggcatacatatccaatttctcgattaaacattcccaaagtgagattcactgatggtcccaatggtattaaacgcacaaagtttttcaatggtgttcctctggcttgtttcccctgtggaactggattaactgctacctttgatcatgaaataattattgaccaccggggaaattaa

SEQ ID NO: 45 - DNA, 702 bp, Candida albicans
gattctgaagatccttatttaactggacaaattgccactgctataattaagggtattcaatatgataatgaaattggtgccacggttaaacattatgtttgtaatgatctacaagatgaaaggagtgctagtgattctttggttacaccaagagcattgagagaaatttatttagaaccatttagaatagctattaaagaaagtaatccaatttgtttgatgacagggtataataaagttaatggtgaacatgtttctcaaagtaaatttttcttgcaaaatatattacgtgatgaatggaattggcaagggacaattatatctgattggtatgggacatatacaagtataaaagccattgaaaatggtttggatttagaaatgccaggatctcccattttccgtaataaacaattgttgactagtatgattaaatcaaaagaattgcatatcaaacatttggatgatcgtgtaaagaatgtattaaaattaattaaatttgccaaacagtcaagtgttgtggtcactgaagatggtaaagaatcatcggagaataacactcaagatacaagagatatattacgcaaactagctcaagattctattgttttattgaaaaatgataattatttattaccattgaaaagggatgacgtcgacttcagctccaagtttattgcaataattggtcttaatgcataa

SEQ ID NO: 46 - DNA, 1545 bp, Candida albicans
attgccgcttattcaggtggtgggtcagccactttaccagcttattacaccactactccttataatgccattgttgagaaattatcttctatttccaaatttgatattacatcacaactcaaatatactattggtgcaaaagcatataaatatttaccagaattaggtccacaagtgatcaatcccaaaactggtaaacccgggttttccatgaaattttataaaaagccaaaatccgttcctaatgaaaatcgagaattatttgatgaattagatacagaaatatctgatattttattaggtgattattatcataaagatatcccttctaatgggttatattatattgattttgaatgtgaattcacaccatcaaaaacccaacattatgaatttggtttaactgttcatggtacagcacaattatttattgatgataaacttgttgttgataataaaaccaaacaaattaaaggagtttcatttttgaattctggaaccattgaagaacgaggatcaattgaattacatcaaggtaaaacttataaaatcattgttgaatatggttcggcacctacatttacattaaaagatcaagttggagaatattttggtggtgggattcgtcttggtatgaatgaaattattaatgatgatgaacaagaaatcatcaatgcagtaaatttggctaaatcagtagatttagtgattttaattattggattaaataaagattgggaaagtgaatcttatgatcgtcctgatatgaaattacctggattacaagataaattgattgaatcggtattggacgttaatccaaacaccattattgttaatcaatccggtacacctgtggaattttctgaatggttggataaactgaaagctttgttgcattgttggtatggtgggaatgaaagtgggaatgccattgctgatattttatttggtaatgtcaatcctaatgggaaattatcattgactttcccattgaaaaataatgataatccaacttttttgaattttaaaactgaaagaggtcgagtattatatggagaagatatttttgttggttatagatattatgaaaaattgaatcgtcaagttgctttcccatttggatttggattatcatatactaaatttgaattttttgatttgaaattggagaagaaaacaaaagataaagaagaagaagaagaagaagaagaaagtcttgttgtttcattgtcggtgaaaaatattggtaagatgactggttctgaagtgattcaagtttatgtatctaaagtggaatctgatgtgattaggccaattaaagaattgaaaggttttactaaagttaatttacaaccaaatgaaaccaaatctgttaatttgaaattgatcattaaagattcagtttcgtttttcgatgaatatgccaatcaatggtcagtacaactgggccaatacaaagttcatgttggtaatagtagtgataatataccattgactgagagtttcaccatagagaaatcatatttttggtcaggactttaa

SEQ ID NO: 47 - DNA, 903 bp, Candida albicans
gttgccaataagctaaaactcccagaaaccgaacaaatgctagattatattcgtcctgatttgttatttctacggtgcttggctaagaatttgattatgtggaatgaaatttcatgtacagatacttgggttgcctctcaaatgccatcgtcagtagctcataaatacatgtctggcaatggacatgaagtggcttttgagcatcttgatggtgatcagttgacgtatttcaacgtattaggtggagcgtgcttgtcgatggccctaaaatttgcatcttcccataatttggaagccagagatactatactaaaatatcttgacaaagtaatgcaattaagtgcaaaacccgcattaaactatgaccagaaaattgcatacaaggggtgtgtgaatcttcaaaatattttagcactatgtgcttccgtgatcatggcagctagtggtgatttggaagttttccgtcgattaagagtattgcataacgatacaaataaaaaaatgggatttgggtgtttcatggctattaatacggctttgggatttttgtttttaggtggcggacagtatgcttttgacagctcaccatttgctattgcttgcctagtcacatcgttgtatccaatttatccgacagagaatagtgaatatgaaatacacttgcaggctttgagacatttttgggctttggcaatacaacctacatgcttgatcgtgcgagatatcagtacgggcagaccatgcaagattccggttgcaataaacatgaatgatgactcagtcctagatagtatctcaccttgtctacttcctgatatccacgagattctaactttgaaaacaaactcgagtgctcatttcgaactgaatttagactttctgcttaattccgacgttttataa

SEQ ID NO: 48 - DNA, 1629 bp, Candida albicans
tcccttcccccccttgtgctcgtccaccccgcccgccccccccagaagttagtttccttccagcggcggtctgtgaagaatgatacaagtatgaagtttgaaaaagaagagatagataatcaaggtgaacccaattcaagtcaatcatcatcttccaataacacaatagtcgacaacaacaacaataatgataatgatgttgatggagataaaatagttgtcacttgggatggtgatgatgatcccgaaaaccctcaaaattggccaactttacaaaaagcatttttcattttccaaatttcatttttgacaacttcagtttatatgggatcagcagtttatacccctggtattgaagaattaatgcatgattttggtattggaagagtcgtagctacattacctttaacattatttgttattggttatggtgttggcccattggttttcagtccgatgtcagaaaatgctatatttggtcgtacatccatatatatcataacattatttttatttgtcatactacaaatccccactgctttggtaaataatattgccggtttatgtatattgagattcttgggtggattctttgctagtccttgtttggccactggtggtgcaagtgttgctgatgtggttaaattttggaatttaccagttgggttagccgcttggagtttgggtgctgtttgtggtcctagttttggtccattctttggttcaattttaactgtcaaagccagttggagatggactttttggttcatgtgtatcatttctgggttttcatttgttatgttgtgtttcactttacctgaaacttttggcaaaacattattatatcgcaaggctaaaagattgagagccatcaccggtaacgacagaatcacaagtgaaggagaaattgaaaatagcaaaatgacaagtcatgaattgatcattgatacattatggagaccattagaaatcaccgttatggaaccagttgttcttttgattaacatttacattgccatggtgtacagtattctttacttgtttttcgaagttttcccaatttatttcgttggagttaaacatttcaccctcgttgaattgggtaccacatatatgtcaattgttattggtattgtcattgctgcctttatttatattccagttattagacaaaaattcaccaaaccaattttgcgtcaagaacaagttttccccgaagtatttattccaattgccattgtcggtggtatcttgttaacttcaggtcttttcattttcggttggtcagcaaatagaaccactcattgggtgggtccattgtttggtgctgccactactgcttctggtgcatttttgattttccaaacattattcaatttcatgggtgcttcatttaagcctcactatattgcttcagtttttgcatcaaatgatttgttcagatcagtcattgcttcagtgttcccattatttggtgctcctttgtttgacaatttggccacccctgaatatccagttgcttggggtagttccgtgttgggtttcatcacccttgttatgattgctattccagttttgttttacttgaacggaccaaagttgagagcaagatctaagtatgctaattag

SEQ ID NO: 49 - DNA, 234 bp, Candida albicans
ttttatattgccccaatagcaatacatatacttacatataacttcataatgcattacagatttttgagagatagttttgttggtagagtgacctatcatttatcgaaacataaatactttgcccatccagaagaagctaaagattatattgtccccgagaaatatttagccgattacaaaccaactcttgctgatgatacaagtataaattttgaagaagaagagatagataat

SEQ ID NO: 50 - DNA, 195 bp, Candida albicans
tgtcattattcattaaccaaacaacgattattgaattcagctactattaaccctgatatcaaacccaaatcaattgatcttaaacaagatggattgaatattatttgggatcaagaagatcatgaatcaaagtatgattttaactggctcagattacattcttatcaaccacgtttaatccctatggatgaataa

SEQ ID NO: 51 - DNA, 792 bp, Candida albicans
tcgttcacccgtggtgaggacaattctggcaatagttttaatgagcacagaaaccaccactacaataacaacactaataataataataataataataataatgctgctactagtaataattacaaacaaccacagttaatgtcgaagaaatcaaatgatagtctttctagtcaatatcaatatcaatcacaatcccaacaaccaaaacatttgagtggagataaatctcgacaatccttaactgacgatttggaccctttgaaagcaaatacttggacaccaaagcaagtttcttcttattttgccttggtgttagggtttgatatggatgtggctgggaaatttgctcaacacaaaatcactggagaaatcttgtttgaattggatttaaatcttttgaaagaattggatattgattcatttggtaccagattcaaattatataaagaaattgggaaattaaaggaattgaatactgaaggagttaaagataaacaattgagaacagattctctgtcgactggatcaactggtaaaaatgacactacgtcatcagcattaaattctccaccaactgcttccacaactttacacgatgccgtgcctcatatcgatgataataatatgttaaataatactggcaaacaacaaacacaactaatgccatcagccgttttgaccaacacttctgactacaataataatagtcaacaacaaagtggttcctcaacatcatcagaggaaaaggtcactgtcggtggatgttgccccacaacaatacttggcttctga

SEQ ID NO: 52 - DNA, 288 bp, Candida albicans
ttaatcaaatcctcaaaattaccctctttattactactaaaaaaaactaacaatacaaatatggatggtggcgatacttatatatgtataaaacaatttaatgccagattaggcgatgaattgagtcttaaaattggcgacaaaattcaagtattggctgacgatagagaatataatgatggttggtacatgggcaaaaacttgttgactggagaagcaggcttatatccaaaaacatccactcaatctcaccacgggagctgcccgaatcggcgcttattgtctccc

SEQ ID NO: 53 - DNA, 1485 bp, Candida albicans
aatgaagaagttttttcagtgttagaatatttgaaataccccaaggcattagtttcaatcaaagagattcttaggggaacaagctctaagggaaacacgagaaatattgatgaacttttgtcacaatctgttattgataaagttaacgaaatactgtcacaatattcaaatgacattcaaaggaaaaatactattgaaaattcgagaaaagaaatatatcaattaattaaatttttgacggaaaataactgtcaagatgatgcaattcaattaaaaaagattttatacgacgcatcggtatcagataccaaattatttgcattagtggatgaaacttatcatcaaactttaggaaaaggaattcaatctactgaatttaagagtttattcaaaactgttgataacaagtcatcgaatcaagattcagaaataagtcttttggatattattgatgatgatgatgatgacaatactaatcaagataaacaaatcaagaatattgaggattacttgaatgatttaaataatattaaacaagctaaattcaaattaattgagaaattgaagaaagaaatccataatgatgatatttccgatattttggtattaaacatgaaattaaaatctactaatgagatcaaatcaattattttccctgaagaattgaaaaaatttaatccatttactaatgaattagataaattaatcactaacgagaaatcaataattgaacaattaaaatcgcgttggaatcaattgatatcaaatcctcaaattaaaaacttacaaacggaaactaattcgaaaaatagattaattattagtcaactggaaaaaattgatcaattttatgggaattggttgaaatatcataatgggttaattgctggagaaaaattttataatcaattattggatcagtttaaaaattttagaaataatattgataatcaattgaatcaaggaatgaggagtttgaatattggtcaacaatttcctacccagccaatgttgaataggactcaaagttctggtttacaatcgaattatactggtcaatcgagtattagtcatagtggaagtctcagtggacagccatcaggaggttataatcaaccacaaccacaacaacaacaactccaacagcaacagcaacagcaacagcaagctcaattttctggtgcttataatcaacagtattcacaacctcatggtggatatacccaatttcaaggttatggccaagggcagggtcaatcacaaactggttatcaacgacaaccaccacctccaccaccacaattaccacccaaacaaagtatgggatcctacaattttgccacaactctacaacaacaacaactaccaccacaacaacaacaacaaccgcaacaacaaaggacacctcaaaatgaaagtaatttgatttatgataatccttcaacttataatccaaatatgtataattttttctccagtaaatag

SEQ ID NO: 54 - DNA, 981 bp, Candida albicans
ttaataccgtttttctacatccttccgatacaaaatatggagcaagaattactcctcaaaggcagaaagaaagactctattgagcagtttattagtggctcccagctatttcttgagaatggtttgtcgcagcttcgatacatggtactagtagaaggattatcaacacctgaaggatacgatcagtgtccataccgctcatatgtatggagcatactatgtcgagttcccccatccccaactgaacagtatttgcaattgctagaaacctcaagtcagaccctcccagatgaattactaatcaaaataaaaaatgatacttttcgtactttgatgaacgataaaaaattccatctgaaagtgaacgaggaatctttgattaggatactatcgtgtattggaataactacggaagttggctatgtacaaggtttaaatgttttattggcacccatcgcatacgtttgtcacaaaagtgaacctcaggcatttgcaatcttgcacaatttgataaccaagcaaatcccattatatattactcctaacatggaaggagtccacacgggtttgcaattggttgacgcaattttgaaaataatagatcctgtcttgagtgactatctacactctaagtttttaaaggcaaagatatacgctttcccttcgatactaactttatgtgcgtgtactccgcctttgaaatcagttttgaaactatgggactttctatttgcgtatggcactcatataaatgtgctctttgttgtggcacaattaataatatgtcgttcgagcattttggaaagtgaacaaccaatgaaaatcttgagaacttggccaaatttagaagaaaatgaaatcataaagttgagtctcagtttcatacctgaactaccagagaagctctatgatctaatagctacacatggttacgatagaaaagttcctaaagaattggcaagatttttagaagaaaaataa

SEQ ID NO: 55 - DNA, 3768 bp, Candida albicans
attaaaactatctgtattattattacttataaagataatctatcatccctaataatgcctccagcttatcaatctgcatttcataaaatcatttctcgtgataaaggagtatttgaaggtcacaatttccttgtttcagttgacacaataaattggattcatgtcaatacattgacaatcacagaacaaggccaattattttcatctgattcaaaagacaatcattatttgttactacaatctttacaatcttgttttatacaaatttatcctgattcaaatatatcggggtcaggtaaaagttccatttctcaaccaccaccaacaacttccacaagacgtaatttattaagaaaaagtagtaatttgaattcttcagatcaactgcacctgaagtcaagtgaagacaatgaacatcaaccaccagcgattcttataaagacttttgataatgataaactatatataaggataccttcaaaagcaaattttggtaatctattgagttgtcttatggtgtggcaaaatttaaaacctcaggggttagccaaaaaatggtattgtgaaaataaagttattgaaggattcaatcccaatgccccaatttatgaattattggtttgtcgatttaaaatttatggaccattacccaataaatataaaaatttgaatattgtcccgggacctaaagcacccgtgtatcaacagaaaatggatgattttaaagccaattttgataattcctatataataactccacaaatactgtcagataatcataatagtatcaatgaaggttggttttatgccatgggggcattgaattctcatgggattttaaattttataagtgaattagatgggactttattatattcgattgatataaagcagattttgtctagtgaaattagagaaatgcataattcgattttcaatagttcaaatatcttatttattggacaattgaaagaactacgttataataatgttataagaacattaagtaccttgactcctgatcaattattgacgccctttttaacacgtgatggtaaaatcattcctaataatcaaagaattttgattgaattccccttacacattgatttagaagattggtttgttggattaaattattttgctaaacgagaatacattggatcgtttgataatgaatcaaaacttattcataacgttgaacatcctcaattatatgatttttccaaagcaaatttccgagtatcgaaaaaaatgtctattgacattattgaagccaaatttgaaaatactgaaactaacaaactggggaaaatttatgcagaagtaagaatgtgggggttcccatggtctagaacggcaattgttaatcataccaataatccattttggaaagaagagtttctgactgatctaccgatctcaacccaaatggtacatattttaattaaaaaatgttcttttaatgattcatcttattcaactggtgataaattaattggtacggtttatgtgacacccgatattttgaccaaacaaatcaaaaccacttcgactattatgactagtagtgaatctagtcaagctatacaaatgaatacggtgccgttatctagtatggcatcgaatctgaatgctggattagatattgttagattgactattaatgatcccaacaatatccccattgggaaattactattagaagtccatttacaagaatatcatattctttcacccctggtattcaaaccattagaaaaaatgcttgttaatgcccccatgaaagatttgatcaagttttgtaatgaaaatgtcccttcatcagattttgaacgtgttagtttggtattgttagatattttccaaagtcttgaagtagaagatgattggttcaaaagtttaatggaagtagaattagttaatgttgatattatgacgaggaaaaattatcatcaacgtaatagtcaagatcaagcagtttctaattccaagacacaacaacaatcttcacataataatgtgttcaatacattatttcgaggatcatcgattttttctaaatcattagaaaaatataatttacgtattggacaagaatatcttgaaaaagtatttggagatttctttgctaaaattagtaatgaaaagaaaaattgtgaagttgatccaagatatgtcagaatacaagaacgtgctttacgaaaggggaaaagcattcatgaagctactgggttagagaatgggcaaaatgaagatgttagtgatgatgacgacgacgatgatgacaatagtagtgatgatgatgctgattacaatgcagaaaaggaacgtgaaagaaatgaaagaattaaacaaatggtggaagaaaatttccaaaacttgtatggatacgttgaagagatttggtataaaatatatataacatcgaatgatttacctgatcaaataaaattacaattgaagaatttccgaactaaagttgaattagtgtgtgatcctgaagataaagttactagtttgaattgtttatcagcatttatatttttaagatttttttgtccggcgatattgaatccaaaattattttatttagctaaaaatcatcaaacgggtagtacacaaagaacattgacattaattgccaaaatattacttaattttgctaatcgacaagaatttagtccccataaggaaccacatttagtaagaatgaatgtttttttaaggaaacatacaccagaaatttatgattattttgataaattgacgggtcggaaaaatgattttaatgaaaaaatattggatttaagtcatgaagttaaacgatttgatttaggtttagataaaacttctaatgaattacccacaactccttatttgattgataaatatttgagattaacggaaattgttcatttattggattatagtaaatatgtcaaaaatattggtaataacaataatggttcaatgagtaatttagggaccccagtgaatagtccatcaagagatatggaaagagaacaagatcgttcacgttcacgatcacaatcaggaacaccagatttagatcctatattaaatttaagtgatttaaaattaaattatgaaaataaatatcaaattggatcattagaatttgagaaactggaatttcttgaattgactggtgataatgaaactgaaggatttattaaatcattatgtaaaggtaatgaagaaattttttcatttataaattctaatattactttaaaagatattcaaaaacaaagtacaaaaatcatgaataaaattcaagaattggaaatttatttagaaaattatgaatttcctaataattataaagatcaaattatatgggattcgttcactgatgatattatgaataaatgttggttagatactagtagaaattgtttgatttattctgatcatgttccttcatcaaataatcaatataaaaaattggtcgatcatgcattttcaggattaaaattgaaatttaatgatcatcagaaattaaatggtaattctacaatgaattcattaataaataatggtggtatggggaatagaaatggtcatgatgttaatggtcacaataataataataataataataataataatactggagatggttataatgaaactgatcgtaatcaaagattaagttcaacttttagtactattagtattggtagtgctattaaaccaaatacttcaaagaatccattcaaaaaatggttacggaaaaattga

SEQ ID NO: 56 - DNA, 399 bp, Candida albicans
aaagttaaattaataattcaaattatcgtcaacttccgtttttcaatgaatacacttcatcacaacgaagggctgaaaatgaagaaacctcgtttacacgaaataaccactattcctataaaacaactacattctcagtttgacaacaccgagaatgccactaccaaatctacaactgtcgatgagtggctagatatattcccgcaagcagcaatattcaccgggtttgatgatatcttatttgactatgtgatcacaattgtctaccgcaagcacgaaaacatttcaacaaaatcaattaccaaatttggtgtatccacatacgaaaacatgcaactcacccatcgatcaaggttttggcccagttgtgaaaatttagaattgaaataccaaaagtca

SEQ ID NO: 57 - DNA, 690 bp, Candida albicans
atcatgaaatatgcattagtgttgttactttcattaataaacgctcttaaatatgtgccatttgataaaacacaattagatccatcatcggtattcgaacaatttgattatccttctttaaattcatccccctggcaagtatcaactgccaaaaaatttgatgagggaagagatgaaatagttcgttatagtggtgaatggaaaattgaatcttcgacttcgaaatatcctggtttagaaggtgatttaggattagttatgaaatcaagagcttctcattatgccatttcctataaattacctcatgaagtgacaaataccaatcccaataataataaaacccaagatttagttttacaatatgaagtcaaattacaacaaggtttgacttgtggtggtgcttatataaaattattggatagttcaccttcaggttataaatttttcaattcagaaactccatatcaaattatgtttggtcctgatgtttgtggtagtgaaaataaaatccatttcattataagaaaaaaacttcccaatggtgccattgaagaaaaacatttaaaacataaaccaatggcaagaacaaatgaattgactaatttatatacattaattattaaattcaattcagattttgaaattagaattaatggaacagttgccaaagctgggaatttatataagaat

SEQ ID NO: 58 - DNA, 318 bp, Candida albicans
ttttttcactgcttatatttctgttatattattcattgttctttgggttggattccactttttcttttatggattcgggaaagatcttttaaaatgaacaatattttggttccattggatgaatgtgatattgaatctggtgttagagatattaatgatgcagaatttgatattccaccacacaaaagaatgcatgggataaattctgggctattgttgcataaacgtttttttatatataattctataagtttagactgttttttaaaaaatttaattacacatttgcataataataaagataccatttacttgtaa

SEQ ID NO: 59 - DNA, 1086 bp, Candida albicans
  unsure (1058),(1063),(1065),(1071): Identity of nucleotide sequences at the above locations are unknown.
gttgaccttcaaagtaaagtcatttaccaccgtttggaacaattgtcttacatttcccttttggaaggtagagttggtatggctactgattcttatagaattggtgctagatacattaccattgccttgagatttgctgttggtagaagacaatttgccagtgcaaagggcaaagaagaaactaaattgattgattacactttacaccaaagaagattattaccattcttggctatgacttatgctgcagctcttggtactgacagattggaacgtcaacatgaagaattgttggcaaacttggacaaagctttggcaaccaaagacaagttgttgttgaaaaacaccatcaatggtaccaaatccatgtttgttgattctggttccttaaagtctacattgacttggtttgctgctgatttgattaatgaaaccagacaagcttgtggtggtcatggttactcctcctacaacgggtttggtaaatcttatgatgattgggttgttcaatgtacttatgaaggtgacaacaatgtcttggctatgtctgctggtaagaccattatcaagacagttcaacaagttttgaatgggaaaccattacaagattcaaccttggaattccttaatgacgccccaactttgtcaaaggcaaagaaagcggttattagaattaaagaacacgttgacgatgttgaccgtgttttgaaagctgttgctggtttgattagtaaattctcctccgatttgattgctgtttcacatcaatcttgggattcaattggtccacaaagagtcattttgtctaaattgagatgtcactactatttgttggaaacttttaacgaaagattgaacgacaacattaaagccaaatctccagcaagaccacacttggaaaacatcgttaaattatactatgtcaccaacattttgggtccatttattgatgaattcttaagattcggtgtcatttcaccaaaagttgccaaatacattactggtgaatacccacaaagattacgtgccatcaccagaccttatatagtatcgacccnacgananctgganaaaatcgcgcgcgcg

SEQ ID NO: 60 - DNA, 198 bp, Candida albicans
tacttagccggatccggcactcttggtgaagacatgcagatactggagtacaacattagaaatttgttacaagaagtgtatttcgacaaattgaaggatatcatgttgaaagatttaagatcaattggtgatattaacgacaaaaagttggatgatttgaaacaaaatgccatcatcaaaggattacaaggtttataa

SEQ ID NO: 61 - DNA, 1227 bp, Candida albicans
  unsure (11),(48),(70),(149): Identity of nucleotide sequences at the above locations are unknown.
caacaacccantaaacatcaccatttatcaatgtttttaaagaatatnttcattgctcttgctattgctntattagtcgatgatactccaacaacaaccaaaagatcagctggtttcgttgctttagatttcagtgttgtgaaaactcntaaagcattcccagttactaatggtcaagaaggtaaaacttccaaaagacaagctgtcccagtgactttacacaatgaacaagtcacttatgctgctgatattaccgttggatccaataatcaaaaacttaatgttattgttgatactggatcatcagatttatgggttcctgatgttaatgttgattgtcaagtcacttatagtgatcaaactgcagatttctgtaaacaaaaggggacatatgatccaagtggttcatcagcttcacaagatttgaatactccattcaaaattggttatggtgatggatcttcatctcaaggtactttatataaggataccgttggatttggtggtgtttcgattaaaaatcaagttttagctgatgttgattctacttcaattgatcaaggtattttaggggttggttataaaaccaatgaagccggtggtagttatgataatgtccctgtcactttaaaaaaacaaggagtcattgctaagaatgcttattcactttatcttaattctccagatgctgccacgggacaaatcattttcggtggggttgataatgctaaatatagtggttcattaattgcattaccagttacttctgatcgtgaattaagaattagtttgggttcagttgaagtttctggtaaaaccatcaatactgataatgtcgatgttcttttggattcaggtaccaccattacttatttgcaacaagatcttgctgatcaaatcattaaagctttcaatggtaaattaactcaagattccaatggtaattcattctatgaagttgattgtaatttgtcaggggatgttgtattcaattttagtaaaaatgctaaaatttccgttccagcttccgaatttgctgcttctttacaaggtgatgatggtcaaccatatgataaatgtcaattacttttcgatgttaatgatgctaacattcttggtgataactttttgagatcagcttatattgtttatgatttggatgataatgaaatttctttggctcaagtcaaatatacttctgcttccagtatttctgccttgacctaa

SEQ ID NO: 62 - DNA, 537 bp, Candida albicans
tacgttggtccttccggccgcctggtgaagactgataatgctaaatatagtgggacattgattgctttaccagttacttctgataatgaattaagaattcatttgaatactgtaaaagttgctggacaatccattaatgctgatgttgatgttttgttggattcaggtactaccattacttatttacaacaaggtgttgctgatcaagtgattagtgcttttaatggtcaagaaacttatgatgctaatggtaatcttttctatcttgttgattgtaatttgtcaggatcagttgattttgcttttgataaaaatgctaaaatttccgttccagcttctgaatttactgctccattatacactgaagatggtcaagtttatgatcaatgtcaacttctttttggaactagtgattataacattcttggtgataatttcttgagatcagcctatattgtttatgatttggatgataatgaaatttcattagctcaagttaagtatactactgcttctaacattgctgctcttacttag

SEQ ID NO: 63 - DNA, 1269 bp, Candida albicans
gctcaaccaacaatgttcttgaaaaatatcttgagtgttcttgcttttgctttattaattgatgctgctccagttaaaagatctccagggtttgttaccttagactttaatgtcaagagatctcttgttgatccagatgatccaactgttgaagctaaaagatctcctttatttttagagtttactccctcagaatttcccgtcgatgagactggtagagatggtgatgtggacaaaagaggacctgttgcagttactttgcacaatgaagctattacttatactgctgatattactgttggttcagataaccaaaaacttaatgttattgttgacactgggtcttctgacttgtggattccagattcaaacgttatttgtattccaaaatggcgtggtgacaaaggagacttctgtaagagtgctggttcttattccccagcatcttcccgcacttcccaaaatttgaatacccgttttgacattaaatatggtgacggttcttacgctaaaggtaagttgtataaagataccgttggtattggtggtgtttctgttagagatcaattatttgctaacgtttggtctactagtgctcgtaagggtattttaggtattggttttcaaagcggcgaagctaccgagtttgattacgacaatcttcctattagtttgagaaatcaaggtattattggtaaagctgcttattccctctaccttaactctgctgaagcttctactgggcaaattatttttggtggtattgacaaggccaagtacagtggctctttagttgatttaccaatcacttccgaaaaaaaattaactgtcggtttaagatctgtcaatgttaggggacgaaatgttgatgctaacactaatgtccttttagattctggtactactatcagttatttcactagaagtattgttcgtaacattctctatgccataggtgctcaaatgaagtttgactctgctggtaataaagtttatgttgctgattgtaaaacttcaggtaccattgatttccaatttggtaataacctcaagatctccgttcctgtttccgaattccttttccaaacatattacactagtggtaaacctttcccaaaatgtgaagttcgtattcgtgaaagtgaagataatattcttggtgacaactttttaagatcagcttatgttgtctacaatttggacgataagaaaatctccatggctccagttaaatacacttccgagtctgacattgttgctattaattaa

SEQ ID NO: 64 - DNA, 1053 bp, Candida albicans
aaaggatggtgtggaacaaaagaggacatgttgcagttaaattggacaatgaaattattacttattctgctgatattactgttggttccaataaccaaaagcttagcgttattgtgtgacactgggtcttctgatttgtggattccagactcaaaagccatttgtattccaaaatggcgtggtgacagaggtgacttctgtaagaataacggttcttattctccagctgcttctagcacttccaaaaatttgaatacccgttttgaaattaaatatgctgatggttcttacgcaaaaggtaacttgtatcaagataccgttggtattggtggtgcttctgttaaaaatcaattatttgctaacgtttggtctactagtgctcataaaggtattttaggtattggtttccaaaccaacgaagctaccagaactccttacgacaatcttcctattagtttgaaaaaacaaggcattattgccaaaaatgcttattctctcttccttaactctcctgaagcttcttctgggcaaattatttttggtggtattgacaaggccaagtacagtggctctttagttgaattaccaattacttctgacagaacattaagtgtcggtttaagatctgtcaatgttatgggacgaaatgttaatgtcaacgctggtgtcctcttagattctggtactactatcagttatttcactccaagtattgctcgtagcattatctatgccttaggtggtcaagtgcattttgattctgctggtaataaagcttatgttgctgattgtaaaacttcaggtaccgttgatttccaattcgatagaaacctcaagatttccgttcctgcttcggaattcctttaccaattgtattacactaatggtgaaccttatccaaaatgtgaaattcgtgttcgtgaaagtgaagataatattcttggtgacaacttcatgagatcagcttacattgtctacgatttggatgatagaaagatctccatggctcaagttaaatacacttcccagtctaacattgttgctattaattag

SEQ ID NO: 65 - DNA, 648 bp, Candida albicans
caaaatcagttgaagatggatgtaaaccaaatcattcaactaatttttggtaatgggatcttatccggtggttcaattcaaggaacacattctggtaatggacacagtgtgaaatatgaagtgtcattgccctcttcatcatcacaaaaaggttctaatggtccatcctccactgataataaggatactgatccatccaaaactggattttctttagatgatttaatgaactcaattccaactgatttttggaatttaatcggtttgaataaagcacctacttcatctgacaatggttccaaagatgcagatttcactccaagtgctgtctcacaggtcgaacaaccaacaagcaagagcgttgaatcaactgctcctggcccagcttcctcggcatcttcttcttcttcactggaagctgcttcctcttcgcaaccatcagaagatagtcaaccttcttcatctgccaacaaaaaaactggtgcttttttcctcagtttagataacactcaaacattatatactgctactttgaaagttggttcaccagctcaagaagttcaagttatgattgatactggatcttctgatttatggtttatttcttcaggaaattctcaatgtaacagtcaatggaggatcaattga

SEQ ID NO: 66 - DNA, 672 bp, Candida albicans
tctgtcagctgtctagtcaaaactcgtgatgctgtccaaggttatattttatttggtggtattgatcatgccaaatatactggggatttgaaagcttttgatattgttcaatctaatgataaatatgtttattctcaaatcccattgacttcagttgcttcatcattgaacaattatactaatgcttatggtcttcctgctggaagtaaccatccaaaagtaggtgctgttatctataatggtaccgattcttttaatggtggtgttgatctcaaagacactccaactttattggataccggaactacatacagttacttatccaaagaccaagttgaatcaattgttggactttatggtaatgttacttataatgatgctgggaaagcttatgaagttccatgttgggtaggtaatcctggtaattatttggaattcaatttcaaaaatgaacaatacattaaagtaccaacatctgaatttgttatttcagtcggtacttatgctagtggtgctgaattgtgtgtatttggtattttaccaggtactcattcaattttgggtgacaactttatgagaagtgtctatgctgtgtttgacttagaagaccatgtcatttctattgctcaagctgcttataatgataaccatgccgttgttcctatcgagtaa

SEQ ID NO: 67 - DNA, 588 bp, Candida albicans
tttcacatttgctccccaatgtcaaggacaaaatctacaaaggtcctaattattggggccggggtttctggattaaaagctgcagaaacaatattgtcgaaatcatttttaacaggtgacgacgttttagtggttgaagcccaaaatcgaattggtggcagattaaaaacaacagacacttctcaatctaaactaggaataaattatgatttaggggcatcgtggtttcatgattcattgaacaatatagtattgaatcatatgattaacgatggtttgttagatgatgagaaagatgtctattttgatgacaaggatcttaaaactttttctagtactggagaagtacctattgtggacaagaaactaaacagagtattagaagacattgaaaagtatattcaattgtatttcaatcggaatttaggtgttcccgatttatccttgcgagacattgttgcacaatattttgaaaaatataatcggttgattactgaagagcaacgtgaatattgtggaaaggatgataaggtattggaattttggtttggaattagttgggatagaattatgggaaatatgctgtaa

SEQ ID NO: 68 - DNA, 1011 bp, Candida albicans
caaactatggattctcctatacacattggtgacttgacaacacagtcaattcaacaaaaattattcgagacccatataaataacaacaataagaacaagaccattaacaacaattgtgctttattgtcgacaatttattcgtccatatactctggtgtaaaaactattcagttaacaatgaaactagattctgacaaaaacaacaacaacaacaacaacaacaatgatctcaaatttgacaacaaaagtcatggtgaaattatagttttgagaagagtacaagactcgtttgttaatgttacccagttatttcaaattttaattaaattagaagtattaccaaccagccaagttgacaattattttgacaatgagatattatcaaatttaaaatattttgggtcatccagcaatacccctcaatatttggatttaaggaaacaccaaaacatctatcttcagggaatatggataccatatgataaagctgtaaatttggctttgaagtttgatatttatgagatcaccaagaaattgtttttggtcgatgtacatgatttcgacaagttacccaaagcaaacaaaagattgtacgaggaagatgccaacagcgatagtgatatattggactctccctccaaaaaacaaaagttggataaaaagtctaaaaaagatttactttccaatggcaaagcaataaccaaaaaactcatagcatcgtcggtatcacagaattcaaactacccattcacgttgcctgctgtaatcattgataatagcaattcagaaattgcgaatgacatccaaattaaattgggaaatgtgtccaaacgtgatgaagaaaaacccgatgggatttcgttcgaaaacgtgaaactggcatttgcagacgccttgtcaaggtatacacccgagaaaaatatcgacattcccttgggattggaaggttcaacggcattgcttttggcttccgacataaactccctgaacctaagggtcctcccttattga

SEQ ID NO: 69 - DNA, 1248 bp, Candida albicans
actttgaaacaatcactagaccaattttctattgagaaccaactgatgtttaataacaaccacagttttatcaagacaataatccacaccaacttggaaaaagtacagacattccaacagttatatacacaaagagtcaacaaattggaacaccatatgggaaggttactaataaagaggcaacaggctttgaaagaattggaatattacaaatcaagataccaagaagaatgcacccaattaagatcattgcgactactgctccaaacgacatggggtcgagaattagagaaaaaccaactgaaatttaacaaaataaatagccaaataaacctgacacggaaacactatcatatggcattagtaaattacaaagaaataaacgaaatctacaagcgagattggagtatatcgttaaatgatttctataaactagaagtcgagagaatacaagtcacaaaaatcaattgtttcaattactgtaataatattgccacattatgtgtcgaccaggatctggcagtggatcttgcaagaccaatgtttgcccagatacaacctataacagatcttgaagagttcagtggcaattatggtacgggcaacaagattttcaatgaccctgaatttgtggattatatgacaggctgtgaggaacctagagtagggtacacattactgaattttccaaatccagactgctcaaatatacttaccagaacatattcaacatacaccggaaatgggaatacatcaaaacaagtggaacaaaagagaagtgacgataaattaaacgataacatttttacacaaccacatgcagttcagtatgaccccaaccgtgttcatgctcctatcaaagaaatgtcgaagctaccgatacccaaattaccacctacaaataacagaacgaaaacaccgtcgccaactcggaaaccaccttccgactatcattccaactattcagatgatatattttccaaggatgaaagattacaatccagcaatggctcttcagattatagttcggaaagaaattgggcatcacccaggaaaagagaaaaacaacttcaagaagtccaagagaaaataagtcgaagagcaacaaacgatttcaaaaatatacccaagataccagagcctgaaaaggttcctgtgataaaggatttttcaatagattttattgccaaagctctcgaggatctaaatgcaggtggtatcttcaccacggggtggaaggaccacgct

SEQ ID NO: 70 - DNA, 1128 bp, Candida albicans
ccaactttgagtacatttaataatttgataaataattccttgaaacgtgatattttgagcaatgttccctttgaagtgacaatgaaaatattatcttaccttgattataagacgttattgtcagtggcacaggtgtgtaagaaatggtttgacattatcaacaaccctgatacttggattaaattattgaaaagggataaattgattactgatgacgctgtaattaaatatgaattgcaatatccggatcaattattacgtgaatggtccacgttaccagaaatcaattcagcacaagttttatacaagaaaagaaaaataattgtcaataggtggatggatccaaagttcaaaccccatagaattagtgtatcagggcatggaaataaagttgttacttgcttgcaacatgatgatgaaaaagttgttacaggtgtcgatgataaatgcatactaatatatagtactcaaactgggcaattgatgaaagttttagaaggccatgaaggaggagtatgggcattgaaatacactggtaatacgttggtaactggatcaactgatcgtacagttagagtatggaatatgaaaaccgggcaatgtactcatatttttagaggacacacttcgacaattcggtgtttggacataatccaccctgcagtgatagggaaaaatcaagatggagaagacatcgtgtttcctgaatatccgttattaattacagggtctcgtgatcacaacattcatgtgtggaaattaccagtagttgatgatctgcaggattatatagagacatttgaaggtgaattcgataatccttatttgattgctgtgttgtctggccatactcaatcagttcgttcaatttcaggatatggtaatattataatttctggatcttatgattctacagttagagtatgggatttactagatgacggtcattgtacacatgttttacaaggtcatcttgatagagtatactccactgcaatagatttccattcgaaaacatgtttctcagggtcaatggattccaacattaatgtttggaattttgaaactggtgagttgacgaacgtattagtggtgcattattcaggcccggcggctggtcggtaccgc

SEQ ID NO: 71 - DNA, 213 bp, Candida albicans
cgtgttgttagtggaagtgagaaaatgttgaaattatggaatgttgaaaaaggaacttttgctcgtgatttgttaagtgatgtaactggtggtatatggcaagttagatttgattacaaaagatgtgtcgcagctgttcaaagaattattaatgaagatgaaggtgaaacgtttattgagattctagatttcagtcaaccacttttacagtga

SEQ ID NO: 72 - DNA, 651 bp, Candida albicans
  unsure (594): Identity of nucleotide sequences at the above locations are unknown.
tttcgttttattttaacccattacatggataagaaatcaaagctattcaaatatcctttgagcgaggagacggctaaatttgagtacagactattgaacccaaatgggaagttatctgatatttggttgcatgaagagtatcaaaaactatccctttcggcaatagataaagtatctcagcaaccttcggcagtgactacggcaccaagtcaaccccatcgggagaatagtcgaaaacgaaatgctggtgacgatgatgtctatgatcaaaaaaacatgccctcatgtgacgacacagcttcatcagacacggactgccaaagtcaagtctcatcaacagctcatttgcattcatatcgatcaaatggattagttgagcctccttcgaaaagaagattaacgacgaccaacgaaacgtctttatcaagcgcaggtgcaactactttccaaattgaatctcccggtagtatatctgctattactacaaataattcaactacatctgctggtgattccaacaactcgaattccttttctgaccagcattcacgacatccaaggactccaaatgttatgaattctcctactcatacnccaatatcggatattgaagaagattctattcaacaattaccgtttaccttcacctag

SEQ ID NO: 73 - DNA, 1638 bp, Candida albicans
gcatccgccattaccaaaaaatatgtctactcttgcaaaagacttctattggaatgttttcaaaagcaagccaatcttagaataagtgcaaaattgcttttgaaacataaatggttaaaccaaactgcaacagcaaagacttcgatggccaccttattgagacaacctagcagagagttgaggtcaatcaagatttattctgaatcaaatgatgaaaattgggatgaagattttgaggagatcaaagtgtctaagtttcaaaactcgacatcttctataatagaattgaaaccagataatacagagaaacagtttaaactcacggagtattccaaaaaggatttattaactttgtttgctgacaataaggaagatactctgaacaattttgaatttgaaactatcggtccaaataaactagcagtggttgcagaaagtatggatgaatccgaccccttcttaaatatagacattgagaactttgatacaaacgaattagaagtacaaagcaaaatggaatatttggtagtaaggttaagtcgcaagttagagcaagttcatctaggatacgaagatgcagtaccagcattagtaaaagttacaggaagaatgctacatcttgttaagaaatatccggtactgcatgataccttgattcgagaccatggagttttgtcattgttggaactcctagagagttttcaagatattccaagccaacaacagctatggtatcattgtctttctatattgaaccatgttttcgaaagcgacttaggcacgctcgagaacttttgtttcttgggaggcatacccactgtagcgcatttccgaagtgcgacctatgaagtacaagtacggttgcaagttgctaaatttattggcattttgaatttatcagaaaaggccttgtctatgtttgtttcttgtgggggactccgtctagtaagtaaatttgtggaagaagattttgataccactcctacattcccattgattgcaatagagtctattcacaacatattagccaaagatttaagtagatcgaaatctgatttgtgccgtattctatcaaagcatggtgtgattttctggttagtggttttgttgaacagattggtcaaatatgatcaaaagcccctgataaaaaacgtgtctaaagaacaagttgaaataacaatagaacgaattattgatataatcaaatacttcagtcaatctgagactaaagttagaatttctattgggtcgatagacttgttcaaattgatattcaaattatttgacaatttaaaattgtctcaccagttgactttgctcaagtttgtgaaatccatgtcttgcatatcagaagtgttgaagaatttatatcatgccgagatcttggagtttttggtcaagttgttaaaaagctacatcccctccaaaggcaattacaaagagattattaatgttctagctccaatattgtataatagccttgctttgaatcatagaagggagtcagagtttgtcaatttaggtggattaccttacttgaaaaccttgtctataattaacttaccattcagacagtttattttgccgataatatgtgaatttgtacattgtgatgctagtgtcgtaaacgaattataa

SEQ ID NO: 74 - DNA, 678 bp, Candida albicans
acccaattaacatcaatattagattcatcaatattattatcaacaccaataactagttttaaatcaattcaagaatcaattttttattttcttcataatattgaattatataatggtggggttaatcatacaccaccgattttaatagttttattatcatttttaggtaatatcaacactagtgttaatggatggaataaaattgggtatgatttattatatactgtgattgatttgataattgcttataaaattattataattaatcgatggtataataattatcgacaacaaaagagaaacaccaacaataagaagaaagaaggagtagaagaagaggaagaggaggaggggacttctgggaaattcgatgattacttgattggttgtttttatttatttaatccattgattattttaactaatttaagtcattccagtattatattcagttggatttttattatgcgaagtattatacaaattgttcaatatgaaaacattgctagatctatgatctccttagctattgctagttatctttcttttagtcccatttatttattacctagtatattagcattaggacatgtcattattagagataaagctatctcggccaagcaacaacaagaaaagaaagagtctgcaccgccggctggaaaatccgatcgtggg

SEQ ID NO: 75 - DNA, 465 bp, Candida albicans
gtttacacttggattttcatattaccattcacaattcgatttttccaatacaaaaacaacaaaattacatctttacttggtgattcatttttagcagtgattttatgtctttgttggatttcatttattaaaccatatcctattcttggtgatttaggcatagtattatcattattaccgattttaaatgatactattgttcaatattgtaaattaaaatatatcactgggatgacattaattattggattattattggcaccaatattttattatatttggattgttttaggtactggtaatgctaatttcttttatagtattactttgatttggggtgctatacatggattgattttaatggatttgatttggacaaaattaacattggattattataatgataatggaattgatattaatggagaaggtggtattcttggtcttagtttagctcaaatatag

SEQ ID NO: 76 - DNA, 255 bp, Candida albicans
actttcaatacaattcctccttttgataaaccctattggacatttttaacaaatttgtggccttactcaaggctggaaacaaggtccgttatgtcctccaactactatggagctcctgacgatgaagaaactggaatgccagcattcatgttggatactcgtcctgctttggataatctcactaacgcccgtgacagattcactcattgggcatatcctctttggaagaaagctatgggcgaagtcagagattag

SEQ ID NO: 77 - DNA, 369 bp, Candida albicans
tatgtacgtgaagggcgacatccgtccagccccgaggtgaagattaacaatcaacctttcccatacaatatccgtaatttggaagacccaaagaagtccagaggtggtttagctgaaccagttaatcataaaatcttattgccttacgatgttgttgttgaaaaggaaggagaatacgttgctcaattcttcaccacttttggaataaccaaacacggaattgttaaatataccagtcctgagtttgatgccgatttttacaaatcagacaagctgattaaagacgaagagattttgaaaaccttggaagaacctttgaatacaaaaccagttaaaaagaagggtactactgccactgagcaaaattag

SEQ ID NO: 78 - DNA, 483 bp, Candida albicans
acttttgtccttctagggcgtgttgaagattgtaccaaaggtgacgaattgatgaatgaagaattatccaagatttacaattccaaaaaaaccaaaaacactccaaaggggattgcctttccaacttgtgtaaacccaaaccacatccctgctcatttggctcctgttaatgctgaagacgaggccaacattactttacacaatggtgatgttgtaaatatcatgttgggaattcaaattgatggatttccatcaattgttgctgaaactttagtgattggtgcctctaaggaatctccagtcaccgataaaagagcagacttattgaacgctgcctggacagcatctgaagccgctttaagaacttttaaaccaagcaatagaaactgggacgtcacaaatgttgtttccaaagtcgctaaggaatacgagaccgtcccattggaaaatatgttatctcacaatcaagaaagattggtttta

SEQ ID NO: 79 - DNA, 366 bp, Candida albicans
tcaaacaatcaatcaaatgcagaaagacgcaactcatttgaggaggaggatgctttgcatgatcattatcatgaatattcggtgtctctagtgcaacacgaaaagaataaacaagaaatctctatggtagagatcgaaaggttgaaaaaagccaattctgagtatagggatctgattgaaaagctcaaggaaatttttgatctccatgatcagaaaatttatctacaagcagaagctttttatctgcttatgaaaactgtattggaactagttgatgaaaaatatcaattgaaaatagagagaaataaattaaggaaggagttggtacatgctcaagctagattgattgaattcaaagatgaataa

SEQ ID NO: 80 - DNA, 672 bp, Candida albicans
gagcctaccacagagtctcagatttctaataccaccaatacttcttctgctgcaccccatgatacagccactatcaaaaccgaagaaacaatcgagaagttagaatcagaaattgataaggcatatgtattagttgaacataaatttcaagaattatgggaaaatgcatcgaaaaacgccgaaaagtatcacttggaggaatataaacaaaattttatcgaacaattgaatactacgaaacaatcgttaaatgaaaagacttcagaattacacgttcaggaaagtttaaaatcaattgaagatcaattgaagaaaatcaaattacaagatatttccactcaagcaaattctgctttagatgtattagattctaaattggaagttgttgaaagagaagctggtaaatattttggtaatttcacgacgtttttatctaatattgtatctatttcaccaggcgacgacagtaccaacaacaacaacaatgctaaccaaaaaacaaaagaagtgttgttcaactcctctttgaatcaatataataactacgggacaacacgttatgatactgatttattgaaattacatactactgaagaattttaccttagtgatgaattagatgatgaaaatgagattaagaatcttcaccacgcggtggaaggaccgcacttg

SEQ ID NO: 81 - DNA, 1392 bp, Candida albicans
  unsure (1326): Identity of nucleotide sequences at the above locations are unknown.
caaaacaagccaaaaagaaataaaagtatcatgttgtcttttaaatcattattagctgctgcagttgtagcatcgtcagctttggccagtgcctccaatcaagttgctctttactggggtcaaaatggtgctggtggtcaagaaagattggcacaatactgtcaggaagctgacgttgacatcattttattatcattcttgaacttgtttccagatccattaaacgttaattttgccaaccaatgtggtaacacttttgaatctggtttgttacactgttctcaaattggtgctgacattaaaacttgtcaatcattaggtaaaaccgtgttattatctttaggtggtggtgttggtgactatggtttcagcgatgttgcttctgccactaaattcgcagacaccttgtggaacaaattcggtgctggtgaagatccagaaagaccatttgatgacgctgttgttgatggtttcgattttgacattgaacacggtggtgctactgggtaccctgaattggccactgccttaagaggcaagttcgccaaagacacttccaaaaactatttcttatctgctgctccacaatgtccataccctgatgcatctcttggtgatttattatccaaagtcccacttgattttgcattcatccaattctacaacaactattgttcaatcaatggccaattcaactatgatacctggtccaaatttgctgactctgctccaaacaaaaacatcaaattatttgttggtgttcctgctactagtaatattgctggttacgttgacaccagtaaattatcctcagctattgaagaaatcaaatgtgactcacactttgctggtgtctccctttgggatgcttctggggcttggttgaacaccgatgagaaaggtgaaaactttgttgtccaagtcaagaatgttttaaaccaaaatgcttgtgttgccccatcttcttctgctactacacaatctaccactactacttcctctgctgttacccaatctaccaccactacttctgctgctattacccaatctgccaccactacttctgctgctgttgccactaaatctaaccagattgtcacttcatcttcctcctcctcttcttcaatcttctacggtaattcaacaaccgaatcttcaactggaattgctactggtaccgttctcccaactggttctaacgaaaatgctgccaccactggttcaggttctaacaccaaacttgccatttcaaccgtcactgatgtccaaaaaactgttatcaccattacctcatgttctgaacacaaatgtgttgccactccagtnactactggtgttgttgtcgtaactgacatcgatactgtttacaccaccctattgtcctttgactaa

SEQ ID NO: 82 - DNA, 771 bp, Candida albicans
atcttcaccaggaagaagaaacaacttcttcttctaccaccactaccaccactactacttcaacaacaatttctagtatttcttccagcagtaaaactagtaaaactaatactactaatactactagtttcttccatcagttctaccaccagttctaccactagttccacaagcagttcttccaccagttcttccaccagttcaaccacttcttcatctaccacctcatcacaaatttctactacctccacagcaccaacttcgtcgacaagtttatcttcttcaacaataagtaccagtgcttccactagtgataccactagtgttacatccagcgagacaaccccagttgttacaccatcttctttgtcaagtgctattaccattccaggtgattcaactaccactggtatttccaaatccagttcaactaaacctgccacttctaccaccagtgccttatcatctctgactactactgttgctactattccagatgacaaagaaattattaataccccaactgatactgaaactacatcaaaaccacctgctatcatcactgaatcagatgctactactatcactcaaaatttaactccatcaactacaacaaaaaatgtaaagacaacatcaacaaacattgtaacggaatgggtatgggctccaactactcttcgcacccttacaacgacttatcaaatattgacaactagaacacatattgaaacagtttttgctgaaccaagtacagtggttatctataattag

SEQ ID NO: 83 - DNA, 393 bp, Candida albicans
attggtgatacaaatatagatgaagattaccttgagacattatataatatcaggtcaaagagatcaaacaaaaaagtggctttgggccattctgaaaagacgcctcttgatggtgatgattatgcaaaagacgttcgtactagagttgtgttgttttggatgattgcaaatttggtatttataatgaccatggtacaagtttacgagccaggtgataccggaagaaacatttatttggcctttattttgtgggcagtggcagtgttggctcttgtcagagctattggctctcttggatacttgatacaaacatatgcacggttttttgtggaatcgaagagtaaatggatgaaacgaggatataccgcgccgagtcacaatccattaaattag

SEQ ID NO: 84 - DNA, 858 bp, Candida albicans
ttcatttttataaagtatggacaagttctcattcatttggtagaaatattttcttacacattgaattttaccatcatattaattaatcatattgagtcttggttttccattggttcatattttttggtgtttaggatattgacaacttctttaggagataaggctttgggttttgctccggttaagattttatcggtgatatttctttggttatatcttgcatctattgtaactacatttgttttaagttttgttaatatacctaaaggtacagaaaaattttatgtcacgattgttattttctttgccatattgatggcatatatgatatttgctgctattttcatggctgtacattctattcaagatatttatcgatcaggaacaagaataaccgtttcattatttttccaaaattcagaatttagagatttggtggtggcaacttcatcaacttatgcattatatttccttgcatcatttttatattttgaaccttggcatatgtttacatcttttgttcaatatattttgctttcaccatcttatgtcaatgtccttaatatttatgcattttgtaatattgatgatatttcctggggtactaaaggtgaagttggtggtaaatcattgggtgaagctaaattaagagaagatggtacattcgatgttagtgttcctatttccaaagaacaaatcaatcaatcttatcttgatcaattggaaaaaattagagatccagcacctccagaagagaaagtgcttgttactaataccgaagattattatgctttcattagatccatgacagttttggtatggatgtttacaaattttcttgtcattgccttgttttag

SEQ ID NO: 85 - DNA, 405 bp, Candida albicans
  unsure (302): Identity of nucleotide sequences at the above locations are unknown.
tcttcttcttctacatttattccatattcaatatcattcactatgtctaattttagagatagttctagtcctcgaagaggctattcagaatttgatcctgaatctggtgaaggtttaggaagaaagaaatcattaattagaccagaaagatcaagaatggatgaaagccatccacgattccattatactcaagttgcaaatcaagaatctaatcatattaaagtacaaccatcttcaactggtgttgatcctcgtaaatcaaatgaattatcaacatcaagatcacatttgagtaattacgntactccaccacatcaagaggaagaagaagacgaagggatccctttaatggatatacacaatgttttcaccccaatgttagcagtgaccaaaataatgatctaa

SEQ ID NO: 86 - DNA, 351 bp, Candida albicans
gaagactaccattttacaattttcaattcaaatattttcccaatgactaaaccaagatttttaacagatatagaaagagcaaaagtgttggaatttcaagatatgatccattacagtcccagatacagtgatgattcatacgagtatagacatgtgatgttacccaagaatatgttgaaagcaattcctcacgattactttaatcaagaaacaggtactttgaggatattgacagaagaagaatggagagggttaggaatcacacaatctttgggttgggcccattacgaaactcatgctccagagcctcatatattattattcaagagacccttaaatcccgggcaataa

SEQ ID NO: 87 - DNA, 276 bp, Candida albicans
attcagcacgaggggccaacagaaacccattggacaaccgggcaggcccccccggccccaattaacccgtgccccggggccggttccgaggacccggaagggagggtttgggggccaacaccggcacaggcgcagggcagtaagggcgcaatgcgggcgggcgggcaactgggaaaggaggtacccaagggcgcattggaccaggatggggttagacttcaagcaccgggggcagagggaaggggcttggcccgttgttctgcaaaggaagactga

SEQ ID NO: 88 - DNA, 1377 bp, Candida albicans
agacataatagagatggaaactcgactgctttaaataatggatcatatgattcagctatatcttcatctccggtctcatctatatctcaatcatcggatacttctggtgtcagttcacgagaaagtccccagcctgttaagtatagcgcttcacaaattaaacaagaaaaactattcgaaaatggggttgacattgatgacacagatttgaatttacagtccacacctgttttatgtgacgggggtatatcaacaccgcctagatatcctccgaaaagacaaaagttaaatgaatataccaccacctctggtccaacaagatcaacattcaattctaattttcaattaccaaatgacattttgaagaacttgactccagtaagcaacacaaccgtatcacgcgataattcaatacccactttacgtaaacaggaaatcttgcagaatattcaaatcaagttactggagaaatcaagtagaatatctcggaaattactggaccttcatagaaaacgacaattgaaccaagaattaaggttgaaaaaattgaatgatgaattacagctggctaatattagacgtaatcaatacttgaatatggttagacagcgagctgcaaaattctatcgagatgttggtgataccgataacaggggtgctagaatcatcattcagaaatcacaaagaacaaatatcatgtctattgggggttccactaatcggaaccatcgctatatgcctaaatcgtttgatattaatttatttgtccctttacaaaagttggtacaaagatttttatttcacaagtatgtaaagttgattgcaaactcacaattcttggataactttcaaatatattcatttaatcgagtattaaaattttccaatagtgataatgatttaaaaactgggattcattttatattgaaatatttacgagtgcctcatttgttgggatcggaatacaagtcatttttttattgttttataatgattgccgatttcaattcttgtatgaatcacgatggtaataatttggggaatagtctaagtatcaattataatcatccggggtttaatgtaaacaccgatacaaaagatgaaaaagagatgttttttcataattgtatttggttgattgttttcaaatttggtcagtacttggtggatgaatttaagaccattatccagaaaaaatcattaacggaacagtttttgaaatactgggatgagtataatttcattttcaaaattttcaaatggaatcattacaatagcttgaaaagcttgttaattagttcgataaatattattgataaacaaattaatgccttatctcacttgaaaaatgatattctggttgcagatttaaaataa

SEQ ID NO: 89 - DNA, 582 bp, Candida albicans
cggcaggcgatcatcaattattaccatacgtcaaaacatagtgggtttaattataaagatttccgaggtttgaaccatcattatttatcatcagcttttttgataacactagaagtgccttgcacaattaaggaacccccatctagcatattagtatttggagattttgaaagtgatttaaccagtaaattgtcccgcaacttatttatatggaagagtatagcaccgttaatattgagaaaccaattgaaagcaatcgtgttggagtgttctaattgtaaagagatagctgccaacgaattatatggtcatttgacaccaaaattgttaatttatgaattgaaacaattggcgcatgaatgtaaacaattagacaccgccaccaccagtactgaacaaccattattagggttgaatgtcattgtaaatcatgtcaaggaacccattgccgatccaaatcaggaaagtcaattacatgatcctcgaaaaagaattttagctgaattgaataaattaaatgagatagaaaaattaggatgtaatatttcaattgcccttagtggcacctcaattatagtatag

SEQ ID NO: 90 - DNA, 918 bp, Candida albicans
atggctgaatttagcgatgctgagctcagaaagatgatgggtacactttcactcttggtacaagattccaggagagaaattaaccacttgcatgataagttggagaacaatagtgactcaaaatatcaatctttagaaacgtacatcaactcaaagtatgcagatactataaaatcatttgaaaaattaaaatatttggacattgataattcagagttggttaatacctggatcatgtgttttaatcaggttaaaaggtttcaccctcaggtttttgatgctttcatggaggcagagaacgaggacgaaattggaatcgaaaagatccaatatacgccatacacaggtaaacacttgaatgatatgatcagaatcttctacatgaagatatccgaattaatagaaagaaaagttagtccaaatgtttctagagagatgaatgatggacagccacaatttgttccgaatttgtttaaaaaagtttacgagatgattatttcaaaaccagatgtttctgctgctgaaagaattggaaaagctcttttcaagttacaatctaaactgagagaacttgaaagagaatcagcatttttgttatgtcaacatttaatgaccaatgaccaccagcacgatgatattattcttaaatttctcgttagcggtgtctcaccatggtacttacatctgcaaatttacatgctgtcatataaacttggattctcaaatttgtttttagagatttatgctcaacattatgaattgtataaagcagatcccatttacaaattgccagatagtatgacattgttgaatgaaataagatcaaatagagattatcctaaagtggtaaatgctgcaaaaaatacagtacaagtcaataatgtttcatccaagaacaataaaaagaaggatgaatga

SEQ ID NO: 91 - DNA, 192 bp, Candida albicans
gattataaacatatttgttatccacctctatcatcaattagtgcacattcaggaccttcagtagacttagccatatttgctattcatcttacaagtatctcctcattattaggtgcaattaactttatagttacaacacttaatatgcgtagtataggaattcatatgatagacatgcctttatttgtatga

SEQ ID NO: 92 - DNA, 363 bp, Candida albicans
aaatatgaatattccgattttgttgactctataggtgagacaatcgaattcgagtcatatgttatccctgatgacatgttagagcctggtgctttacgtctattagatacagatacttctattgttgtacctgttgatacacatatccgttttgttgttactgctaatgatgttatacattcatttactattccttcattaggtatgaaaatagatgctactccaggtcgtcttaaccaagttagtgctctaatccaacgtactggtgtttactatggtcaatgtagtgaattatgtggggttaaccacggtatgatgcctatcaaattagaatgtgtaagtattgaagacttcattgaatga

SEQ ID NO: 93 - DNA, 192 bp, Candida albicans
ggtataagattacaagattcagcaacacctaatgctgaaggtatacatgaattatatgaccatattatgttctacctatgtttaatattaggtttagtatcatatatcttatatgtaataattaaagattataaagataatagatttgcatataaatatgtacgtcatggacaagttatagaaataatatga

SEQ ID NO: 94 - DNA, 1170 bp, Candida albicans
ccaaacaaaatgtccccctcgcttgttcaccaaattcttgctatcactcatccatatgttgaatatttggaagaaaacattactaaatggtatatcctagtaccaggtattcttattgtgttaaatgtgttaacaactcttcatacaaagtatttggaatacaaatttaatgcaaagcctgtcacaaacttcattcaggattacacttttggtgtcataactccattgattttgatctactacaagtctcaaggtacagtaatggaattcgccaataatttttggaacttcaaatttctcatcaaaataccaaatgtaggaacacgtgagcttacaatatttggtatgcatttaattgagaacccaaggaacccgggggaatatcaaggggggtattgggtaacccaatttaaccatttctctttgggcactcgtcatggctttttgtactcattgttaggtgatggtatttttacattggacggtgctggctggaaacatagtagatctatgttgagaccacaatttgctagagaacaaatcgctcatgtcaaaatcttggaaccacatatgcaagtgtttttcaaacacattagaaagaacaaggggaaaacatttgacatccaggagttattttttagattgacagttgattcttctacagaatttttgtttggtagttcagttgagtctttgagagatgaaaccatcggcatgtcacctagtgtgaagaatcttgctggccgagatgaatttgctgatgcatttaattattcacaaactatcaatgcctacagattcttgttgcaacaattttattggttgtgcaatgggactaagtttagaaagtcaattgctgctgtgcacaagttttctgatttttatgttcaaaaggctttgagtttaagccaagatgaattagatgaacaaaaagggtatgttttcttgtatgagttagccaaacaaacccgtgatccaaaagtgttaagagatcagttattgaacattttagtggctggaagagacacaactgctggtttgttgtcatttgtgttttttgaattggccagaaacccagaagtatatgccaagttgaaagaagaaatctacaataagttcgggtccggcgaggatgctcgtattgatgaaatcacatttgagtctttataa

SEQ ID NO: 95 - DNA, 309 bp, Candida albicans
caaataaaaattaccacctcaatgtcctcaactacattcaacgatattatcgatagtgttcttccgtacttgaccaaatggtacaccattttaattggtgctgggttaatattcgttttatcaaccaaccttaagaacgcttactacagttataaattgggatgtaaaaacccagtacacttgaaaagagctggctggaccggtataccagctttgattgatgctattaaagctaaaaactctggtaaattagctgaatttggtggtgatacttttgatgaactcaactccaaaaatttctatttgaat

SEQ ID NO: 96 - DNA, 717 bp, Candida albicans
attccactgaagaagaaatcgaagaaaaatctcaaaggtggttacgttttcctttatgaattggttaaacaaaccaagaatccaaaagttttacaagatcaattattgaacattatggttgctggaagagatactactgctgggttattgtcatttgccatgtttgaattagccagaaatccaaaagtttggaacaaattgagagaagaaattgaagccaattttggtgttggtgaagaagctcgtgttgaagacattacttttgaaaacttgaagaaatgtgaatacttgaaagctattttgaacgaaactttaagattatacccatcagtcccaattaatttcagaacttcaaccaaagacactactttaccaaccggtggtggtccaaatggtacttctccaattttcgttcctaaaggttctactgttgcttacactgttttcaagactcatagattagaggaatattatggtaaagattctcatgattttagaccagacagatggtttgaacctctgaccaagaaattgggatgggcttacttgccattcaatggtggtccaagaatttgtttgggtcaacaatttgctttaactgaagcttcttatgttattagtagattggcacaattgttcccagtgttggaatcaagagatgaacaataccctccaaatagactattcaattcgcctttcacagccatggcgatcatt

SEQ ID NO: 97 - DNA, 1998 bp, Candida albicans
tataactgcctaatacactctttcgccatgtcaattactaaaacatacaatggtgatcctacatcacttgtaccaactcaactggtaaaagaatcattaagactaattgaagatttaaaattctttgtagccactgctccagcaaattggcaagagaatcaagtgattcgaagatactatttaaaccacgatgaaggttttgtcagttgtgtttattggaataacttatattttatcactggtaccgatattgtccgttgtattgtttataaatttgaacattttggaaggaaaataattgatcggaaaaagtttgaacaaggtattttctccgatttaataaatctgaaatgtggcgccgatgcaattttggaacctcctcgttcagagtttttagaattcttatttaaaaattcttgtttgagaacacaaaagaaacaaaaagtgtttttttggtttaatgttcctcatgataagttaatggcagatgccttggaacgagatttgaaaaaggaaaaaatgggtcaaagaccaacaacaatggcccatcgagaaccagcattatcattccattacgacgagtcttccagtttatacactcaattgggtaaacacatggaaacacagaagaggatcaacgacgcagccacaagctctacttctaatactgctaccaccttgaccgacaccggtgtatcctcaggattgaataataccacttctggtggcggcagtgatagtgcaacctccacacacaacaacaatgaggcatcgaccaaaccaagtaatggcagtgaaaaatcgtcaccggagtacactacaactgcccgcggtagagatgagtttggattccttaatgaagccacaccaagtcaatacaaagccaattcagattatgaagacgatttcccattggattatatcaatcagaccactcaaaattctgaagattatattactttggatgcaaattatcagacaggaagtaaaacaaatatgatggaagacaattacgattcatttttggatgcaacactatttatacctccaagtcttggcgtacctacaggtacagctgcgactgcaacaacatcaaaccaagttgccttcaacgacgaatacttgattgaacaagcccaaccaataagaactccactacccccaatatcatcatcaacaatatccggattattacaaccaaaatcagctgctaaattcttttcactacagagtgctaatggtggagaagaatttttccctgcttatcaaaatgacccatctactgctaatgccgggtttgtgccgccaatttcagcaaaatatgcaactcaatttgctactcgacaagtcgccaccccaacctatataaaggcaataccacaaactggtgctgctgctgccactggtaatggtggtcaaccacaacaatattatgaccaggcaactggtaatgctttttacccagcagaaataccggtgctgtacaatgttgtccatcctgaaagtgaatattggaccaataattctggtgcagttgctactactgctgctgccgctgctccaatgtatgacgcttctgggtttcctatacctattaaccaatcatatatggtaatgaatgaacacgaaatggtaccttatcaatacatgaattccaatggtgctatgattggcatgattccacctcaccaacaacaacagcaacaacaacaacaaattgccatgggatatcaaagcatgttgagacaacaacaacaacaacagcagcagcagcagcaacaacaaccttcttctacaatgactaaaaagaaaaagcaaatccattcgttcaataataacaagagtttatcatctaatggcggtggcattaccaagaaatcacacgataataataatcatagtaaagttaaaactctgtacggatcattaaatgatgttgtgaattccaaagtcaccaaagtgatcaataaagaagaagtaaaacagtcacaaacatag

SEQ ID NO: 98 - DNA, 330 bp, Candida albicans
cacgacacaacaaacttgcaccacctttccaaccttgcgttcagaatgacacccgtgaaaacccacatccaagaagattccgacttggactatgtgaaacacaaattgaaaagatcacggccaaatagtcctggtccatccacccttcctagttcgccggtgttggggttgtcgaccaatactaccccgctgatatctgccagcaatagcagtaccaacctctcgtcactaggtatgatcgcctccttcaaaccttcaatgctacattcccaatcaagcgatgccttgccttcaataaaaagtttaaacttacctgaatttaataaatag

SEQ ID NO: 99 - DNA, 1029 bp, Candida albicans
aatatgacacccaacggcagtaggagacattcggcgtacatggggtcgcccagaagccagcatagttccacaatggaaacaggttacaatccttacgaagcagtgcagaagaaacaggaattataccaaaataacaacggcaattcaccaaccgtcatcattgaagaagatccatacatcccaaattataaagagctgtctctagcaaataagaaaacaaattataacatgaaaattgtcgttgtcggtgacggtgggtgtggtaagacgtgtttattattagcatacacacaaaacaaatttccttcaatctatgttcccacagtttttgagaattatgtgacggcagtacagtcgcctaatggtaaaaccgtggaattggctctctgggatactgctggccaagaagaatacgataggttacgaccactaagctatcctgacgttgatattttattggtgtgttttgccgtggacaatgaagttagtttggagaatgtcaaggatatgtggttccccgaagtgaatcattattgtcctggtattcccattattttggttggtaccaagagtgatttactgtctgatatgaatcacgatgcatctatacgagtagccaaagaaattggcgccattggattgattttcacatcagccaagaccatgttcaatgtacggactgtttttaattttgcattaaaccattttcaaagaaatatggaattacaggaacaatatgaaaagacattgggttcaagaaagagaataagtagagtattgggtggtagtaatggaggcagtgggaaccattccagacatcattctagaaactactccaacgtttcgaacaacagaaggggccatttgaagaacacatcatacgattccacggcattgttggatcaaccgttgacagaagacacctatgtgaaaaatccttatgggaactttggctataaagcaaatgttgaaagtccgtataatcaggatgagtttgcatttacaagagaaagggaaagaagaagataa

SEQ ID NO: 100 - DNA, 324 bp, Candida albicans
gctgaatggcacaaacattacgaacaagttaaaggtgattggaacaaagctcttgatgatttatccacacaatggaatgacagtaagacacaattgaatggtagatttgatactgaaaaagatagagccattaaaggagttgaagatgctaagagtaattttgaaaaattgagtaatgatttagccaatgatgcttctaaaaaccaaaaattgaaagatgctcaagatcattttggaaagagtcttgagaatttgaaattatttggtgatgacgtctacaatgattttgctaaaagatttgacgatttgtttaaccgtaaataa

SEQ ID NO: 101 - DNA, 672 bp, Candida albicans
catatcatcatgtctgctggaaaatatttattaggtactgctgcccttgtcggtggggtttattattatgatcaatatgttcaaccaatcttaccaagacaacaacaccaggaattggcttatcaaacccaacgtgttgaaaacaagggttccgaattgaacaacaaattgaccaaaaaaattgaagaaggaaagaaatttgttaatgaaaagactgaatcagtcactaaacaagttaaaaactctgatgtttaccaaaaattacaatcaaataccgaagattacaaaaaacacgttgaagatgccgtagataacgataagaatgttttcgttgttggtattcaaaaatatattgattttgtcaatcaattaggtgaaggtaaagttcaaactggtactacacaatattcaactgtttctccaaatgttgaagtcaaagaaaaatcaatttttggtaattggtttgacaaaagtgacaataaagttgatcaattgaaaaatgacgccgataaaaaaatcaatgaagctaaagataaagctgaatctaccaaatctgatttcttcaattggaattccaaaaaagctgatgaattagacaaaaaagccaatgaagccatcaattggactaataagcaaattgattatgcttcagctgaatggcacaaacattac

SEQ ID NO: 102 - DNA, 441 bp, Candida albicans
aataattatggtgttacactagtttatttggtaaacacgaaaagtatttatcggtgtagatttttcagacgcgttttggcaaacattcttcttactaaaaaaacaaacctttctcccatcacgtctttatccatttttaatccaatgccaactgccaccattgattgttcatctgctcaagatatactaaacaacccttcaaccaatgataatgatttgatatttacaccttatggtctaatgttattagaaatacagggagaattaaatctacctaatgagttcccacaaggtcaacctaaaactgatgaagatcatgaatatttaaataattttattacgattaatgaaattcaacatgctgtaaaatttgggaatttagtgtttgatgaacaagataacagtaattttcaacacgccctggaaggtccgcattggtta

SEQ ID NO: 103 - DNA, 741 bp, Candida albicans
aattattcacacacacacacatacaggaaaacaactataatggcttctaccatgacaagtcgagatagatttagaacagaaggaaccaccacattggatgacactaatcatttgttgtacgatttagaaagaaaattatcattaacttccaacacctcatctcaacaaacacacacatcatcagtagtacatagtagtcatttattgggactagggagacaaaatattcagagtcaagtattaaaccaaatcatgaacgacgaagagttgaataatcaagatgataaacaccaaagaatccataatagtattttcaaccccgatgagattttccaagagagacaaaataacaaatacatgacatctaaatttgccaagaattacaatgatgataatctaacgaaaaatcataaattgaatagaaagaattcgttaaatatatccaaatccagactagaacgaaattcatgtacttcagaagatatacagaataataaaccactaccaccagcaccacaactacaggagaataacgagtatgatattaacaaatcaataagtggaattcatgaagttgaagatccatcaatgtctgagtctgaagaagaattattagccaatcatcttcaaatgcctcaagaagtagaacattaccacaacagtaactacaactatcaagaagaaccaacgtatggattatcttatggtggagatgattatgacgattctgattctggttga

SEQ ID NO: 104 - DNA, 711 bp, Candida albicans
gatcactgctataatacttggttatttaccaaaatgtatactattatacaaaagattaagtggcccttagtattatgtgattttgttttcaaaaattttaatactaattaccggacattggagttattgaatttaaaagaatctagacttcgagaaattaggttcagtggaggtcatgttaaagagttgagtattgatttatttccagttagtgttgaaaatttaactttaatggaaatggggatccatgaactatctgcttcatttgaaagtttgaagaacttgtacaggttgtcactaatgggaaatcaattgagaaatgtaaattctgtcaaattgccagtatcatctttggaggttttaaacgtacgtcaatgtaaccttcgtttgatatcaccatttttggtttccatgcttgaggagaagaatcagaacgcaaatctaagagtagaggctacaggaaatttgaatgtgaatataaatgatgcgaggaaagtaatgaaagcaatcaaaggtctctcattagagctcaacagactcaatgattctatattgaaaatatctaaccattcttatcgtttggaagctgtatatcgtgattttgatccttattttgaaactccccaatcttctgagactgaagaggtggtctccgattatgattcagacgatctttacaatggaagtgtgttttatctggatgaaaattaa

SEQ ID NO: 105 - DNA, 777 bp, Candida albicans
tcttttccaggaagtagccaaacttccctccgaaatcactgctataatacttggttatttaccaaaatgtatactattatacaaaagattaagtggcccttagtattatgtgattttgttttcaaaaattttaatactaattaccggacattggagttattgaatttaaaagaatcgaaacttgaaaaaattagtatctgtggtggtggcatcaagaagttagatgttgatctattcccaatttctgttaaagatttagctttagtggaaatggggatccatgaactacctgcttcatttaaaagattgaataatttacgacagttgtcactaatgggaaatcaattgagaaatgtaaattctgtcaaattgccagtattatctttggatgttttaaacgtacgtcaatgtaaccttcgtttgatatcaccatttttggtttcaatgcttgaggagaagaatcagaacgcaaatctaagagtagaggctacaggaaatttgaatgtgaatataaatgatgtgaggaaagtattgaaagcaatcaaaggactctcattagagctcaacagactcaatgattctctattgaaaatatctaatcattcttatcgtttggaagctgtatatcgtgattttgatccttatttcgaaactccccaatcttcagaaaatgaagaggtagtctccgattatgattcagacgacctttacagtggaagtgtgttttatctggatgaggaagataatgcatataacaacaaaaaaagaaaggaatga

SEQ ID NO: 106 - DNA, 345 bp, Candida albicans
tacttattaccattctatgctatacttcgtagtatacctgataaattaggtggtgttatcgctatgttcggtgctatacttatattattaagtctaccttatactgatagatctattattagaggtaatagtttcaaagtattatctaaattagcattctacttatttgtatttaactttatcttattaggtaatttaggtcaattacatgtagaagtaccttatatacaattaggtcaatttgctacagcatattactttgctcattatataatagttgtaccagtaataagtacattagagaatatattatattatataggaacacagacaagagttaaataa

SEQ ID NO: 107 - DNA, 1194 bp, Candida albicans
aatagcgtaccactcaccaactacaggaacagaaaaatacttcaaaaaaatgttcaaccccaaactcaacacttcttcctaaacaaatccttaatcatgttgggcagaatagctaaacggtcgatctccattactaccaacacaccactcaaactccccttcatcccattagtcagtgaaacagggtttcctggggcaattggaaacacaccattattgaagttaccaaggatttccgaatcaataaatcgtaacatctatgccaaagcagaatttatgaatcctggtggatcaattaaagaccgtgctgctttgtacattatcaaagatgctgaggaaaaagggttgatcaaaccagggggtacaattgttgaaggaactgctgggaatacgggtattggattagctcacgtctgtcgagctcgtggatacaaatgcatcatttacatgccaaacactcaatcgcaaaacaaaattgaaacattgagattgttgggtgcagaagtccacccggtgccagctgttgcatttaccgatccagaaaactataaccaccaggctaaaagacacgcagaaagattagacaatgccgtatggactaatcagtttgacaacgtggccaatagacaagcccatatagaaactacaggaccagaaatctgggcacagttagacggtaaggttgatgcattcacctgctcaaccggaactggtggaacatttgctggtacaacgagatacttgaaggacatttccaatggcaaagtaaaagcagtgttggctgatcctccaggttcagtattatactcgtatatcaagtctggcggtaaagaaatgattagaggcggatcatcattcacagaagggattggtcaaggtagagttaccgataacttgcaaccagacttggagttggttgacgatgcagtcaagatccccgacgaagattcaatcgccatggtctaccgtttgttagacgaagaaggattgtatctcggtggtactggagcattaaatgtagctgctgcagtagaagtggctaaactgttgcctgaaggcagtaatgtcgttactgtattagctgacctggcccataaatacgccgataggatcttctccaaaaaatggttagcagaaaaaggattatacgatgctattccaccacacttgcaaaagtacgctgtattagattag

SEQ ID NO: 108 - DNA, 210 bp, Candida albicans
atatcaacaatgagttcaatacccaatatcaattggaatgaccctaacaatggtaaatccaatacctctcgtcaatcacaaccacaaccacagctaccaagtaatgtatctccccctaatagcagagcagttccaacgtcagggtcaataagcggacctcaatatgggagctcacaattttcaaatgaatatcctcgagatcctaattaa

SEQ ID NO: 109 - DNA, 621 bp, Candida albicans
cccggaagcgaatatgctgattccattactgttaatccccataaaatgttgggtattccaaacacttgttcatttttgttgttgcctcaagtggccaatttccaaactgccatgtcattgaaagctccttatttattccatggacgtgaactgggttctgatgaaaattatgatcttgctgatggtacaatggggtgtggtagaagaagtgatgccttcaaattttacttgggttggttatattatggtgaacaaggattcgccaaacgtgttgaacatgcttattctattatggaatattttgttcaatcaataagatcaaatcctaatttcgaaattgttggtcctcaatcacctcaatgtcttcaagtttgtttctattatcatccagcaactgtgaacaaatcaaatactgaaataacaagatatgtctcgagaaaattacataaattagggaaatatttagttgattttagtcctaatcctgttgatgatactcaaggtgaatttttccgtgtggtgttcaattctcctattttgagtgataaaattgttgacgaattgatcgcttcaataattagtgtgggcaaagaattagagtacacagggacggtgaggtga

SEQ ID NO: 110 - DNA, 555 bp, Candida albicans
  unsure (520),(533),(538): Identity of nucleotide sequences at the above locations are unknown.
gatgggatgggaggtttgccaaaaaaaaaaaaaaaacttttttgtatgtttactttgtggatatcctcccagagtacgagaatactttgcaaatactggattagtatctgctactgggataacttgtatatgataaaaggtgtttccttcttaggacaattaatgctcaagaggtcattcagtaaagttgcaaatacatcaaatagacttgtcaccacaacgaaaatgagtactgactatacaaattggtcaaaagaagatttgatttccaaaatcaatcaacttgaaagtaactcctttactactttcaatggggaaacctcatcccaaaggtcaatcaaaccagttaagaaacagaaaaagaaagagtttgattggagtaaacaaaacatgagatttgttgcctttaaatttgcttatttagggtggaattataatggattggcattacaattagaaccaactccattacctacagtagaagaactatttttgagagccctagcaaaagtgacttgtnttaaccagcatgntagcnggtccaaaccccccctc

SEQ ID NO: 111 - DNA, 519 bp, Candida albicans
aattgttttgattggacaggttcagcatttttatggcatcaagttcgttgtatggtagcaatattgtttactattggtcaaagtttagaatctcccctgataattactgatttgatggatacgaataaattccctactaaaccacaatatgaaatggctcatgatataccattggtgttgtatgattgtgaattcccatcaatggaatggaaatccactgatgatgaatatagattacatcgagtaatacaaggtttcactcgaatgcaatatgatttacaattgaaaacccaaatgctgcaaattatggaagatactttattcaaaaatcaagatccaaccactactacaaccaaaattttgaaaactatgaataatggtgatggagttggtcgatcttataataaatatatgccaatactggaacgtgaacgtactgaaagttatgaagttttgaatctaagatggatggaaaaaaagggatatcgaagaggacaagaaaaactcaataaagaataa

SEQ ID NO: 112 - DNA, 195 bp, Candida albicans
atacaccaacaatttgacagtatgagtgttgaagattcaataatatctttagattcattacaagatcaagggattaatgctggtgatatcaataagttgaaatctgcagggatatgttctatcacagtacgtataataaagtttaccagttgtctgtttctggtcttcaccacggggctgcaaggtccgcgataa

SEQ ID NO: 113 - DNA, 432 bp, Candida albicans
ggagactcatacatcatacaccatcccttgaacattgttgttcccaaactttctgaaagtgaacttgaagaccttcgtaatggatttgattggggtgatcttaaaccttggatctacttgttcaaaggtttgtcattttacgtgtgtgggaataacttgagtgctcgatttttaaaggaaagaattgagagattcagtggagacttgtcgaaacattttatcgaatgttgctacatagtaatccctgataaccattccagaccactaatgcttcgtgaaattgataagatgtcaaaccaaatttctcgcgaaatggttattgatgaaaatggtgggtcttcgagaattccacattttgttactgaggcattcgttcaagcttcaatcaagatgaattatattcccgatcctgacgattacaagtttaggtga

SEQ ID NO: 114 - DNA, 2175 bp, Candida albicans
  unsure (2119),(2120),(2121),(2145): Identity of nucleotide sequences at the above locations are unknown.
cccttctgtagatcattttccgcttattcatgtgaccacaacagcagagtctacatgacatattttttaaacgacatccgaccaccttctccaaatgatattactccatcgttcactttattgactaaagaattgtttgacaagcttgacggggttagaaaagagagtcttggtgattttcgaactgtcactgagaagaaagcattcattatcaaaacttttataaatacatttcgaacacacattggcaatgatatatacccttcagcaaaactaatattcccggaaaagtcgggaagaatatattttatcaaagaagttgcattggctcgtcttttgattaaaatgtacaaaatccccaaggaatcggaagactatatcacattacacgattggaacaaactgtatcaaaggtcacgaaggtgttccattgatgagaaaaagatacgtgaattgccattgcaagcatcaaggattatttccaaaatggagccaattgtggataaactcgaggaatatactgtaccgcaaattaactcttctttagatcaattggcattggaaaaggtgtctcagggtcagatagatattcttaaaccactatttgataatctaagtataccagaagtaagatggcttattcatatactacttaataaatcgatcttaactagcatggagagattttttttcaacacttggcacccggatggatatagagtgtttagcatatgcaatgacttacaaaagacattacaattttcaacaaatcccgatttgagactagaccctctgcagttagctatacatccttgtttcaagtttaaaccacagttgtcagaaagattaacaaccagttataaaacccttgtgaaaaagttacaaagaaagcatgaaatggatcctccatatgagaaaaaattccaagagttaggattggaaaataaattttacatcgaagagaaaatggatggtgatcgtatgcttcttcataaggatggtgatagcttcaagtttttttcacgacgcttgaaggattactcttatttatacggagaaagtttccagtttggtgccctcactaaatttttggcccatgcttttgccggaaatgtacaatctgtgattttagacggcgaaatggtggcctatgattatgagcgtaatgtcatccttccatttggaactttaaaatcactggcaattcaagaaagtgtccgacagtttacaaccatcgatcagtatgaacaacagacagcatatccatttttccttgtgtttgacattttgtttttaaacgggaaagatttaactaattatccgttattcttccgcaaaaacatcttgaaccgaattcttagaccaataccaaacagatttgaagttttagatacacggctaggttcttctctggaagatatcgaaagagcaatcagagaagttgtcagtagtcgatgtgagggtttagtattgaagaatgtacagctgaagtatgaaattgatgggttcagaaacccagattggataaaagtcaaaccagagtatttagaaaaatttggtgaaaatttagatcttgtggtgattggcaaatctccagccataaaaaactcctatatgtgcggattgaaaagtgtaactgatggcgtttattatagtttttgcacctgtgccaatggtatagaaattgaggagtttgataagatcgaaagactcactcatggaaagtggattaaaacagatgtggcaatgcctcccgaactgttgatcaaatttggaactaaaattcccactttttggattcatccgagtgattcgttagttttggaaatcagagctcgttcaattgacactcgagcaggcaccctgtatgctgtggggtcaactttacataacaatcattgtcgaaaaataagagaagacaaatctattgatgaatgtgtgacattacaggaatacacgcatatcaaggcaaattatatcaatgatttaaataaagcacaaactgcattgggggaaaagcgtgaacctgtgtactcattaaataatgagctgaaattgaaaaaaatcaaagttgaatctgatttgtttagtggggataagtttttgattatgagtgatnnnagagaagctgaccgcgaagttacnacccatcgaagaaatgaaagcaatggttaa

SEQ ID NO: 115 - DNA, 543 bp, Candida albicans
agacccgggtttttagccaaaaccttatatgatcgattgatacaggagtgtttgaacttgcaaaattcagggaaagagagcaaagtctattctagtatattgaaaaacaagagcaagtttttgatagctcatgcatctactggttatttacaaggactagaggaagtgttggatgatcctcagactaaaaagagattagcagacactaaatttttggaggagctggaggcattacagcgcttccaaagagcgttgaatgatgacgacggaagagcgtggtatgggttagaggaaatcacaaaggcattaaacatggatgcagtaaggtatctaatggtgtctgatgctttgtttagaagcgacgatattgaagagagtagacattacattgaccttaccgaacaagctaaaaccttaggtgccaaggtgtacattttttcaagtctacatgaatctggtgaacaattgaatcagttgacgggtattgctgctttattgaaatatccgattccagatcttgatgacagtgatgaagaagactag

SEQ ID NO: 116 - DNA, 1539 bp, Candida albicans
aacctcagacagatgaataggcttgtatcggaattaacatctagaaatgatcacaagctagcggtttgtcaattataccgagcgttgctacggaaaacgaatcaattagcatctattcccgcttcaataaacaaatttgaattaaaatataatatacaagaaaggtttagaagcaactatggaagcacttttcaaatatcagagcaaattcttaaaggcataactctaaatgaagcactaagtctagcgttaggtggcaattgggatgatttgaaacaattcatcgatatacaacgcaaggaagttttcctgtatcaaaaacgacgagcagattacttgaccaataaagaaaagatcgaggaatcagccaaaaagactgcaagaggcaaagtgaaacgaaatctattggccagatcaaggagaaagacaaaatattatgccccagatctaagaatgccagacagtgaacaacagttcattaaagacggacttgcaaacgcaaaatatcaaggtgatacagtgttgaaacaatttttgcatgagttgcaaagcttgaaaaagatccccgaccccaaattattgccttattccccagagctaatatttactgctggtgataatttaaactttgatcacatcattcgaggaaccagctcgaaatcattagagaattttgatcaagacattcttaaagctatagttataccagctatggagtatgatattaataaattgtatttagatcaattgaaaagtgatcttgataataaaggtccttataaagccaccgttcatgaagcattagcaggaactgtgcctgtcccgtacataatgcaacctaccaagaaaaagattggtcgagaagaaattgccaaactaatcaaaaaacagatattctttcgtagaatgatcaatatatgggagtcgcaaactcatttaacagaagaaaacaaacaaaaggatggaagttatcccatcaaaggtagtcatggttttggccctgaagagcttgtatatccaagagaatactatcaagagttgtatgacgcagaagagatgtatgagatattgctacagatccatataaatgaattgaacgggaaaccaaacgacccattagatttagaacaattttcgtggagtgagagtttagatattgcttcgaattatcttcgtgatgcttataagcaagttattcaagattccaaaatggattttaaggaattacaggaccaccttcaaaagtcattcaacaatcattatgatgaacaagttgaaaaatatgggcgattaatcacaaacttgcagaaacacaacgtttttaaacatagtgagattgtttcacctccaggttcacgaagtatattcgatgttgctgcaaaaagatctatcgatttcttccctaaggaagaagtaatcggtaaaggtaaaactcttggtgaattcatggctgaatcaggttttaagcattacaagcatggctacaagcttaccaagaggattgctcaaattatgaaaaagctaggaaaagatttttga

SEQ ID NO: 117 - DNA, 747 bp, Candida albicans
cgaatgcaattattgagactaacattactattcaatggctatttgattggagataatgaggaacagaatctagcaggctttttgaaattgtttttatacgttgtgtcggattacaatgccaacaaaagggaatatactacattagaatacttcacagtgagtattttcactcaattagtcaggaaatatcacaagcccgataataatgaatttgttttactattattcaaatacatatcggggattgaaacatctaactatggaaatgctcaagaaaccgatactacgaagagtctcgagctttgtttcaattttgtgaggttgttgaatgtcgcctttactcgtaacaatgatactaacattactgatatcatctacaaattgaatattatgctgatctcgaacgcaagttcccttgatcaatctatacctgaactagtgaatgatcttgtttcatacatcaaattaacagatattgatttgaaattctgttacaaaatcaaagcattaatttttatacttaatgggaattatatggtgaatcaatctcgagatacacttaaccaaatcaaggaagatattatggaattgaaaaaaatattttattcatccatgaaaaaattaacaactgcaactgaaaatcttgatttagtgatgatggttcaagatgcttttcatcaattagagtatttgaataatatgatagaaagttttcaacacgaggatttattttataatgatatatag

SEQ ID NO: 118 - DNA, 651 bp, Candida albicans
tatcaattaacaatggttttcggtttcggtaaagacgacgacaaagacaagaacgacagaagagataacgattcttacggatcttctaacagaagaaacaacgacgattcttatggatcgtcttcatttggctcttccaatgacgattacaactcttacggttcttccaacaagagaagtaacgattcatatggttcctccaacactgattcctacggttcctccaacagaagagacaatgattcatatggttcatctaacaatgattcctatggttcctccaagaccgactcatatggctcttctaacagaagtggcaatgattcctacggatcttctaacaatgattcttatggctcttctaacagaaaaggtaacgactcatatggctcctcaaacactgacagttacggttcttccaatactgactcatatggatcttctaacactgactcctatggctcttccaacaaaagaggtaacgactcatacggttcttctaatgatgactcttatggttcttctaatgatgactcttatggttcttctaatagaagaggtaatgattcctacggttcttcaaatgatgattcatacggttcctcaaacagaagaggtaacagtgactcctatggatcttctgactattaa

SEQ ID NO: 119 - DNA, 291 bp, Candida albicans
gttgacgacaaagacgatttagaatttttagagacttttgctggtgctattttcactgagagatcatttgatctgaattttaatttgatagagaatgaattaactaaagagaacaatgaagttttgcttttgccagatactacagaagagatcgtatcatggatcaataagttgccttatgacacaccattatcttggatttacttgtctgatgatgccaatctgttagtgaaaaaacaacttggattagaaatcgtggaatctgtacttgatctatctgaagatttatag

SEQ ID NO: 120 - DNA, 687 bp, Candida albicans
  unsure (392): Identity of nucleotide sequences at the above locations are unknown.
tgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcanacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctccagcatcgtctctctgaaaatcgactggatcatagagcgttaccagctggctccaagttacccacgtttgcctgaattccgccgcccgcttccctgcaggtgctgtttttaa

SEQ ID NO: 121 - DNA, 330 bp, Candida albicans
gcaccaagagcatttgatattgctaatcatttagcagaatggcaaggttttaattgtgatcgatctgctataccggaaccatcaatatcaaacccagtattggtcaattggtgttgtggatatttgaatgatatgaatgcatcaaaagaaattgttgaatcattaattgatgaaattaaagcttattatggattaccaggattttattgggggatttgggccatgattcaaagtgaattatcaaacattgattttaattatctgaattatggaaaattaagattagaagaatattggcaatggaaaaatgattatttaaagaataagtaa

SEQ ID NO: 122 - DNA, 222 bp, Candida albicans
tgctcccaaaatttaaaactttggattaatgatttaaagaatgatcgtattattattggattttgtagattttcaacttcaattcctgatttagtggaaaaattgaaattgggtaaaccattgaattattataatcgtgaagaattttataagtactacaactatggttataattcttatgatgaatcagaaaagcaagtcattggtaaaccattggcatag

SEQ ID NO: 123 - DNA, 792 bp, Candida albicans
acacttgtttttaacactttatcacaaagaatagcatttgcaccatccacacgttatagagcaaccaaagataatatccctaccgatttacaattagagtattattctcaacgatcagaatatcctggaactttaatcattactgaagcaacttatacatcacgtcaaggtggattagtaccatatgttcctgggatttataatgatgctcaaactaaaagttggaagaaaatcaatgatgcgattcatgccaatggaagtttcagttcagttcaattgtggtatttaggtagagttgcaaaccctaaagatttgaaagatgctggattaccatttgttggagcctcatcagtttattggaatgaagaaagtgagaaattagctaaagaagttggaaatgaattgagggaattgacagaagaagaaatcgatcatattgttgaagttgaatatccgaatgctgctaaacgtgcacttgaagcaggatttgattatgttgaagtacactcagctcatggttacttgttagatcaatttttaaatcttgcctctaataaaagaactgataaatatggttgtggtagtattgaaaatcgtgctcgtttattattaagaattattgataaattgattgatatagttggagctgaaagattagctatccgtttatcaccatgggccacgttccaaaatgttgacgtcgaaggagaagaaattcatagttatatcattgatcaattacaagaaagggcaatcttcaccacggggctgaaggacccgccaatgcgttaa

SEQ ID NO: 124 - DNA, 927 bp, Candida albicans
agtataaatacatcaaataacccacctatttcaaaattgttttatttttgtttatctctacaacaaacaactttcctttattttactaccaactattttccattcgttaaaatgaaattctccaaaattgcctgtgctactgtttttgctttatcttctcaagctgccatcatccaccatgctccagaattcaacatgaagagagatgttgctccagctgccccagctgctccagctgaccaagcacctactgttcctgcacctcaagaattcaatactgctattaccaaaagaagtattattggaattattatgggtattcttggcaacattccacaagtaatccaaatcatcatgagtattgtcaaagctttcaaaggtaacaagagagaagatattgattctgttgttgctggtatcattgctgatatgccatttgttgtcagagctgttgacacagccatgacttctgttgcttctaccaagagagatggagctaatgatgacgttgctaatgccgtcgtcagattgccagaaattgttgctcgtgttgccactggtgttcaacaatccatcgaaaatgccaagagagatggcgttccagatgttggccttaatcttgttgctaatgctccaagacttatctctaacgtttttgatggcgtcctggaaactgttcaacaagctaagagagatggtcttgaagattttcttgatgaacttcttcaaagactcccacaactcattactagatcagctgaatctgctttgaaagacagtcaaccagttaaaagagatgccggctcagtagcacttagcaatttaatcaaaaagagcattgaaactgtcggtattgaaaatgctgctcaaattgtttcagaaagagatatttcttctttgattgaagaatatttcggaaaagcttaa

SEQ ID NO: 125 - DNA, 318 bp, Candida albicans
aaaaggaaccaaagagagagaaagaggaaagcacaacttcccaaagttcatgaatgtacttttgaaggatgtgacaagtcgtttgcaaaaatttcagattataaaagacattatcgtatccatactggtgaaagaccatatatttgcgagcattgtggagctagtttcaatcaacgttatagattaacaacccataccagaattcatactggggaaaaaccattccaatgcaaatattgtgggaaaacatttgcccgaggtgatgctgtgcagtctcatatcttttcaattcatcgagccaaaggagaggcattctga

SEQ ID NO: 126 - DNA, 657 bp, Candida albicans
caaattaaaggtgaaatgttgtttcaagcgaccttaattccaaatttgcggaaattatgtatcacggcagaataccagataattagttacagattagaagagttgactatgttagagtatttactgctcaattccttcggatttactagcttttatgctcttgaaatgaatgttccaaatttaaaaactttaatattgactgagtgtgaggggttgagcgaatatgacggtttagaggattgtcaacatttaaagcatttaacaataaatgactgtgcctatccatttgaaatatttaatgaaacacgttttcttgagttagaaagctttgaatacagtggatccggttatataaatccaaaatattttgaaaaagaaaatttaacttttcctccaaatttgaaacaattatcaatcaaaacttccgatttcgttaatgtcaggtcgagtcaaatagtatttcctacttcattgatccgtttagagcttttagatgtatcgtttattgaccaatactttcatttggatgacaatttacaatatattcacattgagacaccaaaacttttgtttgacaacaaattcaatatcccttttatgaccgaggaattgatattaaaagttttcaccacgcggtcgaaggtccgaacttacgtt

SEQ ID NO: 127 - DNA, 450 bp, Candida albicans
ttctgttccaccacatatactagtttagtgggggttttaaaaaaaaacataaatattcaaaacgaaatgggtagaattcatggtttcttaggaggtgtattgctaacatcgtctttggcgtattccacaagtcaatatattaacaaaaaccaacaattcatctcacaaaatttacgtcaatcggactatatcatcaataatagaattttaagtgatgctgatgccaaattgcgtgaaaattacgttccagactcacatgtcaaatatcaatctcgagtgaattttgctgaaacttgtaaggatatttggaatgaagaaatcataaccatggtgaactgggtgtatagtctcaattggtataaaatgggtttagatattgatgctaaagtaaaccaatggactgatagaattgctgaatctgttgccaagaaggctgaagaaaagaaataa

SEQ ID NO: 128 - DNA, 939 bp, Candida albicans
  unsure (10): Identity of nucleotide sequences at the above locations are unknown.
gagaggttgntggaagtatacattcacaggacccaagttgttgcagagttcaatcatgatacccagccaaagggttcatcgttaaatgcaattcaaccaccagcaccggtaccagcaccaccgccacaaactcacaccaacgtcacaaatgaaaaataccaaaaagcaacattgaatgaatcaactgcaaaacctattcctccaaaaaggaataataatagtgtaaaacctagcacgaagcgaacactaacttctgggccaagtgacattctagtatccagatcacaagaaggtaatccattattatccacaccgattatgcaagcaacgccatggtcatttgacaagtctcttctctcggattactatattaatccaaagtttcagattatattcttgacgttaaagtaccacaagcttcacccggaacatatttggaatcgatggaaaaaactaaatcaaggctcatcaacagttcatacgagaggcgatgacgcattaagagtgttactagttgttgtagatgtcgattcccatcaagacctattgcgtaagttactggatttttgtatcaagcatgacttgtcgttagtattggcgtggtcatacgaagaggctgctaattacattgcattatgtaaacaactagataaggcacccctaaaggggaggaagattattgaaggtaccaaaggaagtgactacaattcaagtgtagtgaaagctttcactggtatcaaactggtcaataaaactgatgtctcaaatctactagcaaattgtaagtcagtgaaagaaattgtacttcaaagctgccaaaatgataatgatgatggtattggacttgccagtattcctggattgggagctaaaaaattggaaaatcttaaaaaagtattcctggaaccttttatttcaaataaagattatgatacatga

SEQ ID NO: 129 - DNA, 1245 bp, Candida albicans
tttgatttgtttttcatttttaacttcttgaccgaatttatttatttgttcaaagaatttttgccagtcactataatcaatctcatgatgcccagtattgatactgatattgacatctttgttgttctaggaaaacttccatctgatattgttggtttgattcttgactatttaccaaaatgcatgttgcatgaactattatacttcccacctattagagaagttgttgcatctgcaattttatcaaaaatactaatactcaaagttatacacagaaatacagatcataatgaatgtaattgtgaccttttggatataacgccaaaaaaattgaagcgggctatagatcaatggaacatatttcccaaatttgttgtcatgaaagatttcaatttattcaaagctgtcttagatctctctcctcaagttttacacaatgctataaatctttatggcgttttttgtgtcaaaagtgacgctgatcgacaaaagagtttagaaatatttgtgaactccaatgtcaaatttagtcatttcgcattaatgaattttggacatgtaacaactttacctactgtaactacaagtcttaccctaggagatacaacattagctagttacatggttgacggactaaagaggttacacgtgagtcaggggtttattgaagaaagagtgacaagttataattttccgtcatctttagaggatttagaaattgaaggtccgcgttcacctaaagtgattttacctccaaatttgcgtaaattgagatttgcaacgattccggactcgattgaatcgatgccagggcaagcagccaaaatggaagaattactgcttgctttaccacacattgaatcctttgatgagattggctttgtttctccaaacttgaaaatattaaatatcgaatactgtggcaagctaaccaattatgacggcttaaaaaaatttcaaaatttaaaagaattatctataaagtactgcaactatctaattggagtatttgcaggaaacttatttcctgagttaaagaaatttgaatacatggggacagattatgactttggaatcccagactttatacctacggatttatttggtaccacattagagtttccgccaaatttaaaatatttatcgataaagtttgctagtttcatgagggtagatttgagtactttagttcttccttcccagttgagacatctagaactttggggtgtgaaacttggttttgga

SEQ ID NO: 130 - DNA, 1341 bp, Candida albicans
agacctgcggtaactacaagtcttaccctaggagatacaacattagctagttacatggttgacggactaaagaggttacacgtgagtcaggggtttattgaagaaagagtgacaagttataattttccgtcatctttagaggatttagaaattgaaggtccgcgttcacctaaagtgattttacctccaaatttgcgtaaattgagacttgcaacgattccggactcgattgaatcgatgacagggcaagcagccaaaatagaagaattactgcttactttaccacacattgaatcctttgatgagattggctttgtttctccaaacttgaaaatattaaaaatcgaatactgtggcaagctaaccaattatgacggcttaaaaaaatttcaaaatttaaaagaattatctataaagtactgcaactatccaattggagtatttgcaggaaacctatttccaaacttagaaaaattttattatcaagcaaaagatatagatgatacactagaagactttgagctttcagaatactttgacaatgtgacattaaagtttcctccaaatttaaagcatttttcaataaagtttgctaattttatgacagttgatttgaacactctttttttccctcatactttgaaacatttagaactctggggtttgctgtttagcgatggatacttgcacctttctgaaaatttagaatacgtacgtatccgttcaccagaattggagtttgatgacaatttcaggattcctcaaaagatgaagtactttcaagtaaccgttaactacttctatttcgagacatcagattttatgtaccatttaccagatggattagaacatttacaattggtttcgcgtaaagatggagacatgggtcaactatataacaaagttcagtggccaaagtcattgaagatatttcgtttacattattttagctttaatccgagatcattggcatttttgaaattgagtaaatcatgccttgaagagattgatattcgcggtggtcattataagagattaaatgcagattcacttccaaaaagcgttcgagttttaattttgaagaaaatgggaattcaagaattgtgtggttcctttgaacggctaaataacctaaacaagttgttagtcacacacaccaatcttcggaaccaagcccctataaaattgccagtatcatcattgagcctcatagacttacgatactgtaaacttgatactaagtcaccttttgtcgtgtctatccgacaggaaaagaataaaaacacctgcttaaaagtaaaagaatctgacttttggggcatgagtgacatggaaatgtga

SEQ ID NO: 131 - DNA, 882 bp, Candida albicans
agtagtttagattttgaaactgatttttttttttcaaatataaacaaaccacatctttcttttgacttcctattaccaatgtcccaggatagagatatatcgtcgttgataataaatcaaacatttaagatctataaatccaattcatcactatcgtcatctataaaactcactaaaaaacaattggagaaatttcgaataaccctatgtaaatacttgtaccaaagatatcaacaaactttacaaatagaagatgatttactagttcaatatgaattatatcgtgatattgtacctgaactcactatttataacaattcaattgaagagcattcacagtataaaatccaatatctaataatcaaatgtgccaataatcgattgatatctcgtcaagtgttcatatttgttagtaatgatgatgatttcactttggtattgaatagaattaccaatcaccctagcataaatgaatatattttggaattattagaagatattaatgattatccattgattataaaaccacttgatttacctgattatctaatacccaacttggtggatcaattgggtaataagttggattctttgggtgatttacaattagtatattcatcttctacatctaataggttgagaaattttataattgatattccgaaaaacgatttaccaaaattgtctagtgatgggaaattatatcaagatattgttaaattcatgtataataataccaaaataaaatttgaaaaattaagaatagaaaaatttattaataatttaattaatattgctagtgatgggaaatttaaattaataattaatgataatcaattaatttggtttttgattgaatctataaaatcatctttacaataa

SEQ ID NO: 132 - DNA, 1599 bp, Candida albicans
ggaatcattctaaatctagcaaaagattcacttccagaattgcgactcaggcattcaaacaagcttgtggtccaaaaatggggtactctactacttgaaataatagacaatgagagtgtcgtcactaacatttaccaattgactaatacatattggacccacttgcccccagagatttgtgtaccacaaaatttaaccaaactaaacaatgcaatcttatccggaacaaccatttcaaattccgatatcgcaagaatactaccaacacctaaacagctactgttaaatttaattcttgctctaccactagttaaccaaacatctttaaccgatctagaatacaaaacacagatccaacaaatctttcaaaaaactttacatgaactcagaccaaatgacaagttgggagtaatttttcttggaatagacgggtcaaaaaaaccgtgtgccaaagggtcctttgttgggtgcactgaaccaagctggagtgagtggaagcaggtaatacgagacattacaatagttccaaactcatttcaaagtaacttacaggaaataaatgttgctatagaaaagtgtatggagctatacccttttattccacgtacaacatcatcagttaacaagtttctaatactcagcccaaacacatactcacagctgccaaaagacgcacccaaatccaaatctattgacgcaataaacgaaaaactatcttgcacaattgtttgtgtcggcagcacatatggcaactaccaaccattcaagtctattactacatttggcactcctttcctacgatttgagtctttcgcgaagtttggcagcttactagtatactatatcaacgaaaacctccacaaaatatgtattccaaaattgacattaacattaaaggcatctcagggttttaggttcactgatcttgattccagaggggctattgatggaagtcagttgacacttactattaaagatattgtcccacagacgcaaaaactgattgtgctcaaagtgcaagcaaacccccaatttgttgcttccaaatatcagacgcttccaatatttgaatatgatgggtattggttttatgagaaatacctcgacaccaagttgataagtacgagagtcaagataggtgtcagccagcaaccaccgacacctattgatgcggaagcaaggggaagctttacggaatactatttagacatcccattactacctcccgtgtcgccagcaagagatgctgtatttgccaaaagacaaactgagctaaccataattaactcattaaagaaaagcatcgcgctgggtgaaagccaagtgtcactggatataattaaaagctgcatatcgttagcacacggattgatacgtacttctcttgaaggctctacaaaatcacacaccaatgaatctagccctgagtgtgagtatagtatgttacagttgctaatggcagtaagatacactgacaaaggcaatgttgagtatattgatttcttggtaaatcatatgaaaagtattgccaagctactagaatcggacctcgatgcaggtaaattacgatgttccgatttgatgaatagtttaatatag

SEQ ID NO: 133 - DNA, 945 bp, Candida albicans
atccaaattcctgttggtggaatactttggggtaggaaacgtgcaagtgtatcaggtacatctgtcaatgttactgacggtgaccaagttgtttatgaaattgactccgaactcccaaacaaacaagagtggttagatttattagctggaactgaattaaattggttacaagcatttatttccactgatagaattgttcaaggatcaaaacatgtttccaacccattgcatgatatcttgactcctgctaaacactccaaggttactattgacaagaaaaccaagaaattgactgcttttgaaaacattaaaggtgacttgttaccagttgttgagattgaattggtcaagccaaacactatccagttgtctttgattgaacatagaactgctgatgccaacccagttgcattaccatttttgtacaaatacaatcctgctgatgggtttgctccaatcttggaaatcatggaagatagaaacgaaagaattaaagaattttactggaaattgtggtttggatcttctgtgccatattctaacgatatcaatgttgaaaaagctatcttgggagatgaaattaccatttcaagccaaactattagtgagttcacccatgccatcggtaacaagtgtgacgcatttgttgatagacctggtaaggctactttagctccaatggattttgctattgttattggatggaaggctattattaaagccattttccctaagagcgttgatggtgacttgttgaagttggtccatttatccaatggttacaagatgattacaggtgctgctccattaaagaaaggtgatgttgtttctaccaaagctgaaatcaaagctgttttgaaccagccaagtgggaagctagttgaagttgttggtaccatttaccgtgatcttcaccacgaggggcgcggtccgcgcttattttaa

SEQ ID NO: 134 - DNA, 333 bp, Candida albicans
agatatgaagctagtcaatggacttttgctcgtggtgctgctgctactattgatcgtgaatttggatttgttggcaaacatattttccatgatattattgaaactcatgttttacatcattatgtttctcgtattccattttataatgctcgtgaagctagtgaagccattaaaaaagttatggggattcattatcaacatagtgatgaaaatatgtgggtctcgttatggaaatctgctagatggtgtcaatttgtcgatggtaataatggggttttgatgtatagaaatactaatggatttggagtcgatcctaaaaagcaaacccattga

SEQ ID NO: 135 - DNA, 1326 bp, Candida albicans
ctttcaataatggcagctgctacaacttccttttcgtcgggattcaataataacaacaatgctgatcaatctactgatagttctgctactatcagtaaatcaggtaatgttgccagttttaaaaccacttccactacttcaacctatcaaacaaatttaactgctattgatacttatggtaatgaatttaaagttccagattataccattaaagatattttatcggctattccaactcattgttatgaacgtagattattacaatcattatcctatgttttccgtgatattttttgtatggtcgtattaggtttcattgctaataattatattcatttgattcccaatcaatttattagatttgcagcttggacaggttatgtttggtgtcaaggattatttggtaccgggatttgggttttagctcatgaatgtggacatcaagcttttagtgattatggtagtgttaatgattttgttggttggattttgcattcttatttaattgttccatatttttcatggaagttctctcatgctaagcatcataaagctactggtcatttaactaaagatatggttttcattccatacactaaagaagagtatttggaaaaaaataaagttgaaaaagttgctgatttaatggaagaatcaccaatttattcatttttggttttggttttccaacaattgggtggattacaattatatttggctaccaatgccactggacaagtttatccaggatattctaaaatagctaaatcacattacacaccaacatctccagttttcgataaacatcaatattggtacattgtcttatctgacattggtattattttagctttcaccacagtttaccaatggtacaagaattttggtttattcaacatgatgattaactggtttgttccatggctttgggtcaaccattggttggtgtttgttacatttttacaacacaccgacccaaccatgcctcattatacttctaaagaatggacttttgctcgtggtgctgccgctaccattgaccgtaactttggatttgttggtcaacacattttccatgatattattgagacccatgttttgcaccattacgtatcacgtattccattttacaacgccagagaagcaactgatgctattagaaaagttatgggtgaacattacagatacgaaggtgaaagcatgtggtattcattatggaaatgtatgagaatgtgccaatttgttgatgatgataaagaagatgctaaaggggttatgatgtttagaaatgtaaacggttggggaccagttaaaccaaaagattaa

SEQ ID NO: 136 - DNA, 1212 bp, Candida albicans
tttaaagatctttcttctttttataccatggcactacagtacagcccagctaaatcctcaaaagtttcaaagcggcccctgtcaaaatcacctataatgagttttcaaaaggatgttcgaaagatacttttaccatctacaaaagtttacaaggatgcagtgtcaaatcagaagttgcaatcacctaccacgttagaagacaataagctaacagttaaagattacaaggtgagattagattatcagcaattctctggaaaagatattatggtggcaatagatactattttgaacaacaaatgggctgaaagtacacaattacataaccgatatcctactaagcaaggaactatggaggaacgaatatttggtctccgtgttttatcaaatgccctgaaaacggatatattgaaattcagaagaaactttcctatgggtttggttaccactacacagttatactctatttttttgaacgagagcaacacatttgttgataaatcattggagtcacacattagatcaggaaaactcaagaaaatagtgattagcaatgctgctccgattattctgcggtcggtgaataaatttcaactggggaaagtcacctatgggtttgagaacgttgaactcgtggtaaagtcagattcatattttctggttataagtggcatgcgagatctgttagaagaagaagagcttaagaataatcaattatcaggggctttgcaaagtaaaaaacaaagttcaatatctagtttggataaatttatgaagtatttgaaggaacacccaacagctttgtatatatcgtattctgccgataatggaggttttacagctgaggaaataacatacttggtaaactcggggtttgtgactttagcttcaaatcatttgatagaaattgagataaatgtttattcaatttcatatcctggatgtggagcttatttgaagttggtgaactctggtcgttcatggttggtgaaagtgttgggcaaaaacaagcacaaggaacttttagaagaccaaatcatttccaaatgggaaggtgtgaatgcaactggtgaatccaaaatgaataatttccgatctcccttttatggatatgatttgaattgggttttagcagatgccttgggggcaggggtagttgaggttttcaatacacccgtggggagaggttggaggttaacgggtaagatataa

SEQ ID NO: 137 - DNA, 1923 bp, Candida albicans
aaacccgccatccatttatcaatcggtgattctcttcatattcttttttttttttgctccctgaaccttcaaagagctatttttgttagtaccatggcatcccaaactactgatactgacctctttactaggttagctaaattacctccaaatgttattgctttgattgttgacaatttactgaaatgtattttgccgccgttgttgtattttccaccaattcaagaaataacgactattgcaattttgtcacacgtgagtattactgatcgtgtatggagacatgagaaaactaatctttatagtatcaacaacgatggctgtaactgcactttgttcagcattcagctttctaaattagaggatgctgtcaagcgttggaatttttacccaagatccattagttttgttgatttaggtcaataccgtaacactttggaaaacttccccacggttttggaaaaagctcaagatgtcaattgtcattttttctgttctaatggtaaagagcgcgggtacttgaagcaaattcttagcactagttgcagattcaacagattgaatttacacgatttgggcgccattcccaaaatatcctctgtggtaaaggaccttctgttgagaaatacttggttagacaattattttatcccgggtttgaagctgttgcaatgtgatctcactcacaagaatcaagcggtggattattgtttttttcctactgatttagacgagttgtctgtcactattaatgatcgtaacattgtctcgttacctccaaatttgaaaagattacaagttgtgacaacccatagaaccgcaaatttaacaggtcaaaaaatgctaaacttgaaaaatttgcaactttgtttccctaatatcagaacctttggcgaagctaaaataatcgcgccaaatttagaggttttggatttggaatgttataaactaaccagtttcgatgatttgaaatccttgcgctttttgaaaagtttgaatttcgtgggatgtgtttttcctgttagcttgttcaagcaggtctatttccctgaattagagttttttaaatacgaaggtactgttccgctctttttaacaaaaaagccaaagatcgataagacagtgcctgaagagtttaaaaatctatcattaaaattttctccaaatatgaagagattgaaaataatcaatgcaaagtttttggatatcaacttaagtgatacattatttcctgcttctttagagtttcttcatctttccgaggtaacctttagtgatggctatttacgtcttggggaaaatttgaaaactgtttacatagaaacaccaagagttgcgtttgacaaaagtttcagaattcccaaggcggcaacagagttcataatcatagttgattttttaagttttgaaaattctgattttatgtaccatttaccaagttgtcttgaaagcttacatctaaacggttccaagaaaagtagtatgaagcccctcgagcagaaagtcaaatggcccttgtcattgaaagtatttgttatgaggtgtttcaatattgatagcaaaacatttgaaatgttgaacttccaagaatcagagcttcaagaaatatacatgtacaaaggtgacatcaaaaaattggatgcagacgctctccctgcaagcattgagacgttgacattaaacagaatgggtattcaagagttatcggaatcttttgagaagtttaaaaagttaaagcatttggctttagagaaaaatccttttaaaaaattgtcaccagttagattgccaatgccttcattgaagaaactaaaacttactaaatgtaatattaagttagtgtcaccatttcttgtttcaaagttggatgaaaagtatttaaaatcgagactggccgtaatagctattgtgaatattcagaca

SEQ ID NO: 138 - DNA, 1146 bp, Candida albicans
actaatgtgatgaagaaacaaaggttaaatcaccaagaaattataaattcatgttttaaacccccacaagaagccattgatgatttacagaagcacaaggaactgttcccacttggctttataacatcagattgttcgacacttctcgacaaatatggaacactcaaggtatatcaagccatcgataccagtttaaacgaaactggtaaaaatcatgcagagattttgagtcattatccagaatatatcgaaaatgattcatttgaatgcttctcgctgcaaattactatttcaaacaaagaaacaggttatacttgtgaagaattgttaaaattaagggaggaattgatatatatccatagaacattagattttacaattgtacataaactcatggcttttgttactttcgtagaggaaccagtatatgataataattcattagaaatgatgacattaacaaatttaatcaacaatctagacttagatttcaatggcactgtggaacatattaaagtagatcaatttaaaaatcgacaattattatcattccaattaccaatgtacattagatcacaagcaagaagtttattcgaaacaaatttcttaaataaaaaagataaaatagtaaaagaatatgatcctgtgattctgtatactcaacctccgggtaaaaagggacaatcagaaattaaagattatgtttgttattttattgttgatctttattcagggcagatccctaaacgaagaatcattactactactactactactaccaaaagaaaatcaacaaaaacaaaagcaaattctggtaaacaaaaaaatatactagataaatgtacatcaaaagttgtatcaaggtgtcgattttgtgcatattgtagagcaatgactcatacaaaatatcaatgtccatttattaaaccttgtactaaatgtggtataaaaggtcacaaaacatctagttgcaaaaacgatactttgactgccaaagaggatacaaaaaatttgaaaaaaaaacaatatttcccaccgttaccaaataaagaggttcaaaggtatacagagaaggaatctataaagtcaaaaactcttaaggaacccaaaagagaggtgaacatcttgttactaaagaaaaactag

SEQ ID NO: 139 - DNA, 1776 bp, Candida albicans
cgaaataacaataaaaagaaaaagaaccccaaagatactccatcatcaataactacaacagatcacatctatcctgaattgattcttcaagagtctgaacatggcaacaaatattattcatgtttccaaagttataatcgacaatttataaatgatcctaccactacgactacaactactaataacattaatcatcattcagagattgtgcgatggacaggttcaacgattgaattgactgctagtattatactagataattggttgaatcaaagttccggaaatggcactaaatctaataataatagtggcagtaatagcacgaccactacactgaaacgacatatatctcgacctaatgcattgtttgtatgggcatcaacagatgaatatattgaagaacggaaaaaggaattacgtcgactacaaaaactaaaagataatgggcaagatcaaactcaagataaatcacaacaaatccaaaatggcactaataataggccaactgatgatagcaaaaacaagaataacagtagtactggtaagagtaaacaagatatagttaaacaaaatctaaagcaaaaattagatattgaattctcaaatgttgccattaataataaattgaatagaattattgaaattgaatcaaataaatttattcatgcaagaattcaaagaattaaagctcattatagtgaacaaatggaaaaacaaataaatgaacggaaaagaaaagatcaagaattatatttgaaaaaattgaaattaaaagaagaagaatatgaacaagaatcttcacttcgatctaagaattctacaaacagtggtggtggcacatttttaggaaacttatttggattcaattctgctactgttggtggaaccagtgtcaatactttggaatctacatataataatcgatcatcgacagaaagtagtcgtaccatggattcgactaatgctagtattactacaccatcagtaatgacaccatcagcgaaaccaaagagattcccattgttttccgtggcaggtttatttgggggatcatcgaagaaaaattcaagtaaaacagttttatttgaacctaatgaaataaatgaagatgggaaagacgagacaaacttgtctactccgacaattgagaataatgaactggtggatccagaaaatggcacgcggccaaatatagtaatagaccaagatctggaatcaaagccactaccatcacctccactaccaccaaaaccaaaaccatgtgagaatagactgactccagatttgaatcaagacgatactaataatcaacacccaacacaaccacaaacaactgcaactacaactacaactacaaacaatttcttttctatagacgaattagaacagcatattaaaaaatctgctgaacccagtccctcaaaatccaacaagttcaatgatttcttagctaagggtcaacctactgagaacggcacaacaagcacaaatgataacaatgactacgatgaagatgatgaagagtttgatgattttacttctgcacaaccaatccatgataataacaatgacataacaattttccaagatccaccaaaattaaatcgtaattttttttcaattgataaagctaaggggaattctgtttcgaaatctggtcataatcaaataaacaatgatctacttgaaatatttagtccaacgagaacatcatcagcacctgtgagtaaactgcctagccctgcatttaatgaacttagtttacttgatttataa

SEQ ID NO: 140 - DNA, 1002 bp, Candida albicans
  unsure (910): Identity of nucleotide sequences at the above locations are unknown.
atataccaaattgataatcttggtaatttagaaatcattgagttaggatctgttcctaaaagtttgcacgatggtagatatggattgtttattattgattcagagaatgtacttagatattacaatggagaatttcatacaatcgatgacaatgcttcttctatcagagttgatcaaaacaaagggtacatatatcttctagttaatgataaaaaattgattaaactttccaaaaccggacaagttgtatttactactgaaattgaagttggatcaataaaggaattcaataagggaattctcttaactgggaatgatcaaatattcaaatttgatgaacacgataaaacatttaaaagaattgaaaatgattcatttaaaaacttggtaattgttgacaataatttattgtatgccacattgaatgatgctgtgcagttgatccacgttactaagaatcaaaagactgaattacttgaagttatcaaactcaaaccaaatgcaaaagtcgagttatttactactcccttgaatgcttttcttgttgtgtcctatcaaaacttgaaacaggttcatgacttgacagatcttcttgatacaaaagatgcaaaaagtatcaaacagcttattctcaaactgtcattggatttcccacacctgcttgtttctataaacaaagatcaattgaatcttttgttgatcaatgaccaattggttggagaagtatacagtttatttgatggttctaaagtagagtctatttatccacagttccatcaatactcctcaaaggctaacaaatacattattgttgatgaacccgaatcagagagcatcaaacatgaactagaactgatcctccatgaaggtgatggtgtatatgttttaacaaattggaatcctaaagttnacagacacttggctgaactaggcaaatttggttccgtctttaactataaaaatttgtttacttccaatgaatcattggaatttgtcaaataa

SEQ ID NO: 141 - DNA, 282 bp, Candida albicans
aaaccatttgtgatagacaaaatgctgctgattcttgcctggggattcaatttgtggtatcaaccacctccacctactgcacaaactgagaaagaaatcgaacacactattaactctcacaagattgttatttattctaaaacttattgtccattttgtgaccaaaccaaacatctattaaatgaacaatatccacaagaatcgtacgaagtcataaacttgaatattctcgatgacggattgactattcagaatcaattgatcataatactggtcctttga

SEQ ID NO: 142 - DNA, 408 bp, Candida albicans
agaccagcaggatcaatacaacagcaacagcaacagcaacagcaacagcaacagcaacagcaacagcaacagcaacagcaacagcagcaacaaaaatcaattgataatgatcaagattcaacaaatgaagaattggatcctaaacgatttgaaaaaatatctaatattattaaaacttataaacaatcaataacaaaattaagaacaaattttaaaaatttaattattcgaggtagtaatggaaccaatttttatattgatattataactgataatatgtttattatgattgttttaaaagataaaaaagatactcaaaacatgattcagcaacatgaagaattattgatttcagataatattaaagctgctagaacatggtttgaaaaaattgaaaataatgagtaa

SEQ ID NO: 143 - DNA, 759 bp, Candida albicans
  unsure (4): Identity of nucleotide sequences at the above locations are unknown.
tatntaataaaaacttactcctccagtcaactaagcttgaatcatatcttttttacagccaaatttctcactccctacacgtacactccctcacataatatacacagcttcatggtggaatcatctgcatcaattaggaaatcacaggattcagctaatgataataattcagaaattgatcagactgaattacggtactttactgaagttgatattgatgaacaaccaagtaacaacacttttgatgaagaagaagacgacgaagaagatatttcttcttctgcaaactcagccattgaagaagaaaaaggtgtttccaacaaacaatcatggaggaaagttttaatgctttgttttctgtcattggggtcaatttatggtgatcttggtacttccccattatatgttctcaattcaatcaaatattcttcttacccacccaataaagaagacatttatggtgctgtctctatcattttctacatttttaccattattgttatattcaaatatgtgctaattgttttgtttatcggagttaattgtaatcatggtggacaagttgccatatttgccaagattgctcgacacttgggtattggtcctagaggggttagcttgccaggggcacctgaagcttctgacatgcaattattaaccagacaagacaccactacatcttcaatcaaatctactcaaacacgagttgaaaaaataaaagaaaaccccatattgctttcttttcttcagtattttata

SEQ ID NO: 144 - DNA, 576 bp, Candida albicans
  unsure (34),(76): Identity of nucleotide sequences at the above locations are unknown.
ttggtacgtttccattatctagacatccccggantaggattcatgtatgtcgattccataatgaccaattcgccgnacactttgcctcaactatatggaaagttgattacttcatttgcatctataccttctgaatttgtgtttgtggggattcgagtattatctattctatatgtgaattctgatgaaagaatattattggcaccaatgaaaattcctggtcattataaatgtatattaagatttggatttatggaaaatgttcaaattgataaagaattaagttctaaaataatggcaagaattcctggattaagtgttttaactcctgaacaattacataatcatccaattattcattttttcgaaaatgatttaattagatgtcatcaatatcattctggtaaaagaaattatttcaaaaaatttggtcatttgataagaaaaactattattaatcatatatatagtcccttatattctttgactcaagataaaggagggtttctttggtatgataatgaaaaagaggaaagtgaaaagaaattatttattggtggtatttctagaatataa

SEQ ID NO: 145 - DNA, 741 bp, Candida albicans
aaaaagttttcttcttcttcaatttttagtgtgtatgttataattttttttttgaatggaaaagagagaattccaactcaagttcaatcacgtcttgaatctatagaattcatcaattggaatttcactcataatataaacatgtcaagtgagaaggtaaaaagagtggaagcagatgcaactgatttattagccagtctttcaatagacaaaagtggcgaaaaacttgaagaaatcaaaaagggatcaacacctgatccttctgatttattgggtggtctttcattaaaagaaggtgattccaaaaaacctgaagaaaagaaagaagttgttgaagaacctgaaaacaaagaaattaacgacgataagaaagatgaagacaaaaaagatgaatcaaaagatgaagttaaggacggagatggagccaaagaggaaaccaaggaggaagtcaaagaagaatccaaagaagaacctaaagaacctaaagaacctaaagaaccagctactaatttaattaaatcatcttatgaagttaaagttaaattagctgatattcaagctgatcctaactcaccattatattcggttaaatcatttgaagaattagggttgtcaccagaattattaaaagggttatacgccatgaaattcaataaaccttccaagattcaagaaaaggcattacaatggttactttcaaatccaccaagaaatatgattggtcaatcacaatcaggtact

SEQ ID NO: 146 - DNA, 249 bp, Candida albicans
agactggttaattatgatatgccaactgataaatatggcaaaccagatccatcaacttatttgcatagaattggtacaactggtagatttggtagagttggggtatctatttcatttattcatgatagaagatcatatgacattttgatggccattaaagcatattttggtaatgttgaaatgactagagttccaacagatgattgggatgaagtggaaaaaattgttaaaaaagttattaaaagttaa

SEQ ID NO: 147 - DNA, 195 bp, Candida albicans
ttgataaatttggtatgtttgatgaaattaaagctagatttactggtattgttttccccaggtgaaactttgagagttttggcttggaaagaaagcgatgacactgttgttttccaaactcatgttgttgatagaggtactattgctattaacaatgctgctattaaattagttggtgacaaagctaagatctaa

SEQ ID NO: 148 - DNA, 2472 bp, Candida albicans
ggaggtgccttggacggtcaaggtggtaactccaaagcagcagatattgttgtcgatgaaattaccaagaacggtggtgttgccgttgccgattacaacaatgttttggatggtgccaaaattgttgaaaccgccgtcaaaagctttggtactgtgcatatcattatcaacaatgccggtattttgagagattcttctataaagaaaatgaccgaaaaagatttcaaattggttatcgacgttcatttgaacggtgcttacgctgtcaccaaggctgcttggccatatttccaaaaacaaaagtttggtagagttgtcaacacttcctctccagctggtttatacggtaactttggtcaaactaactattctgctgccaaatctgctttgttaggttttgccgaaactttagctaaagaaggtgacagatacaacatcaaagccaatgccattgctccattggctagatcaagaatgactgaatctattttgccaccaccaattttggagaaattgggtcctgaaaaggttgccccattggtcttatatttgtcatcagctgaaaatgaagtgactggtcaattctttgaagtagctgctggcttttatgctcaaatcagatgggaaagatccggtggtgttttgttcaaaccagatcaatccttcaccgctgaagttgttgccaagagattctctgaagttctcaactttgacgactctggtaaaccagaatacttgaagaaccaacacccatttatgttgaatgattacactactttaactaccgaagctagaaaattaccatctaacgatgcttctggcgctccaaaagttaccttgaaagacaaagttgttttgattactggtgctggtgccggtttaggtaaagaatacgccaaatggtttgccagatacggtgctaaagtcgttgttaacgatttcaaagatgccactaaaactgttgaagaaatcaaagctgctggcggtgaagcttgggctgatcaacacgacgttgcctcccaagctgaagaaatcattaagaatgttattgacaaatacggaaccatcgatgttttggtcaataatgctggtattttgagagacaaatcctttgccaagatgagtgatcaagaatgggatcaagttcaaaaagtccatttgttgggtactttcaacttgagtagattagcttggccatacttcgctgaaaagaaatacggtagaattgttaacatttcatctaccagtggtatctacggtaactttggacaagctaactatgcttctgctaaagctggtatcttaggtttgtcaaagactttggctgttgaaggtgctagaaacaacattaaagtcaatgttgttgctccacatgctgaaactgccatgaccttgaccattttcagagaacaagacaagaacttgtaccatgctgatcaagttgctccattattggtctacttgggttctgaagaagttgaagttaccggtgaaacctttgaagccggtggtggttggattggtaacaccagatggcaaagagccaaaggtgctgtctcccacgatgaacacaccactgttgaattcatcagagacaacttgaaagatatcactaactttgacagtgacactgaaaatccaaaatctactactgaatcttccatggctatcttgtctgctgtcggtggtgacgatgatgatgacgatgatgaagaagaagaagatgaaggtgatgaagaagaagaggaagaagatgaagaagaagacgatccagtttggagattcaacgatagagatgtcattttgtacaatattgctcttggtgccactaccaaacaattgcactatgtttatgaaaatgattctgatttccaagttattccaacttttggtcatttgatcaccttcaattctggtaaatctcaaaactcctttgctaaattgttacgtaacttcaacccaatgttgttattacatggtgaacattacttgaaagtccacaaatggccaccaccaactgaaggtgccatcaaaactacttttgaaccaatctccactactccaaagggttccaatgttgttattgttcacggttctaaatccgttgacaatgattctggtgaagtgatctactctaatgaagccacctatttcattagaaactgtcaagccgataacaaggtttacgctgaacgtagatcattcgtaactaacccattcccagcaccaaagagagctccagattaccaagttgatgttccaattagtgaagatttagctgccttgtaccgtttgactggtgacagaaacccattacatattgatccaaactttgctaaaggtgctaaattccctaaaccaatcttgcacggtatgtgtacttatggtttgagtgctaaagtcttgattgataaatttggtatgtttgatgaaattaaagctagatttactggtattgttttccccaggtga

SEQ ID NO: 149 - DNA, 474 bp, Candida albicans
tctcaacgaatcatgtcgtccaagatcgaaagaatcttttctggacctgctttaaaaatcaatacttatttggacaagcttccaaaaatttacaatgttttcttcatcgctagtatatccaccattgctggtatgatgtttggttttgatatttcttcaatgtctgcctttattggtgctgaacattatatgaggtatttcaattccccaggatcgaatatccaagggttcattacttcatccatggctttgggttctttctttggttctattgcctcctcatttgtttctgaaccctttggtataagattatcattattgacttgtgctttcttctggatggtcggtgctgctattcaatcatcagttcaaaatcgtgctcaattgattataggtagaatcatttctggtattggtgttggtttcggttctgctgttgctccagtttatggtgctgaattggctccaagaaaa

SEQ ID NO: 150 - DNA, 1089 bp, Candida albicans
gacgcggattttcctccccgtggtgaagattggggacttcaaattgtccctggtctttgtttgttcttgggttgtttctttattccagaatctcctcgttggttggctaaacaaggtcaatgggaagctgctgaagaaattgttgccaagatccaagctcatggtgatcgtgaaaaccctgatgttttgattgaaatttctgaaatcaaagatcaattattattggaggagtccagtaaacaaattggttatgctactttattcaccaaaaagtacattcaaagaaccttcactgctattttcgcccaaatttggcaacaattgactggtatgaacgttatgatgtactatatcgtttatattttccaaatggctggttattctggtaacagtaacttggttgcttcatccattcaatatgttatcaacacttgtgtcaccgttcctgcattatattttattgataaagtaggtagaagaccattattgattggtggtgccactatgatgatggctttccaattcggtcttgctggtattttgggtcaatactcaattccttggccagatagtggtaacgactcagtcaacattagaattccagaagacaataagtctgcctccaaaggtgccattgcttgttgctacttgttcgttgcttcctttgcctttacttggggggtcggtatctgggtctactgtgctgaaatctggggtgataacagagttgctcaacgtggtaatgccatttccacttctgctaattggattttgaatttcgctattgccatgtataccccaactggcttcaagaatattagctggaaaacatatatcatttatggtgtcttctgtttcgctatggctacccatgtctactttggattcccagaaactaagggtaaaagattggaagaaattggtcaaatgtgggaagaacgtgttcctgcttggagatcaagatcttggcaaccaaccgttcctattgcttccgatgccgaattggcaagaaagatggaagttgaacacgaagaagataaattgatgaatgaagactctaactccgaatccagagaaaatcaagcctaa

SEQ ID NO: 151 - DNA, 1137 bp, Candida albicans
actttaggtatattgattatgttttatatctcatttggtttaggtcacattaatggtgttgcttcatttagaattgcatggggacttcaaattgtccctggtctttgtttgttcttgggttgtttctttattccagaatctcctcgttggttggctaaacaaggtcaatgggaagctgctgaagaaattgtcgccaaggttcaagctcatggtgatcgtgaaaacccagatgttttgattgaaatctctgaaatcaaagatcaattattgttagaacaatcaagcaagcatattggatacgctactttattcaccaagaaatatatttacagaactttcactgctattttcgcacaaatttggcaacaattgactggtatgaacgttatgatgtattatattgtttatattttccaaatggctggttattctggtaacagtaacttggttgcttcatccattcaatatgttattaatacttgtgttactgccccagctttatactttattgataagattggtagaagaccattattgattggtggtgctactatgatgatggctttccaattcggtcttgctggtatcttaggtaattattctgttccttggccagagagtggtaacgactctgtcaatattagaattccacttgacaacaaatctgcctccaaaggtgccattgcttgttgctacttgttcgttgcatcctttgcctttacttggggggtcggtatctgggtctattgtgctgaaatctggggtgacaacagagttgctcaacgtggtaatgccatttccacttctgctaattggattttgaatttcgctattgccatgtataccccatctggtttcaagaatattagttggaaaacatatatcatttatggtgtattctgtttggccatgggtacccatgtctactttggattcccagaaaccaagggtaaaagattggaagaaattggtcaaatgtgggaagaaaatgttcctgcttggagatcaagatcttggcaaccaaccattcctattgcctccgatgccgaattggcaagaaagatggaagttgaacatcaagaagataaattgatgaatgatgattctaactcagaatcaaaagaaaaccaagtctaa

SEQ ID NO: 152 - DNA, 462 bp, Candida albicans
attcggtattttaatatggcggtgttatgtggaatatgccaagtagaacaatcaaaatataaatgtcctaaatgttcaattgcttattgttcattaacttgttataaatcagaaagccatactcatgataatcttccgacagtaaccgacacaacatctcaaccaccacaacaacaacagcaaaccactactaccactactaccacccctggggatgacaaatttctgaaattattacaagatgatcaaattaaatatttattaaatcaaccaagtttacaatttcatttactttcaatcatcaaaattttaattgatcccactttcactcctaaaaatagcaatattgaacaaaaattagatattgcaaatttaaaactcaatgatttaagaattggtggaattgaacaaaatgaattagttgaagaatttgttcaaagatgtcttgaattgatgaattga

SEQ ID NO: 153 - DNA, 1872 bp, Candida albicans
aaaaaaatacaagatgcaaatcatatatttttctttgctaaactaggcatgatggtagggcaagcagagcttacgcgtgaatcacacaagctgattcaagagttgattgcagtttcgttatactgtattagttacttgagagatctttttccagaaaatcactattccgattacaagtactatgatacaacagagccaacatcagattccaattttattttgaccaaaaaattacagggaaacgataatgctgaaataaatatgttcatcaactatattgagaaaggtatcaatgacgctatcaagttggaatacctaaaaggtgtactgtttgaaatattcttatcaaaggaacatccgcagttgatttgtgaaagttatttgtttacaatcaactacctgaggcaagaagtctcaataaatgatgaaacatcgttcagagcaactaaaactactataatccaaagtattcagggaatcgtcaaaagattgattttgctaacgcaaacgtttgacagactaccagacgaaaaatattttgcaataaggttgttattcaacgagtcctgtccagttcggtatcaaccaccatattttcaagatgctacttatgcaaaacccagttcaataactgttaatcaaggatatattgggttagaaatcagtcaaatgaatgcttacaacaactgtgtcaaaatgaatattttggttgaaacctgtaaattggaaaactgccatagtattgatccatttgacttagttgacaaacaaattgaccaatttgaagctgttccatcatgtaacattgatttggatgaatatttagacgatccaaatatgacagaggtgcaaagtcagaagcaaaagacaaacacatttgaggttaccaattgtcgaaagtgtaacattagtatttattcagttgcctatggctataataagccaatcaaaaattccatcacttgcttcaaatgtttattgaaaaataaatttgacaacgatttgagcatcttaatgagcataagattattatggcacttttttatgatgaatgaatttccatcatttgaaaagtcgctagaattgatacatttggttcatactggatcagttgtgcatgttttcaacaaaatgtttagtgacaaaatacttgttgtcacaaataaagcaatgttcggtcccaattctgtagattttatttccggaagtggaagctttatcccaacggtagaaggtattatcgccaatgatggtaaacaactacagaaacattccgaatattttgtttcctttgttcccagaatgtgcacaatcccgtcgttttttgcatataataagaaactagattctgtttatttcccgaattatttagttcaacgagctgattttgtattgagcaacttgcaaaaatttaaagcaggtagctttggcaagcgcattgtgggatcatcatcgtcatcgtcactacaggtaacgaagccaaactcaaaatctggtgccatttgcaagttaaaaagtggtggccgtggccgtggccgtccatcattggtttcctctctgtttaagccaagtttgcatccaagtggatctatttattctcagtccaatagcataattgaaagtactaatgatatgacaccgttgcaactaaaggaagagagttccccaacaactgtagttgagtgctccacacaaaatatttccgaaacccttgacgatttatcttttgaagaatcattacagtatttgtctcagtcactggaacttcaaattgtcaagtgcaaacaacagcagcaacaagaacaacagtactatcccccaaatttttaccagaataagataagtagggcaagaaaacaaacttatatttga

SEQ ID NO: 154 - DNA, 279 bp, Candida albicans
tgcaagaactttacatgttgcaagcaccgtcattatctacgcaacattataattaactcttcatttgaacacctcaataaattattaatatcagctgacaacaagacaattggctatcctgatttcatgctattgaccccattactacatatatttttagttcatagtctttatggtttgctttgtttctttaatcgcattgataattcaatatttgtgttacaagaaggacccctcgtaactccagacttgacaaaattccagcgcgtttcttcgtag

SEQ ID NO: 155 - DNA, 1068 bp, Candida albicans
tatataataacgaaaaaaaaaacacctttaataatcacaatgtccgctgctgtttcaactttatccgatatcatcaaacgtaatgatgctgttaacgtgaacccaccaaacccaattattgatttacatatcactgaacatggtactgattggctttgggctgttttttcagtttttgcattatttgcaattgtgcatggattcatttacagttttactgacgttagaaaatctggtttgaagagagctttattgactatcccattatttaatagtgctgtttttgcctttgcttactatacttatgcttctaacttgggctatacttggattttgacagaattcaaccatgctggtactggttttagacaaatcttttatgcaaaatttgttgcttggttcttgggttggccattagtgttggctattttccaaattatcaccaataccagctttactactactgaagatgagtctgatttgcttaagaaattcatttctttgtttgaagctttgtttactagagttttggcaattgaagttttcgtcttgggtttattgattggtgctttaattgaatctacttacaaatggggttatttcacttttgctgttgtgttccaattgtttgctatttatttagtcattaatgatgtggttgtttcatttggttcatcttctcattcagtctttggcaatgctcttatccttgcttttgttattgtttggattttgtacccagttgcttggggtttgagtgaaggtggtaatgttattcaaccagattcagaagcagtgttctatggtattttggatttgatcacttttggtgttattccaattatcttgacttggattgccattaataacgttgatgaagaattcttcaccaaaatatggcatttccatttgaaaccagaaaatgaacatgctccaactgctactgaagatgttgaaaaagctgtttggttaaacccccaagaacttctgggtgataccgctggttgctcccttcaggtttttccagaacactggttgttggctccaggccccaagcccgaaggctga

SEQ ID NO: 156 - DNA, 993 bp, Candida albicans
tttaacatctcgagatatttcttcctcaacaacctcattaacagtttctatatttatattcgtttttgtatgattatgaatatgactactgattatagagatccattactcgatttgtttggtacagagtctaactctggcaatgaaacatcatctcccagtgacattccagttatcaacagaagtggcacatttaatcatcaacaatttagccccttgttaacccaacaactgttatacaatacacctaactctggatctactccgaatatttttgacccaaactatacccagatgcatgaggaacaaacatctccatctctgaacaaacttcaaccagaagatcccccaataaagaaaatgaacactataagtcagacaaagatacaccaacaactggaaggagatgaatacaactcaaatgataacaaagatctgatagatttagacaaaccaccagttgttgaaccaagtcctccgttttttgttgaaagtgacactacccctgaatttgtgattccaacacctaccctggaacaacaacagcaacaacatcacgagttaatcgcacaagactaccaacgttccaataattcaaatcaatttggaaacttgacccattatgaaccaaatcttcctccattacctcctttatcagagagtatacttccacagacaaacactttccatccattagtgttgccacatgacccaagacacgctattactgctggcccagctaataacagtcaacaacaacaacaacaacagcaagactcactgataccatcagatggtatttcttccaagatacaacaacttcatgcaccttcattgtcaaacaatcaatcagcatctcaacgtaaaaagaaagaaagttctgggcccaaaacacgtcctgcatttgttatgaaaatctggtcgatggtgaacgatcctgccaatcatgaatatatcagttcttcacccacggggctggaaggacccgcgcta

SEQ ID NO: 157 - DNA, 858 bp, Candida albicans
gcaagcttggtccttccagcccgctgtgaggactctttagacagttcaatagggttaaattcaacccaaaaaattctccagtggtcttgtatatcattatcaattgctatttttaccggggttaccagttatttatcagaatttattctaaattattgtggtgaaaattggatagtatctctacgacaattaacttttttcaaattgaataatcaagatttgtcattcttcactggatttgatactaattggagttcactggaaataacggccttactcatgaatgacaccagggacttgaggaatttaatctctcaattcttccctttattagccaatttggtgtcaatgacattaatcggaataatctggtcaattgtatctggttggaaattggcattagtggggatttcatttgttccgttagtacttttggttactgttctttatgggaaaatattagaatcaattgaaaataaatataaatgcaaagtgaataatgtcgagctagatctatatcgaaccataaccacaataagaactataaaaattttcaatatccaacaatattttgaaaccgttttcaaagaagatttgaaagttttaaattccattggtgtttatcgagcattgcaaactggtattggatttgcaatttctgatttgttttcatctattggtcaagcaataattttattttatggcatgaaactaattagtcaatttcaatataattattctcaattattacaagtaatcacgttgttaagttttacgatcagcaatgcatcaatattaattcatcaattgccagaaattacaagaggtcaaagagcgtcttcaccacgggatagaaga

SEQ ID NO: 158 - DNA, 348 bp, Candida albicans
aaactaacgcaaggtcttattgaaaaagtgaaaaaatggagaattggcaaaacaactatttttattactcatgaatataagaacatacttgatgatgaaaatgtcattatcttggatcaaggaatgatcaaaaaccaaggacagtttaaaaagatgaagaatgaagaaattgtccagaattacaaatctcagggtattgaaacttcctcatatgaaaccactagtcaaagtttctctgataatacaaagctaccggatggcgattacaactataaaaccaacccttatattcttaaggatttagaatcccaatcttcaccacgggcctgccaggatccgagcttaggt

SEQ ID NO: 159 - DNA, 204 bp, Candida albicans
agcggtggtattctgtgtccccggggaacaatcgagattgatacggtctcaattgataaattagaccccaaatatatatgtccagatatcactttacttgaacaaaatccagtgatatttgatgataagacaattgcagaaaatattgctattgatatagttgatgattacgatagtttgcaggcatacctattatttgaatga

SEQ ID NO: 160 - DNA, 498 bp, Candida albicans
ccccctcccatgcggatcggtctgtccctaggtgaagactgggtacggatgttcacatggcttaaatttggtgaaatccaacaatcaagagcaagaatgcaaatttacaataaaattattaacgagtcacaatcatggtatgattcaaagcaaaacctaattgggcaattgacacaaatcaatcgatgtattgaagaattgagatcttgtaatggtgaaattttggctagtttgatgcaaaccatagtattgattttggcacttttaataatgtctttttaccaatcgtggagtaccactttgataataatggcaagtttccccattatggcactttgtggttggtattttggtaaactcacctataaagctcaacaggatgagaatgaagttacatcaaaagctagtaaagttttcaactggtgttatgttaatccagaaatggttagattcttcaatagtaaaaatattgaattaactaaattcaaacagttaatt

SEQ ID NO: 161 - DNA, 417 bp, Candida albicans
ttcttttgtttctattcttttaaattaattgaatattgttcttctttcttcttactctattgcaactatcaagagactattattataaaaactatgtttcaagaaaaatctgaaaaactgtctttccccaaaagatcttcatctttgagatcaccatcagattcaccggctattacttcaaaaaatgtttttatgtttgttaattattctaaagattggccattgattcttgtgggtattttacttatgggtggttcagcaattgccacaccaatgaatacatatatttacggggaaataatgggtaaactttcacaattttatttgcaggatcagtcaaatcattcttttagtcaagatatagtaaaattatgtgttggtttaataggtattggatgttgtaaaatgatattagta

SEQ ID NO: 162 - DNA, 777 bp, Candida albicans
agcgggatctacatgcccgtggtcaagacaggtatatcaacaattttgaaaatcttgttcaggttatatgatatcaagatttctccagattcaaatactaccaagaaatatcatgatcaaactgttaaaattttcaatcagaatttatatctcatcaacagcggtttattatgtcaaacaattgccatagtaccccaatttccaaaatttttcagtggtacaatatatgataatttaacttatggaatcaataacacgaatagtgctggtagtaatagctcatcttcagtttccgattctgaaattattaaaatattgaaattggttaatctccatcaatttatagtctcattaccacaaggattattaaccatcatgaatgatagtgacaacgataatgataacggcaatgaaaatgaaaatgaaaatgaaaatggcaacacgatactgacatcatcatcaacgtcctttactttttcaggtggacagttacaactacttgccatagccagagcattgttgcgtaaccctaaaatattactcctcgacgaatgcacatcaaacctagatccaataactactaaaatcatcattaacgtgataaaatccttacatggaaaattgacaatactatttgtcactcacgacaaagagttaatgcgtattgccgataatttgatagtaatgaaagatggtcaaatagtggaacaaggtgattttcaacaattaatatccaacgacggagagtttaccaaaattacaaagactataatataa

SEQ ID NO: 163 - DNA, 759 bp, Candida albicans
agactttgtgaaaataaacaattccctacttttgttttgaagaaattatcgtttgccattttatctgggttgacttatttatataccactcataaaatcattcatcgtgacatcaaaccaaataacgtgttaatgactcataaaggggagtttaaattgtgtgattttggtgtatctcgagaattgaccaattcattggccatggccgacacttttgtcggtacttctatgtacatgtctccagaaagaattcaagggttggactacggagtcaagtcagatgtctggtcaacaggattaatgttgatagaacttgccagtggcgtgccagtatggtcggaggatgataacaataatgacgacgatgaggatgacgaagacgatgcctatgttaggcaaggatctatagcagcagaaagaaacgggcaaaatagtccaagcagaagcagaaagaataaacaaaaaggaaatggttacaattcatataatggaccagaaggtatattagatctattacaaagaatagtcaatgaagatgcccctacattgacaaacaaaatcaatcctgtgacaaagttgccatatgacaaatatttgtgtcaatttattgatttgtgtttgattaaagatgattcagtacgaaagactccttggcaattacttgaagacaaagaacattttttcaaaggggtcgaagaaggtgtttatgacaaagaacacaagagctgggcgaaaaagatcagaaaatgcaaagtgtaa

SEQ ID NO: 164 - DNA, 669 bp, Candida albicans
agaaagaaaggtgaagaaagtgttgagcaaggagaaaacaaagttaaagccacactcgatgatgtgaacataaagactgggaaagtcttggctgacggtatccagaaaacacaagacacagttgacgatgtgggtataggagctgaagatattaagaaaggcgccgaggcaattaaccagaaaacaggaaaggttttagctgacggtattcaaaaagcccaagacgcagttgaagatgtggatgttagtgctgaaagcatcaagaaaggtgctgaagcagtcaaccagaaaacaggaaaaatcttatcagatggtatccagaaggctcaagaagtagttgatgatgtggatatcagtgctgaagatattaaaaaaggggctgagaaagtcaaccaaaagacaggtgaagttttatctgatggtatcaaaaaagctcaagacgtagctgaggatgttgatgctggtgcgaaagacatcaagaaaggagctgaagcagctaacaaaaaagcaggaaaagtcttagcagatggtattcaagatgctgaagatcttagtgaacgtgtacaagcaagacatgaagttaaagaaaacaccaaaggctacgctaatttagaagacaaaggaagaaaagttccagttgaacagaatagaccagaagatttgatgtag

SEQ ID NO: 165 - DNA, 420 bp, Candida albicans
ccaaggatggaccttccagcccggcggttgaagactacaactccgactatttcaagtgcttctaccactccagttatttcaagtgcttctaccacctcagttatttcaagtgcttctaccacctcagttatttcaaatgctatatctaatccagctagtacagatgttaagcctacaacaagtagtcaaggtactaagtccacctcaattgatacagactctaaatctacttcagaaaccaccgtcatggtttacaccactaaaagtgttggtccaactacagttgaatcaatttctgttgctgtatcatctgctgctcaatcaagtattgctgctatttcttcatatgaaggtaccggtaacaacatgaaattgtcatttggtgtcgtaattgctggtgtcgctgcctatgaaatttaa

SEQ ID NO: 166 - DNA, 909 bp, Candida albicans
  unsure (56),(872): Identity of nucleotide sequences at the above locations are unknown.
attattccggctacctcaggaaaattccaatttttaatccaacccaaccacactgnttcaaaacattcaacttccaattcatcggtttccgttacaacttcccaacattcaactcatgataatccctccaattcttgtgtaccacccccagcatcttcaactagtagtgacaccaccagcaacaagtgtcacaagccatcaaaaactgttgttacttggacttcatgctcaaacaatgcatgtagccaatctgaaatcacaactggtgctattgttgtcactgataaagacacggtttatactacttactgtcctcttaccgatacagaaacagacacagaaagtactaccgctaccacttcaacacactcaactcacaccactacttccaagcactccagtgttgagtctacgtctgtcactagttcttctacacattcagtttctaagtctaccgatgttaccacttccacacactcatcttctgaatcaagtcatgctaccaccatgacacattctacttccaagcattcaactcatgccacgacctcaaaacattccactaccgagtcaacttcaggcattacttctaagcactcaacacatgctacttcatcaaaatattctactgttgagtcatcgtcaagttttgcttcaacttcggagtcatcagttccagttagtagtctgaaatcaactacctttgaatcttcaatctcaaccactacttcaaaacatttaactttgaagtcatcgacaccagccagtactttagagtattctacttccatacctccagctccagctaccacttcgaattctttatctactaaatccaccactttgactactatttctaggtcatctacttntggttttcacacacggggcctggaaggagccgcgaat

SEQ ID NO: 167 - DNA, 564 bp, Candida albicans
acgtggatttgcctcgggctggtgaggacagctactgaaggtgctccagtggctccagaatcatctgcaccaggtactgaaaccgcaccagctaccgaatcagctcctgccactgaaagttctccagttgctccaggtactgaatcttccccagttgccccagaatcatcagcaccagctactgaatcagcaccagccaccgaatcttccccagttgctccaggtactgaaaccactccagctactccaggtgctgaatcaactccagttgctccagttgccccagaatcatcagctccagctgttgaatcttctccagttgctccaggtgtcgaaactactccagttgcaccagttgctccttctaccactgcaaaaactagtgctctcgtctctacgactgagggtactattccaactacattagaatctgttcctgccattcaaccatctgctaactcctcatacactattgcttcagtctcttcattcgaaggtgctggtaacaacatgagattaacttatggtgctgctattattggtcttgctgcattcttgatctaa

SEQ ID NO: 168 - DNA, 396 bp, Candida albicans
tcactcgcttttagtttcgtcaatatgagattatcaactgctcaacttattgctatcgcttattacatgttatcaattggggccactgtcccacaggtagacggtcaaggtgaaacagaggaagctcttattcaaaagagatcttatgattactatcaagaaccatgtgatgattacccacaacaacaacaacaacaagagccttgtgattacccacaacaacaacagcaggaagaaccttgtgattacccacaacaacaaccacaagagccatgtgactatccacaacagccacaagaaccttgtgattacccacaacaaccacaagaaccttgtgactacccacaacaaccacaagaaccttgcgacaattcacctcaaccgacctgcgccgtg

SEQ ID NO: 169 - DNA, 195 bp, Candida albicans
cagttccgttttctttcacgtcaacttcaaacaacaattatgaaattccttcaaaaatttataatcacagttgctttgttaacaaacattgtttttgccattgacattactgagaataaaattgatcgtggctctgtcactttaagttttggagagattatcattcacccaggcgcatcttggtctataattgga

SEQ ID NO: 170 - DNA, 873 bp, Candida albicans
ccaataatggtcaaatctgttttgaataacgaagtttaccaccagaccaccagcatcaatggttctggttgtttcactgccaatcgtgactcgacaatatatattgccaatgtattgttaccagtttccacatcgcaaaatttttatttggctgacagccaatcttccataattgttcaagctattttaacccctcaagtgttcaatgtctatgggtttggtaatggtaatatggtcggggttactcttccgttgcttggtaatatattgaatccagcatatagttataatccatccacaggtattttaagattgagaaatcttttggtgtatcaagattttaatattggtcctggttataatcctagtttatttctgatcgttactgacaatggtgctggtcttccctcaacaatactcggttcggtttcttatagtggtcctgttccaccaagagctttacccgcatcttgtaagattgcttgtaaacccgtgcctaccgcgccaggaactaatccaaccgagtacacgaccacaataacaacaacaaattctgctggtaagccattgacagaaactggtgtggttgatattctgactgatagtaacggatcatggttctcaagtactacaatctttccaacttcgtcgtcaagtagtagcagtagcagcactgtatcttcaactgctccgtcatcctcaagcaccaaaccttcatccagtagccaaccatcttctactccaccaccatcttcaagtagtaaagcatcatcaactactccaagctctagtagtcaatcgtcttcaactactccaagctcaagcagtaagccttcctcaactgtaccaccaactggcagcagtcagtcatct

SEQ ID NO: 171 - DNA, 2139 bp, Candida albicans
agcgttggtcctgccagcggcttggtgcaaaacgtcaatcatcaagggcctcgacaactagagttttcgtctactattccaagctcaattcaccaacaatccttatctattcaatcaccaagtagtcaagagtcttcggtgtctctgactccaactagcagcttgcaatcttcaactaataccatatcaagtagtcaagactcttcctcattctcaccaacaactagtgatgattcgtcaattaactcgccttcatcattatctgattcatcaactagtaatgtatcatcaactgataatactgaatctagtgttgcatccgcaccaccaacagattcagcaatttctgctacttcatctgatatcactattgaattcacatccacctgggaagtcaccaacagtgatggttctgtttccactgagtctggtattgttagcgaatctggttcctcattgacaaccttgactacatttgctacatctggtgctggtcaatctgaattcacatccacctgggaagtcaccaacagtgatggatctgtttccactgagtctggtattgttagcaaatctggttcctcattgacaaccttgactacatttgctacatctggtgctggtcaatctgaattcacatccacttgggaagtcaccaacagtgatggatctgtttccactgagtctggtattgttagcaaatctggttcctcattcaccacgatcactactttcccaccatcatcctcatctagtgttgttgccggtgttactaccgaattcacatccacctgggaagtcaccaacagtgatggttctgtttccactgagtctggtattgttagcgaatctggttcctcattgacaaccttgactacatttgctacatctggtgctggtcaatctgaattcacatccacttgggaagtcaccaacagtgatggttctgtttccactgagtctggtattgttagcgaatctggttcctcattcaccacgatcactactttcccaccatcatcctcatctagtgttgttgccggtgttactaccgaattcacatccacctgggaagtcaccaacagtgatggttctgttttcactgagtctggtattattagtcaatcaggtacatcaatcgctacgttgacaactttcccagaaccagctggtacagtatatcctgtgaccactttattcaccacagagtatgtcactacttgtcctaatggagaattgtctactgctacaggtgtagttgtggttagtacggattctaaaggtattgaacaaaccgttacatcagttgtcccatctactgtgtatactaaagaaacagtgacttctataataactcattgtatcaagaataagtgttttgaaagtaccacaactttggtgagttcagttccctgtccgactcaagtaccaggtgtttttacgtctactgataatggccatggggtacctatcgctagtatagatgttactactggggctgctactgtttctaatacaattaaggctcaagattctactggttttactagtgctggtaatgcaatcacaactgctataactgctactggtgcagtaactacttctgttggtggtcaaggttctactgattattcaaatgctggtaatactatagctgcaggttctggctctgactctggttctggttctggttctggttctggttctggttctagttctaatactgtcggcattgttaatcctaaggtttcttctgctgcctctggtattactgttgctgctgcttctgcttctgctggacaatcatggccatattcttctggtggttctggaaatggtgtattgcctctgggtgcaaacaatgttggttcaaatcaaacaccaactgtaagtggaggtaatagtaatccaagcacagtaactggtgctgctgtcggtgttggtggtgttgttagtggttctccttcgtattctggcaacagtcttttgatttcatttgtttcaagtcaatccggagctatttccagttctacaggagtaacaattcctattgccacagaaaatagtggatctaaattttcagtgggcaaatctgcgtttattgctatcattttgacaactttcattggatttatttaa

SEQ ID NO: 172 - DNA, 1485 bp, Candida albicans
  unsure (21): Identity of nucleotide sequences at the above locations are unknown.
ttgaagatgttattgaaacanatattcttgccatttttcgtattattcaatgcaattaatgctattgacatttaccaaaatcaagtttcaagaggtactattgatctctcaattggtgccatcaccattcactcaggtgcttactggtctatcattgacaatgctatttccgctttggttggtactttaacggtgcaacaagatgctgggttttatattactggacttaatccctttcttggattacaagttgaattattaggagttttgaactcaatcaaaaacgacggtattgttagttttaatgggttgaacagtttggttggtccaatttataaccttgttggtcttagtttccaaaataatggtgaattctatttgagtgccctgggggttgctcctccagttttttcaatcactgctgctgattggcataacaatggtttattagttcttgctcaagccaaaagaacatcagctttagctaatcttggtttccctactggttctattgaaaatcaaggttctatttgtttatttggtaccgcctaccaacagcttacttccatcactggtagcggttgtatttccgctgatagagattccacaatctatattttcagttcacttttgccaattgccactacccaaacattatatttagctgatcgcgcctcctcaattgttattcaacctgtgactttgcctgctacatacacagtcagaggatttgggaatggtaacaaggttggtatctcacttccattgcttagtgttccacttcttggtcaacctgcttactcctatgacccatcttctggggttcttactttgagaggattaggtgttggattgctttcacaaagattccaaattggtactggttatgattcaagtttgtttgaaattgttactgatgatggtgctggtctcccaactactttgttaggttctgttagatacaatggacctgttccaaataatgcagttccagcctcatgtaactgtaaatacgtcccaccatccccaggaaccgacgaatcatctagtctttccagttcaactagtgaacaatcatcaagcagtgctacttctgtatcagcttcagaaactagtgatacctcatctactcaagagtcatccttatcaagtgaagtatcttctacccaagagccatcctcatctactccagaaccatcttcatcaagtgagacatcttctactcaagagtcgtcatctactgaaggtccgtcgtcatctactgattcctcaactgaagcttcttctagtgaatcatcaactgcaccatcatcatctgctgaggcctcttcttctaccgagtcttcaactgaggaaccatcatcatctactgagggaccttcatcttcacaagaatcatcctcaagtgaagaatcatctactcaagaaccatcatcttctaccaaagaatcatcttctaccgcaggtccatcttccactgaagat

SEQ ID NO: 173 - DNA, 1821 bp, Candida albicans
  unsure (1271),(1364): Identity of nucleotide sequences at the above locations are unknown.
tatcacccattgatttccggtgctaattggtcaatcattgataattcaatctcaacatttattggtaatttagatattaaatctaatgctggattatatatttccctgacaattctgaatttaccacttttagttcttttaaattctggttctgcttctattactaatgatgggattgtttctttagatgctcgtacttcaactcaaggttcttctcaatttaatttagttggtggttcatttgaaaataatggagaattttatcttgctgcttcaggagccattcctatgactatgggacttacaggtaaaagttggaataataatggattaattgttgcttatcaaaatgaaagaagttctggttctgttaaatttggagtcattggtcaaactattactaataaaggacaaatttgtttaactaatcaagtatatcaacaaactagtaaaattgatggatctggttgtgttactgctaaaaaaaatgctagtatttatatttcaaatgttcttgatccgcaatcagtttctactgaacaaaattattttttggctgatgacaaatcttcaatcataactcaagccgttggatttaatactcaagttatcaatgttttcggatttggtaatggtaataaaatcggtttaactttaccattaaaaagtggtaatggtggtcaagcttatagttatgattccgattctggtgttttatctttatcaagtggtttgtttggacaaaaatttaatattggtcctggttatgattctaaattgtttagtattgtcactgataatagtgaaggtatcccatcagttaataatggtgctgtttcttattctggtcctgttccaagtcaaaaatcattaccttcggcttgtaatgttgaatgtaaaccagttcctaatgcaccagatgatggctcttcttctagtagttctgttgtttcttctactaccagtactgccagtactgattcagcttcattgtcatcaacaagtggtgaagaatcttcagcttcaacaacaacaactgaatccagtgaaacttcaaacacctcatcaaatgcatctgaaacaaatggatcttctacagaatctgaaactactggatctgctacaacttctgaagcttcagacacaataaattcatctgaatcatctgaaacttcaggggcatctgagacttctcagtctactggaactagtgaatcaagtgaaactgaatcaagtgttactgaatcaagtgaaacggatagtataactgntataatttggaaaaaacttgtaggggtaatgataattcatcggttacttccagctcagacggttgtactgattccatcacttcagaaacagcntcatattcatctacccccttatatggggattcatctcaagtatcttctggaacaactggtacatcaccagataccatgcccagttcccaaacagactatacttcttctggttctggttctcttctggtttctccttcttctagtgttgtccaatcttctggtgttaccaatagtacaccaaatactggtgatgttaatactcaatctaatactgctaatatcgctacatctgataatactgctacatctaccgcttctaatgatactggtgttaatacagctacaactacaactactggtactggtactggtcctgacaacaacaacaacaacaataacaacaataacaacaataacaacaataacaacaataacaacaataacaacaataacaacactaacaacagtggtgtttctgcagctgattctaaagcaagtggtgatatttctactgtga

SEQ ID NO: 174 - DNA, 879 bp, Candida albicans
agtattctaaattttggttcgtatttttcaatcttttctaatcatcaaaaagtttttatcccaatgttgtttaagaactttcttttgctattcattgcaacagcaactactgtgtttgctagttatgatgtttctagctcattaatccattatcatgatttcaattttaatgttggtgatattgccattagaaatggtgcatcattttcattagttaatacttttgactgtcttttcaaaggtgatcttaccattgaagaaaaatccaagttatacatcacgtccactggtagagccttgatactccatattgctggtttattcaacaaagttaaaaatgacgggttattggttgtcaacactttagaatcccatgctgctgccatttgtaagatacttggtgcctcgtttgttaacactggtgacgctatctttgcattccaaggaagatttttaccacctatcattgcacttactgctcgacaatggcaaaattttggacgtatgcatttcttacaaaagtttccttctaaatctttagccatgttgggacattttggtggcacaattgaaaaccatggtaccctttgttttaccaatcagatttttaaacagttaactactattgatggtagagggtgtattgccttagaaaaaagctcgtcatttttcattgaaaattcattatttccaattgatagaagacaggtgatatacatgggtgaaggtaacccaagtattcaggctgttgttacaacattcccacaaacattcaaggttgccaactttggtggcaacggtgctcataaaattgggttgaacttacctttgagtatttcccacattcttcaccacggggctggcaggttccgcgcttag

SEQ ID NO: 175 - DNA, 855 bp, Candida albicans
tcaaagatgttattgtcaaaccttgttattcccttattagctaccagtgctactgtgtcagctacatttgatgtcacttcttcattaaccaaatatgctgcatttgattttggtgttggtgacatttccattcaaaagagtgcttcattttctttaatcaacacttttgattgtgctttccaaggtgatattaacatcgaaaaagattgtgagttccttattgcttctactgctaaagccttaaaacttacctttaacaacattttccacaagattgaaaacaagggtaaatggatcgttcacaccttagagtctgccgctgctagtacatgtaatattattgtcaagtcttttgtcaacactggtgaaatcattttggctttcaaaggtcacgttttggctccgatcattaacattgccgcttcccattgggtaaatcacggttgtttacatctttttcaagaaatcaaatcaatctctgtcgccattttgggtgttgttggtggcacaattgaaaaccatggtactatttgtttaaccaaccagctctgtaaacaagtaacaaaaattattggtagtgggtgtattgccttggaaaaatcttcttcattctttatttccaactcattcttgtcaattgatgctcaacatactttctacttgggtgaaggtaacccaactattcaagctcaagcagtgtcactcccacaaacattcaaggttgccaattttggtgctaatggttctcataaaattggtttgaacttgcctttgttgtctattactatttggggcccctgggaaaaaatgttggtcttacgacaccaaaactggtattttgacattgactgctaa

SEQ ID NO: 176 - DNA, 786 bp, Candida albicans
acttgcctttgttgtctattactatttggggcccctgggaaaaaatgttggtcttacgacaccaaaactggtattttgacattgactgctaatggattcatttcccaaaagtttgacattggtcttggttacgatccttctaagtttgaagtttgtactgacaattcagttggtattgtttccgttatcaaaggttctatcaaatacaatggtccatgtccacatgctggaagaccatcagtgtgtcaaatttgtccaggcgttccaactcctccagttattacatcaagtgccaccgctatcacaagcacccaatcaaaaactactagttcctcatccacttcaagtattgctactactagtactaccagtagtaaacctaagcctactactgtttctactagctctattgcttctacaactactccagatggatcttactccacctcattcgtcactgttactgctgaaaccactaaggttgttactatcacttcttgttctaacaatgcttgtcatccaacaactgctccaactggtcttactgtcgtcacacttactacttctgatgtcaaaactgttgtcactacttactgtccattgactcaaactgttactttgggtgttaccggtaccaagactgtcgatttgggttgcccaaccggttactttggttacaacgggtacattggtaaaggtgttagtatcggtcatggcggtgctgctgccagtgccagtgctggtttccaaattggatttgatatcttcaaaaatcaccacttttaa

SEQ ID NO: 177 - DNA, 798 bp, Candida albicans
gaagataagctgcggaatcggctacttccgtggcgtgatgacaaaaggatcaacggtgctggttgtttcactgccaatcgtaactcgacaatatatattgccaatgtattgttaccagtttccacatcgcaaaatttttatttggcagacagccaatcttccataattgttcaagctatttcaacccctcaagtgtttaatgtctatgggtttggtaacggtaatatggtcggggttactcttccattgatcggtaatatatggaatccagcatatagttataatccatccacaggtattttaagattgagaaatttttttgtgtatcaagattttaatattggtcctggttataatcctagtttatttctgattgttactgacgatggtgctggcattccctcgacaatacttggctcggtttcttatagtggtcctgttccaccaagagctttacctgcatcttgtaagattgcatgtaaacccgtgcctaccgctccaggaacaaatccaaccgagtacacgaccacattaacaacaacaaattctgctggtaagccattgacagaaactggtgtggttgatattctgactgataataacggatcatggttctcaagtactacaatctttccaacttcgtcgtcaagtagtagcagtagcagcactgtttcttcaactgctccgtcatcctcaagcaacaaaacttcatccaatagccaaccatcttctattccaacaacatcttcaagtaataaaacatcatccattactccaattcccagtaaccagttttct

SEQ ID NO: 178 - DNA, 696 bp, Candida albicans
gagacattgtgcttccatcgcctgttgaaaactggttctggttctaataatggttccggctccggttccggttcaactgaaggttctgaaggtggttctggttcaaatgaaggctctaaccatggttccaatgaaggatctggttctggttctggctctcaaactggttctggttccggctctaataatggctccggttcaggctcacaatccggctcaggctcaggctcacaatccggttctgaatctggttctaacagtggttccaatgaaggttctaacccaggtgctggtaacggatcaaacgaaggttcaggtcaaggttctggaaatggttctgaagctggttctggacaaggttctggtcctaacaacggttctggaagtggtcataacgatggctctggttctggatctaatcaaggttccaattcaggcgctggttctggttctggttccgaaagtggttctaacgcaggttcacactctggttctaatgaaggtgctaagacagactctattgaaggtttccatactgaatctaaacctggtttcaataccggtgttcacactgatgctactgccactggtaactctgttgctaatccagttactacttccacagaaagtgacaccaccatttcagttactgtttcaatcactagttatatgactggctttgatggaaaaccctaa

SEQ ID NO: 179 - DNA, 549 bp, Candida albicans
ccatttgtcttggcatttatagagatctacactcgtaccaatatatcattccaagtaatcacacgcctattatatgcacagttgatatattacacgaatgttgaagggtttatactcgtgaatactttccttcttagcattaaccataaaagtgaacaaataatagtacaacaattccttcttgaaattgctccagtaaccaaattcaatcaagattctaatgattctataaatactccaaagtattccagtttgttgaaaccaattgggcatcattcttctattatcaactacaatttcaagggtaataacaacatgaaagtggtatcaaactttatattcacaattttgcttactctcaacctcagtgctgcattagaagttgtcacaagcagaattgaccgtggtggaattcaaggtttccatggtgatgttaaagttcattctggtgctacttgggctattcttggtactattctttgttcctttccctggtgggtcagagttttcaccaaacgtgacccagaagcgcccgcgatatgctcgcca

SEQ ID NO: 180 - DNA, 1989 bp, Candida albicans
ctgaatactcccgaagacagatatgaacaattacaacaaactgcctctatacacaatgccaccattgattcaagtatttatggccgaccagactccatttctaccgacatgttgccttatcttagtgatgaattgaaaaaaccacctacggctttattatctgctgatcgtttgtttatggaacaagaagttagacatccgttaagatcaaactctgttttggttcacccaggggcaggagcagcaactaattcttcaatgttaccagagccagattttgaattaatcaattcacctgctagaaatgtgctgaacaacagtgataatgtcgccatcagtggtaatgctagtactattagtttcaaccaattggatatgaattttgatgaccaagctacaattggtcaaaaaatccaagagcaacctgcttcaaaatccgccaatactgttcgtggtgatgatgatggattggccagtgcacctgaaacaccaagaactcctaccaaaaaggagtccatatcaagcaagcctgccaagctttcttctgcctcccctagaaaatcaccaattaagattggttcaccagttcgagttattaagaaaaatggatcaattgctggcattgaaccaataccaaaagccactcacaaaccgaagaaatcattccaaggaaacgagatttcaaaccataaagtacgagatggtggaatttcaccaagctccggatcagagcatcaacagcataatcctagtatggtttctgttccttcacagtatactgatgctacttcaacggttccagatgaaaacaaagatgttcaacacaagcctcgtgaaaagcaaaagcatcaccatcgctatcatcatcatcatgataaacaaaaaactgatattccgggtgttgttgatgatgaaattcctgatgtaggattgcaagaacgaggaaaattattctttagagttttaggaattaagaatatcaatttacccgatattaatactcacaagggaagattcactttaacgttggataatggagtgcattgtgttactacaccagaatacaacatggacgaccataatgttgccataggtaaagaatttgagttgacagttgctgattcattagagtttattttaactttgaaggcatcatatgaaaaacctcgtggtacattagtagaagtgactgaaaagaaagttgtcaaatcaagaaatagattgagtcgattatttggattgaaagatattatcaccacgacaaagtttgtgcccactgaagtcaaagatacctgggctaataagtttgctcctgatggttcatttgctagatgttacattgatttacaacaatttgaagaccaaatcaccggtaaagcatcacagtttgatctcaattgttttaatgaatgggaaactatgagtaatggcaatcaaccaatgaaaagaggcaaaccttataagattgctcaattggaagttaaaatgttgtatgttccacgatcagatccaagagaaatattaccaaccagtattagatctgcatatgaaagcatcaatgaattaaacaatgaacagaataattactttgaaggttatttacatcaagaaggaggtgattgtccaatttttaagaaacgttttttcaaattaatgggtacttctttattggctcatagtgaaatatctcataaaactagagccaaaattaatttatcaaaagttgttgatttgatttatgttgataaagaaaacattgatcgttccaatcatcgaaatttcagtgatgtgttattgttggatcatgcattcaaaatcaaatttgctaatggtgagttgattgatttttgtgctcctaataaacacgaaatgaaaatatggattcaaaatttacaagaaattatctatagaaatcggttcagacgtcaaccatgggtaaatttgatgcttcaacaacaacaacaacaacaacaaagctcccaacagtaa

SEQ ID NO: 181 - DNA, 2781 bp, Candida albicans
tcttcaatttggtcaatagtcttttacttctccatctatccattcctccccaaaaaagataaaataaaaacaaaacaaaacaaaagtactaacaaattattgaaacttttaatttttaataaagaatcagtagatctattgttaaaagaaatgaactcaactccaagtaaattattaccgatagataaacattctcatttacaattacagcctcaatcgtcctcggcatcaatatttaattccccaacaaaaccattgaatttccccagaacaaattccaagccgagtttagatccaaattcaagctctgatacatacactagcgaacaagatcaagagaaagggaaagaagagaaaaaggacacaacctttcaaacatcttttgatagaaattttgatcttgataattcaatcgatatacaacaaacaattcaacatcagcaacaacagccacaacaacaacaacaactcccacaaaccgacaataatttaattgatgaattttcttttcaaacaccgatgacttcgactttagacctaaccaaacaaaatccaactgtggacaagataaatgaaaatcatgcaccaacttatataaatacctcccccaacaaatcaataatgaaaaaggcaactcctaaagcgtcacctaaaaaagttgcatttactgcaactaatcccgaaattcatcattatccagataatagagtcgaggaagaagatcaaagtcaacaaaaagaagattctgttgagccaccctcaatacaacatcaatggaaagacccttctcaattcaattattctgatgaagatacaaatgcttcagttccaccaacaccaccacttcatacgacgaaacctacttttgcgcaattattgaacaaaaacaacgaagtcaatctggaaccagaggcattgacagatatgaaattaaagcacgaaaatttcagcaatttatcattagatgaaaaagtcaatttatatcttagtcccactaataataacaatagtaagaatgtgtcagatatggatctgcatttacaaaacttgcaagacgcttcgaaaaacaaaactaatgaaaatattcacaatttgtcatttgctttaaaagcaccaaagaatgatattgaaaacccattaaactcattgactaacgcagatattctgttaagatcatctggatcatcacaatcgtcattacaatctttgagggatgacaatcgtgtcttagaatcaacgcctgggtcacctaagaaggttaatcctggattgtctttaaatgacggtataaaggggttctctgatgaggttgttgaatcattacttcctcgtgacttatctcgagacaaattagagactacaaaagaaaatgatgcaccagaacacaacaatgagaattttattgatgctaaatcgactaataccaataagggacaactcttagtatcatctgatgatcatttggactcttttgatagatcctataaccacactgaacaatcaattttgaatcttttgaatagtgcatcacaatcacaaatttcgttaaatgcattagaaaaacaaaagcaaatacaggaacaagaacaaacacaagcagcagagcctgaagaagaaacttcgtttagtgataatatcaaagttaaacaagagccaaagagcaatttggagtttgtcaaggttaccatcaagaaagaaccagttctggccacggaaataaaagctccaaaaagagaattttcaagtcgaatattaagaataaaaaatgaagatgaaattgccgaaccagctgatattcatcctaaaaaagaaaatgaagcaaacagtcatgtcgaagatactgatgcattgttgaagaaagcacttaatgatgatgaggaatctgacacgacccaaaactcaacgaaaatgtcaattcgttttcatattgatagtgattggaaattggaagacagcaatgatggcgatagagaagacaatgatgatatttctcgttttgagaaatcagacattttgaacgacgtatcacagacttctgatattattggtgacaaatatggaaactcatcaagtgaaataaccaccaaaacattagcacccccaagatcagacaacaatgacaaggagaattctaaatcttttgaagatccagctaataatgaatcatcgcaacaacaattggaggtaccgcatacaaaagaagatgatagcattttagccaactcgtccaatattgctccacctgaagaattgactttgcccgtagtggaagcaaatgattattcatcttttaatgacgtgaccaagacttttgatgcatactcaagctttgaagagtcattatctagagagcacgaaactgattcgaaaccaattaatttcatatcaatttggcataaacaagaaaagcagaagaaacatcaaattcataaagttccaactaaacagatcattgctagttatcaacaatacaaaaacgaacaagaatctcgtgttactagtgataaagtgaaaatcccaaatgccatacaatccaagaaattcaaagaggtaaatgtcatgtcaagaagagttgttagtccagacatggatgatttgaatgtatctcaatttttaccagaattatctgaagactctggatttaaggatttgaattttgccaactactccaataacaccaacagaccaagaagttttactccattgagcactaaaaatgtcttgtcgaatattgataacgatcctaatgttgttgaacctcctgaaccgaaatcatatgct

SEQ ID NO: 182 - DNA, 1170 bp, Candida albicans
ctgccactatattatttcattttccttatttatcttacaagtgcaaccatgtcattccaagaaattcctatcattgatttgcaagaggctttcgatccagccaccaggtcaaagtttttggaagaggtgcgggatgccataatcaatgtggggtttttgttattaaagaattatgaatctttaggacccacagaggaagacttacagtcaattaagcagcaagctattgagttttttgcgttaccagcaaaagaaaaacttcaatgtgaaatgctcaatagtccccattttttaggttacaccagattagccaatgaaataactgcatcacacactgattggagagaacaaatagatcttgccacagaattaccagcaccaaaagaaggtgagccattgtacaaaaatattgaaggacctaacttatggccaaatcctgaagtcattcctaaatttagacctaccattgaaagatttatagaaaagatgactgcattgagcaatgtctttaaagacttggttgctgaatctattggagttgatcccaaagcgttgaatagatatttcaaagaaaaccaacaatgtaaaatgaaattaattgcttatccagacgtttcagagttagatggaacaaaatctgccgctttagacgatacaccggaaactaaccaaggtgttgaacctcacagagactccgatttgataacctatatctaccaagctaccgagcaccagaactcgttgcaggttcaaaatttccaaggccattggataacagttcctaatattccaggtcacctagttgttaacaatggtcaaactttgcaagctattactggtggtgtggccaaggctacaatccatcgtgttttagtacccgaaaaaggaacagggacaagaatctcaattccgtttttccaaactattgatttggacagctcaaagggtgttgtagataatttgccccaagaggtgattgatttgaaaaatgaacgagacaaaaaaataaaagactggggggttgatactggattccaatttgagccggatgtgagcaaagaaccaattggccatgccgtttttagaaacagaatcaaatctcatcaagacgttgcaaaaaaatggtatccagatgttttgaaatctgttttacaagaatatacgcattag

SEQ ID NO: 183 - DNA, 4947 bp, Candida albicans
ataatggcgattggtaatatagcagctagatatctaagctcactcgaagagacagataccaccgcaaccaccaccaccaccaccacatctaatgttttacagccaagtaatagattgaactccccgacaaagttcaatagaaaaagtcttgacaataatagtcaagatttagatgctttggcaagagctttgaacattactccaagtaaaccggagactcctacttccatctcaaaaggctctgcaacatcactattaagaactaaatttgaatccccttctgctactgtctcgtcgttcaaatcaactagctcaagcaatggggtctcaccaactaagaaaaatcactttgtggaaatcacttctgatgaaactcctagttgggccaacaaaaactataaagacattttaaacaaatcaccaaccaaatttaatacccaatccaatgttcataccccattaaaacaattaaaccaaccaattggcaccccatcatcatcatcattatcaccagcaaaaaacgcctccaaaagctcacccggttatgaatatttatgccgaattgaagcaattaaacaatggttagaactggttttacaagaacaaatcactcaatctgcttctcaattgatatcttatattcgaaatgggatccaccttgctaaattagctaatgttgtcttacccacgtcgaaaccggtttttttaaatgatagtaaacttcagttcaagcataccgaaaatatcaatcgatttttccaattattagattttttcaatatgccagatttgtttcgattcgaattaaccgatttatacgacgccaagaatgtccctaaagtgtggttctgcttgcatgccttgagttatattttgcataaacaagatcctctgtatcctgcaatgaataatttggtaggcaaagttgatttcagtgccgacgacattcgaactgccaatcgagcactagttaattccccgttaccaaacttttctagtgctgatactggtgaaggaaaaagtgacactagcaataataatagcagtactacaagtgccactgctgcatttatggataaagtcacttcaccggttaagaaaacaccatctccattaaaaagaccacaacaattgcaaaagaaacagttagaattggtcgaagataataaaccagaattgacacaagattctagcggactctccaaaattagtagggatgacccctttactgaccgtgtggatttggctcctccttcaacatcaaatgcaaaattagaattacacactccaccatcaaaactgcttgaattcaaaatcaagctgccaataattgatctatctcatagagattctgactattataccccagagttggaaagtcatctccccaatattataaagtttcaatcgttggctagaggggctgttttcagatacttgatgtttgtggatagaatcttgttaaaatcataccaagacgagtttaccaatcttttcgcaataatacgtggtaataaagcgcgtcgcaaaactgttcacaaacatcgagatgaattgaggttatatagctttgaaattattgaattacaatcaataattaggaaaaactttgttatcaacaaaaaacccaatttcacttctatcaccaatgatgttgaaacagttgagttacaaagtttgattagaggtaaattaacaagagattggaaaaaatacgttaccaatggattggagaaattcactccccagattattgatttccaatcattggtcagaatgaaatcaatttattccaaatcaaataaagtaatttcttataaagacgaaattttgccatcactcattgaattacaatctattgcacgaagccaattataccatcgattctctcgatccaacgccattgatgaaacggaaattattaaaatccaatcaatcattagaagaaatgcagttattgaagacctttacaccaaactttccaaggttcgttctaataaacgtagattgatagagttgcaaagcattgctcgtggaggggttgctagaacaaagttatgcaacagtgttttggtcaccttaatttatgaagacgggatattgaatcagcttttcgccaagattagaggtgacaattaccgtaagaaattcaatagtcaaaaatcggagctattaaaatatgagaaatcatctatcataccagttcaaactttattcagaggagttctttcccgctataccaaagaggtcacactcagtgacatatttgatcaaattgacagtgtaatcactttgcaatctgttgctcgtgggaagttgatgagaggactgatttatgagtttagtgactactatcaaaagcacatcaagcaagttgttaaagcacaggcaattttgcaacgtgtttttgctcaaaatgcttacaaacagttgataactagtaaaaatcctccccttaaggttattagaagatttgctccattattgtcaaacaatgaccgtgattttcaagacgaaatgactttatctgatttgaaggatttgattattgaaaagtgtaaagccaatgaagagtatgaaaatcagattgagcaacttgatatgaagcttgggttgttagacaagaataaaatcagcattgaggaattcctcaaaccaacaaagggtaaaactttcaagcctattgtggaaaatgtgaaaaatttggaacgattgaataaatcattgaagaagaaaattgaattgtggcaaacactcttttattttattcaaaccaatcccatttatttgacaaaattgtttaattccattccatatactaaaaatcagacaaaatctggtcaagatttgttccagtctgtgattcaattattcccagtaagagattcatcaattacttatcattctcgtgaagagtactttttggtcaaacttatgatccagttgatgcaaaatgatacagctaactcaaacaatttgggtgacatcaccaagttgcatttgacaaactggatagatttctttactaatttcaataatcatacattccagagacaacacttgaaagcacttttgggcaagtttgttatacgtattgttgataatgaacaagtggattttgaatcagatccaatcagaatctacaatcaaatcattgatcatgagatgaaagtttatggtcgtagtgaaaagtctcgtgatatttcaccacaggcagctattcagttgccagaagttagtaataagtttgtgggcaatttgatgtcattaagggagacttgcagtgatttgctttcaatgttacaaaaaaatgcttctggaaataaagccttgttgcaaatccctgaccatgtgaaattgatttgtcgtcaaggttatttatgtgctcaaagaaagttccccgacaaatctgatcaacaacatttagccgttgctggggttatatttgtgaaacactatcttggatctattttgcaagtaccagagaactatggaattttgactggtaacaatgatacccagaaagctaaaagcaaagacaatttgcgatacttgtatcgtgttatgttgcaattgttttcaatgaaaccatttaatgacaattttttgaaaccattgaatgagtacattatggcaagtaccgacaccgttaagtcaatcattagtcaggcaattattaatgtgggtgaaattgaaaccgtgtatgaattacatgattatgatgatcttgtgactcatcagagacctaagttgactatcagtgtaaactcattgattcaattagagaaatccatcttgcaaaatgtcgatattattacaacaggcaatgatgatcaattgtacaaaacatgcgtcgaggtggaaaaattgttgatttccccacaagacatgttgacattgaccgatttgtcatcggttactttgaacttaaatcctaccacacaagaggagtctatagttgattcaaaaactaaaacattgttcacccaagccaaacgctgcttgttgtatatcattagagtgcaggaagaagacgacagtgatgatttattggaattattaatatcgggcatcaaaccaagccacgaacaaagattcaaggagattgttcaatatgaaaaagcggagcaagatatttccctcaacaacagcaagagtgttactgctaatactgtcaataaaaagaaatctaccagaccatattcgggtacatcattaggggacttgtcgaatttaacctatcatgaattgaaaaaaatgtgtttggagattattcttaagctagaatcaatgggggagttgactcgtaaaaactcatttcaaacattgctcaatcaaatagctatggacattaaaacaaaggattctcaaagacaatgccgttggcaacaattgcaagtttctcaaaaaactattaagaagttgtctgagaaggaaaactatttgaaaacgcaattgcacaactataacaaacacgttgaatcggtattattggaattacaatcaaaatcaaaatcaaatgataagaattggaaaagaaggctatttaatattatggtcatccccgttttcagcaaacaatatttctatcatcgtgaattgaggaaacataatcgcttacctaaatttggctcctataaatatctggccaaaaaattgatagatcaaaaagtccttattgatttttctactgccaacaatgttgctacagcatcaaagttggattttatgtttagttgtcatcaagttggtaaatttactattgaagttgcctcaggtacagtgaacattccaggtgctaccaacaccataactttagacgaattgttggcattgcagtatgagaacaaaactaaatttgaattgttcgatggtatggcaacgtttgattctaataattttatgggattgatatttagaaagttctatgatttgaagaaagaataa

SEQ ID NO: 184 - DNA, 1806 bp, Candida albicans
ttttattgtttcaatttcatttttcttcttcttctaccatccacattcatattcacatttcattactttctttcaatacctatattacggttcagtttaaaaaaaaaaaacctccatccaatgaacactggaagttcccaagattcaataccaattgacaatatttcgttgggtttgtcaacgtcaccattgaatactatatccagtggtggtagtgattcaaccattggtcatttgaatacgccaccaacatctagagctagatcaggatctttattttcaatttggaatgaacccagtgtcaatcataataataatgttagtcatagtcatgaaatggccacaagcacttcaagaaatcgttcttataccaccactgctgcccttcctagtattactatcgattcattttcggaatcattacagaaatcatctgctcctcgagtgtcaacatctccatttatttcggttccaaataatgacatgataatattggataattttcaaactaatcttcctcgattacgttcacaaaccatatctggtactccaataagttctcaaagcacattgccacacccttcagagtctttgaatgcccctcatcatttccctcaagtgtttgaaaccgtgtcactgaatccatcgtcggcttctatattaccatataatcaactgccgcaattgtttgatgatgttgatttcactcgttttttgattacaacaagttttgataatccaaacttgggtcccacaaaatacttgttgttcgataacttgccattaattattaatgctcacaaactatttggagtactttcaaattcattgaatccaaggatgggtaatattcatggaattagaattactactactaccacttcaaaattagcattggttgaatgtacaagtattgacactgccatgtcattgaaagctagttttaatcatttagaattagtaccaggaaatatcttatatgttgcatttgccaaagtcgatgatgtacaaaatattggtcaacaacgagttcaaccacaacattcacagcaattaccttcgcctgctcaaccattaccacaattacaacaacaacaacaacaacaaccaatgccgttaccacaattatctcccaatcacaatacgaaccataaccacaaccataaccacaaccacaaccaacagccacaacttgtgcaacacagcttaccggataagtcggaaaaacctgatccaactgatattttatcaatacaacagaatctcatgaattcaattggcaaattgtcttcaacagttgatgctaagaaaattgaatcacttatcaataaatgtattgcctactcaaatgatcaataccaaagcgattttggaccattaccagatccgatccccttacgacaatttgattcacctacattgcgtgatttgcgtaaagtattagaaaacaatgaagcacaattgattggtcaaaatgttgatggcggagaagttatgtcatcttttgaattagaagaattgtgtcttgcaatgcttgatgagttgccagaattgagttatgattatttgggtaacaccattgtacaaaaattgtttactttggttgaatcatcattggttaagttgatgatggtcaaagaaattgctccttatttaactcaattgggaatccataaaaatgggacatgggcaatacaaaaaattatcaatttatgtcattcagactaccaacagatgtttctcattggtgctaatcttaagccttatgcagttaaattgttaatgatcaatttggtaattatgtga

SEQ ID NO: 185 - DNA, 573 bp, Candida albicans
  unsure (9),(534): Identity of nucleotide sequences at the above locations are unknown.
ggagcgtgngtccttccagttgccgtgtgtgaaaagtcttgtgaaattagtgtagggagatttggtgctcgttgcattcgtactatattggaaagttgtcatgattcaagtagtacttctccggtgacaaatgaacaagttttattggtggcaggtttgattatagaattcgccaatgagttagctgtcaattccaatggatcgttattaattacttggtatttggacacttttaaagattgtgattcgaaaattgaattattaatgtcaaaatttttaccaaatataagggctctttgtgtgcataaattggccaacttgacggtattaaaaattttgaataatagaattgatgataaatcaagagtggcaacaatggatgctattttcaacaataaagaaactttggaatatattttacaagagagtgataatagtaatactactgctggtccactttttatctataaaattttgagcaatcctactttagccgatttggttaaccaacatatccccaccatacgtaaaatnttaatggaattgaatattgttaatttccaaaattataag

SEQ ID NO: 186 - DNA, 345 bp, Candida albicans
aatcagcgcaagtgcggtcgttcttgcggcgtggtgaagaccacggcaccatcaggaccacgtgaacaacttgaagaatttaaattgcttaaacggaaacttgaccttttatcacttcaatattcacaacatcaaattaaatccaatcaattagtatcattcagaactcaattagaaactcaatatcaagagagtttaattgttaaacaagaatttgatgaattaaatcaacaacccgcagaagaagatactagagaacaatttgaaggtgatgaacaaggttatagaatttataaattaattggaccagttttattaccacaagatcatgatgaaggcttgtaa

SEQ ID NO: 187 - DNA, 183 bp, Candida albicans
accatcccgatcaaatatttaattatccgttactcatttttttttattcaatacgcctttcacatcatgaacgttaactcagtcatatactacattttattcctttttgcatcaacaatccttgcggcagataaaacatccagttcagtatcacctactttagtatgggtcacaggtactgat

SEQ ID NO: 188 - DNA, 336 bp, Candida albicans
agcaacgtaattgattcttggaatgatactccagtagttaatacatgtgctactaaaccattgaatatttctgatgggagttgtgcctgttatattgttaaatctggagatgattgtgattcgatcgctacttcacatggtataagtgttgctgatttggttgattttaataataatggtcattcttataattgggagggttgtgataaacttgctataggtcaagggttatgtttatcagaaggtactcctccaaaacctgaatgtggtccttatgcacctggtgattggaaaactcctcctgaatgtccaaataaagcttgttgtagtaaatga

SEQ ID NO: 189 - DNA, 984 bp, Candida albicans
ggctactgtggacttacttctgatttttgtgagaaaagcactggatgtttttctaattgtggttatggtaatataccttctagaaaaccatcaaatttcaaaagagttgcatattggttagataatgataatggattgtattatcctattgaaaaaattgcttcatatgatttagttcattattcatttgcaactataaatgaagatatgactatttcggttggttctaattttagaaagtttttaaatattaatgcaaagaaaataattgcatttggtggatgggatttttctacttcatcatctacttataatttatttagaaccgcaatttcaagtggtagagtacaatttgccactaacttggttgaatttatggatgattacgatttagatggctttcattttgattgggaatatcctggacaaatagatatacctggtatacctgttgggtctaacgatgatggtgaaaattataatgaattatttaaattgttagctaaaaaagcacccaaaaagttaaaatctatagcattaccagcatcttattggtatttaaaaggatatccattaagtgatttagaaaagaatatggattattttgttttaatgaattatgattatgttggacaatgggattatggaaaaccaaatatgggtttaggatgtcataatgatagactgataacggaggaatctatcaaaatgatacagaaatctggtattggcactactaaagtatatggtggtttagcaaattatggtagatcttttaaattaaaagataagaagtgtaaatcttataattgtccctttgatgggccatcttcacctgttcctggtggatctataactactactcctggtttcttatcaatagctgaattaaacgatattaagtttagtgaaactcattttaattgtacatcaaagtgttctcatgctgttgtttcaccacggcgggcgaaggatccgacttag

SEQ ID NO: 190 - DNA, 1959 bp, Candida albicans
gcagctcggtatttccaccccgtgggcaagaaatcgacaatagaatttgggaaacaattgttacagttggggcttttgcaggaacatagtctaaactcgtacggaatggacgtcgtatacaataatacatcatcatcacaagaaatagtagacgaaaataataagttggtatttttgttaggggagcagttggaccacctatttgatccgttgttggaatacagcccagagacaatgaactttatttatacaccacaacaaacacaggtcccacaaacaaaattgatcacatctattgtgaacgaattagtgactgtgcagaccaactttacttcaaaactagtcgatttattacaaaacttgattacaccattgagagcaaacgtgttggattctccagatggtataacacgagtgaaccaggttttcccaccgacaatagacgaaataacgagaatcaattgcattttaaatgagtctttactaaaagcaaagtcaataaactacctagaagttctacgagcagttgcaaacattttgccttacttttacaaaccgtttgttagacacgaagcaaatttgaaaggattttatctgagattacgcaaattcgccactagcagcatacttgcaatcgctaagaaagaatactcggttcgggaaattgattctattgtgacaggatcattattagaactacctcgactcaaattgatcttgaagagactttatgatgcaatcgaatcggaaaaattaaagttgaaaaattttgaaaattttgacgaggatgaaacaatggtaaacaaatattatactgcagcaatggaagtaatagatgcatttggtggacatgatgaacaagttgacctcaagcaaagaatttttacccctacagggaaaattttgactgaactagctaccaactggccagctgagttgcactatgggtggctttcccgaaaagtcgttggcatattccaattggaacgtagtttagtggtcatctttaatgattatcttttattcctaaacataatcgacaacaacggctacatggaagaactgcacctaaaaaagatttccgtgtcagatgcacttatgcattcgttggtgaacgaaaaaccattgcccaatttgtcatgtttcccagcaatggaagtgtcttcctggtgcaatattaatgaagtcatagcaaccacatttgttgccccaactgacgacaacccaaaggacgatttcattcgatttttgagtacatcttcaactgggtttcagtccttgtcagctatcaaacaatttagtaaaacatatcatgttgaaaataacaaatcaaaaaccattattgaactcatcaacaaagctcgtcttttatataaatgctcacctttccatttgtttaaggcaaacgacagacatctaagcatttattacaccgctcatgaggataaagtatacgaaaatgaaatcagccagtcaccatttgtattgtttttaaatatgaagcttgacgttcctaggtattttgaaacttgtccaaatttgcaattgctattacaggcttcgtttgttggtgatgataaaatacagattacaggatacaataaacccagccaagaacaaatcaacgagtttgttagaccaaacgaattcctggactttttgaaacataaagtattcaattgcttcaacggtatttttctgacctataataaaatcacccgttgcttgattaaaggcaactcagctcaacttaagtttgttattgatgataacgccacgagtcgtagcgaagcaacaacgttggatgaagtaaaatttacacctaaacaaacttacaaacatgacaagtctttctcagagccaattacagttgtaaatgtgcctttggagaataaagtggacccaccattacgcagaagaaagtcattcttccaccacaggggtccaaatccgcgtgca

SEQ ID NO: 191 - DNA, 1149 bp, Candida albicans
tattccattaagatgataaccttgttaatatttatttttgcatttttgggaaatgtcttatgttacccacaagccattctttctcatcaaatatctcccaaagtgatgatagtatcaatgtttcagccagaggaagaggcatggacttcaaaagttgattttcaacacaacatcactgttccaggtttacatccattatatccaaatgttcattgtacttccaattttgatatttgtcaatttaccactggggaaggagaaataaatgctgccagttcaatagcatttttaatttcaaattcaaaatttgatttctcaaaaacttattggttgttagcaggaattggcggtggtgatcctgctaaagtaaccactggatcagtgacatttgcaaaatatgctatacaagttggtttacaatatcaaatagattctcgagaattaactaacacgaatcataaagaaggttggacttctggatattttagttatggaacaaaacatcctcaagattaccctgattcggtttatggtactgaagtttttgaagtgaatgagaaattaagagatagagccatggaattatctcgtaagaatgaaaaattgttaaaactcggtgatgacgataatgttagtttaagaaagttgtattcaagtcctgccaataaaatccccaccattttagcttgtgatgttttgactagtgataattattttaccggacatgttttgaacgattattttagtagttattcccagttgattaccaatagttcagcaaattattgttcgagtgcccaagaagaaaatgctactttggaatcgtttattagagttgccaaaaatggcttgattgattatgaaagaattgttattttgagaacaatttctaattttgttgccaaacctaaagatttatcaattgatccaattgagtttttcaatgaatatcctaaaggtggtattcaacatgcattggataatttgtatattggtggttggccatttgttgaagatgtcgtcaataattgggatagtttatacaaagatggtcaatattttagagcagagaattatttaggtgatatcttaaacactcttgacggtcaaggtaaagattttggtaaagattcttatcacatcagttga

SEQ ID NO: 192 - DNA, 906 bp, Candida albicans
  unsure (254): Identity of nucleotide sequences at the above locations are unknown.
gaaggaccgtattggatgattatggatgatgatgatgatgatgagggaaacctttggagaccaatatcgattattgccaccattaataaagaacctgaattggatgaattaaatataagtgatgttataaaacaaaatattgaactttcatccgatattttaatttgcggggataaagtggctccaggtgcattggctactgcttttgaaaaacttctgaagaatgacaaattaagaaagagttttttatcaanattttcaccatctgacgaaaaagattcaaataatactataaaaaaagaggatttattgctgctgaaagaaattacacctaaagctaataattcattactgataattgattcaaataaagatattttgacacaaattcaaaatcgatatcgtcaaaaatatgaaaaacttgcaattattaataaaattgaagaatctacattaaaagataaattgaacaattcaattgctttaactggagatacggaaagatttaaatttcgtcattggaaccaattactgatttattctgatactgctggaagatcagttagtcccacttcaacaactcgatctggggaatcagatgaatcagatgatgctgaacgtaaaatcagaagaggaaaattccgtcgttgtaaagtcccaatgagtgattctgaaagtaatagtagcagtggtgatattattaatggtgaaagaaatcagaatattgtaaaattcaatgaaattgaaaataatattgtggcaatcaatgatgaagaaaacccaaatttgacgaacctggaagatgataaggttgaggatgaggatagctgctgtgataatagtagtgatctgacgtttgaaattgataaatttgactttgatttaactagtatattcaaggaataa

SEQ ID NO: 193 - DNA, 1575 bp, Candida albicans
agaccatcgggtgatgctgctaatagttcgattttttcattagctatgaaaagtcggaaaagttccattagaaccgtcaataaagaatcatcaactcaatctaccgcttttacaaattcaagtaataattcagtggcaatccctggtataagtagttatgcattaaaagaattagcagcaattcctgatgaaactatgctttctactgaagatcctattcaatatgctttacataaattggaaggtaaatcatcgtcaaaactgactttaaaaagaaaagatgatgacgatgacgataatgatgacgatgatgatgacgagtatttaaaacaaccacacattgatgatgatacacaagatattttgaatgaaattaataatgccaatactgaagatgccattggacttagtaatactagtattgaaatatctcaagttgatccaccattgacaccaataagaatgagttgtagaaattcaaattcagatatgattgaatctgatcctataacttcaacaccacttaatagtcattaccttgagaacccaacaacagcaaaacccacattcaccattgttggtgataataatgtaattgatacatttgatttccaacaaccatcgatacccatgaattctacaacaccactttctttagaatatcaatcaccgaaaatcattttagataattattccctttcaagtgatttattatcggtactgaatgttttatttaatgatgctcatatatcatttgttttatcatatgattcacgatcattagctgatcatttcaccatgattgaaaaagatatgttacaagagattgattggaaagatttgattgaattaaaatggaataaagaattaactccagttaatagttggttagaaatcattgtgaatgatgattattatattgaaaacaagggggttaatttagttattgcaagatttaatttaatggtaaattggataatttcggaaattttattaactcaatcaccaaatgaaagaattcatttaatttcaagatttattcatattgctcaacattgtttagagttacaaaattttgctacattaatgcaaattattttagctttaacttctcaaagaattcaaaaattaaaacaaacttggaaagatttaattccgggtgatattttattattgaaaaatcttgaagaattggcttcacctttaaaaaatttcttaaatattagattaactattaatcaaattaaaccatctaaaggttgtataccatttgtgggattatatttaagtgatttaacgtttaatgctgaaagagcaagtataatcaaagaacacaaccacaatcttagtggtgatggtgatggtgatggagaaggagaaggagaaggagatacgttgattaattttgctaaatttagaacttcggttcatattgttaaatcattatctcaatgtattgaatggtcaagtaattataaatttgatattcaaccggatttattatcgaaatgtctttatatcaaaagtttggatgaagatgaaatgaaatattgtattcaacataatcaaaaatag

SEQ ID NO: 194 - DNA, 528 bp, Candida albicans
cctgggttacgccccgaaggtcgggaatatggaatcgccacaggggattctatgcaattcaaaaaggacaacaaaaacaaacacaacgactgggattctgatgacgaatttgaagacgaagtccctgaattgccagagataacggccaacaaaaaagtttccaacaccaaaatgaggaaaaagaaaggtgccatgactgacacgtcatcattttcaatgtcatcatctgcgttgttcagaactgaagggctcacattattagatgatagatatgaacagatgagcaaaaagtttgaacacgaaaatggtgagcaaccccacaaaccattcgacatgaaggaggaaagacacgatctagaagatatgttggacgatttcttggataattatgaattagaaagcgggggaagaaaactagccaaaaaggacagcgaaaagaaaaaattacagcaagctgccagctcagtgtctaaaggaaaagctgcaagaaaggtcaacgaagcatttagtaatatgaagatagaataa

SEQ ID NO: 195 - DNA, 693 bp, Candida albicans
tcccctatattaaattgtgtacaggttacacgcaccacagtattttgtgattttcgcgctgtgtcggcaccaagattgataccgaactcacacgaccgagttacgagaagtatttttactctttggcacttcatctcttttaatactttttactcaggaatattcaccatagtatcattatttagattgtttggattgaaaccagacatgactaaccaccaacaggaggaccctgcattatcatctacaaatgaatttaattcttcaagtggtgaagattcatcatctgattcttcctcctcgtcctcttctgaagaagaagaagaagacttgatgattactaaacccatttacatgtccaagactactaggaataaaaaaggttctctcaataatcagatcacgaatacaaatgaagaaaaaggacaattagaggaaaaaagtggtgataattcaagtgaacatactaataggaggaaacaaatcacaatatcaaaactcgatcatcaagtaattcaagatcctagtgataataaattggaatttgatggagttgatgatactgatgatattaatcctgaattagaatatgaaaattggaaaattagagaattgaatcgatttaaacgggatcaagatataattaaacaaattgaattagaaaaagaagatcaattacgtagaaacaattga

SEQ ID NO: 196 - DNA, 1518 bp, Candida albicans
  unsure (1047): Identity of nucleotide sequences at the above locations are unknown.
atcaaatacttaatatcaattatcaaaaaacttataaggacaatgtctaaagaagaatccaaagttattaaatctgcattaaaaggaagtgattccacaacaacaattaccactagttcttcttcttcttcttcttcttcatcatcatcaattcaatttagaatatttgttggatcttatgaacataatttattatgtttatcagtaatattagatccatcaaacattaaagacccaattttccaaccaattttccatttccaagctcattcattatctataaaatcaatggatttagctaaaagatatttagttactggatcaaatgatgaacatattagaatttatgatttacaaaaaagaaaagaattaggaactttattgagtcataatgggactattactagtttgaaattttccactgaagtctccacagaaaatcctcaaaatgaagacattagcagtcgtggtagtagcacttccagtagcagtacttccggttattcacaaaaaacggggaaatggttattatcaggatctgaagatgggaaaattataatttggagaactaaagattgggaaacttttggtatcttaaaaggtcatacgggtaaaattaatgatttagccattcatccaagtggtagagttgctatactggtttcacaagatcaaactattagattatggaatttaatgaccgctaaaaaagctgccattttaaaaataaaggggaaagatcatttaggtcaactgggagattttgttaaatggtcaccagattctaaaggatcattttttttaattggaatgttaaatcaaatattaatttataaaacttcaacggctaaaattattaaaaaaattaaaatatcaccaactttaatgtgtatggagattttaaaatttaataataaaaattggttagttgtcgggttaagtaatggtgttattgaattttatgattttaatgaaaaagtattagcggggataaatgaagaaaccaccacaacaactactactactacatctgatgttgatgatgangaaaaagaagaagataaagtgtgggattctaaacctgaacaattgatagctgattttacattaagaggtcatactaatcgtattaaaggaatatcatttattcaagataattcagaaactcatgatataccatatttagtatcagtttcatctgatggaagaattgttatttggaatttattattaaaagatcaaattgctgtttatgatactggtgaaagattaaattgtgtggttacaagtcctgaaggtattgaaaaactggatactatgaaaagaagatttacttcattaagtcaaatcactggaaagggagaaattgataataatgatatccctagtgaatctgaatatgaaactgatggtgaagaaattaaaaatataatgcaaggtgaaaagaataaaaagggtaagaaatcaaaaaagaataatattaaaaagaaaagaaaagttagtgtaacattagaataa

SEQ ID NO: 197 - DNA, 378 bp, Candida albicans
ttggtcgttggtgcactacaatcgttaattctttttttgtcagttcgaaaattttttcacctaacttatttgaaaaccctaataataacctcaataaccacaatgactacttccttatcaccagataaattcataggtgctaacttacacgtcaaattaagtgactgcagaattcttgaaggaatactcaccgtcattgatccattcggtaacttactcttgtcgaatgtgtatgaaacttcaattgacaaattaaatgacaaacaattacatgttagagaaattggtttagtcagtgtacctagagaaagcattgaaagtattaaaactggacaaaaaaacgcatacaaattatatttgggagtggcaacgacataa

SEQ ID NO: 198 - DNA, 942 bp, Candida albicans
tcaatatctgggatcattgatatgggttcggatttcccttttgaaatcaaacaagaattggatacttggaaaactagaggggtaatatatcgagaaaatcctcatcgattgactactcgtggtgtcaatatttatcaatacacagataataataataataaaagttttaatagatcaattgataacgaatcggaagtggaacctgagcaagatgcaattaggtattttgaatatgtgacaccaaaattaagaattgaaatcaatgatatcttggaatatcccaatttgaaacaaagttcaaattatcatttaatctgttcaattgaacgatgtaaatcattgatcgattcaattactcaatttaacccaacagctaagtttatttatgaaccattacctgatgattgtgtttttgaaaatttggaatttttacaaaatgatatattacccaaaattcatgtgttcacacctaatttgaatgaagcaaggttattattagggttaaaggataatgaaaatgaaacaaataaaagtgatgacaatgacgaattacaaaaaatatcgcaacaatttacaaatcatttacaattatcaaattcaggtacagtattacgatgtggagctcaaggttgctatataaatactaaatcaggcgacaaattccaattaccagcatatcatcaggatcaaactaaagtggttgatgtcactggtggtggaaattctttctgtggtgggtttatgatggcgtatcatttaagtgatggtgattggttagccagtggagttgcaggaattattagtagtggctgtataattgaaaaattgggtatgccaacagtttctgacgatagcaaatttaataataaatcattaagagatagactagatacatatttaactgaaaatccaacattaaaagttgatttcaattggatttaa

SEQ ID NO: 199 - DNA, 984 bp, Candida albicans
  unsure (909),(931),(939): Identity of nucleotide sequences at the above locations are unknown.
gacatagatctgcttgcggcgtgttgggacacaagtccatatgaggcatcgtttcaattgtcgtatttgtatcaatctggaatcattgatattgtatacggttcaacagatttgttacttactaaaattgataagtttattttgggaatggaattccaatcgaaagattttagatttgtcaataaaaataaagtactaaaagggttgaatttgagtgaacgacaatttcttgatttatgtataattgttggttgtggggtccaaccagagactttcccattattctcggccttgtccaataagccaccttcgggaggggatatgccatcatcgtcgtcgacatcctcatatggagttggtggctctgctattggcagcggtagtgcccctggtgctcctggttccggttctggtccagcaggcccaggcgctgggtcgcagttgagttacttcaaaattggattagatattctttatcaatatgctcagtttagtggagacaattctagcttattggggtacatcattactctcaataatcccaaattattggacttgtattacaagggggtatgtgctattcgctatatgccaattctaaaccaagaagggtatgttgagttgtaccatgttgcaatggccaagttagggttgagtgaaaatattgatttcttgcatcaagaagaaaaacacgttgtgggtggtcaaatacaagcagaaaatcaacaagttaaaagtagaaatgccgaagtgaaacaaacgaaacagggtggtgagacagacaacgaaaaatcaaatgctgattctaatactttgcatagatcagtaaggataccaattgatgtccatgaaatcatttcacaaagaattacacctgtagctttatttttaccaatccatgggcttatnacctgtagcattattaggatcnatagtganaggagaaattattatcagagcaccatgagaaggtggcatgggtaa

SEQ ID NO: 200 - DNA, 498 bp, Candida albicans
ttgtcaatttacgaaaattggatttcgattcacgggaaagatgttgttatattgtttctgacattattgcgacgaactatggcgaataaatcacccactgtcgattacttagtgcattcaaaacctgagatcattactatgttgatcaaaggaccggaaaatcttgaaattggattgatatgtggccagattttacgagattgcattaaatttgaagttatcaataaatttgttctttacagcccctccttttacaatttctttaaatacgttcaaatccctacttttgacatcgccacagatgccatgatgactttgcatgaattgttaaccacccatagaaaactagtgtctgagttcttgggaaacaattatgatgtctttattactgctattaacaaactagttacatcgaaaaattatgtgactaaacgactaagtgtcaaactattagatgaattggtctcacaaagatcaaaccaacaatttttatcataa

SEQ ID NO: 201 - DNA, 621 bp, Candida albicans
gaacaagagactcaaaatttagagttgaaacataataaatcaattcacgagttgattaaaggttatttttattacggtgatgtttatgggaatagaaatccctacggtgaccccaaaatgtcacaaatgatcatagacaacaacaatgacattttacctagtgttatttctccaaacaatcaaaacaaaaaatcaggaaacgtattatcacaagtaatcaagtacattctaatacttgaatttcttgtgtttcaaacaaaacaattgttggaaccattgtcaaatgtctctcaaatcattataaatgggtcgcaaagtaagaataccaggtttttgaaattattatctacagttacaggattaccaattataattgctaatcacgacgttgctcgaggtgctcagttgatggcattgattggtaaactatgctcatttggttggcactacgatgatgcgtttgatcaagcaatacaaaataataataacgactatcttggtaatgaaaatagtattaatattagagaagattattaccaactattaatgacaaagtatgagatattcaaagacatggcaagtgctcaacaaagataccgtaaattaatgggtgatgtttaa

SEQ ID NO: 202 - DNA, 432 bp, Candida albicans
acaacaagcatggacacctccacaatagtagcaataggggtagatataggaacaggttcagttagagtgtatcacaatgaaactctcacctcgttaccaattaccactgaaaatgatatatacatcacccaatcatcatttgaaatatattcaaaactaatacagttattaagtagaccccaattggattggaattttgattcaatatgtataactgcaacttgttcaatggtcgtattatccaagataataatatacgaagaaacatatctaacaccagttagtttgaacaaatctcatcccaatagtgatgttttattatggatggataattctgccactttgcaatgtaatcaattgaatgaatatttaaaagttgcttaccataatatattgaatcttgtgggaggtcaatttgttcctgaattatga

SEQ ID NO: 203 - DNA, 1383 bp, Candida albicans
atcattatggtcaatacaaaacaactaattgccaatttagaattacccaaattaccttttaatcatgaaaaacaaacaactcaaaaaccaacacacaattatttatccaatacaacaatcaccgatgctggtattatggacccagcacaattcacacggaagaatttaaagtcagcgttacatattataactcaagaattgaagaagagaggtaccaagactccccatatatttcttccgttcagatctaaagttaatgacgaaaaattggaatcatttttatcatctattgcgcctctgggtgaactacgaacagataatacacttttgcaacaactatgttctgaaactgatgaatttactttgattagtgctttgaaatatttttggtcacgtttacctaataatgaaattattggatgggatgtctatcttgaatttaaacgtcgagaggcagaaaagggatatcccaaaaatgcattcttatcgattatgccaaaatgtttgtcatctccagctcatgcctctattgtctatgattttttggatttgatattgagcataacatcaaattctcaattcaattatctaagtggtcggaaaataagcaagatggcaagtttctgggcatttagttgccgacaacagtttctacaatcgccattttatgatgcaactcaggaagaggcagaacataattttattgaagggatcgatacttggaagaaatcaactaatgctcttttccatttagttttggcttttttgagatcaatgctacctgaaaccaattccgaaacattaaaaataccaaagactttacagtctttgttggtaaccacacagtaccctccttcctcggacaatgagtctgaccaaagcatggtaagaggtgctattaccattccctgtgtttgtgtatcaaccacacaaccttcaaaagatgcatatgaattgattagcaaagtgaggcataatctaaaatttgataaaaaggatgatttcttgtcaatcgagaattacacgattttgaagaatttattctcgaaaaagggcacatttgaaattgttaattccttaactgatgaatcaaaaagaattttatcaagaatttccagtgaaccaatatcatcaaaattcaatatttctccaggttggaacaaatcacaagtagaaaccgatccagatattcctttgttttcagaaatttctatcaaagatgtgtcaatacatgactactacatatggacttggttggcgtctattattagtgatcagccatctgtgaccaagcaaatatttggaagatctattgttgtcgaggcggaagtgtggggatttcaaaaatggattgttgttactgagaaaaccttaagtgcataa

SEQ ID NO: 204 - DNA, 1635 bp, Candida albicans
  unsure (752): Identity of nucleotide sequences at the above locations are unknown.
attgttttcttttggggattgcgtttagattggtctatgggaaataaagatgaaatatttgcaaagattgttgacccagatttagctgcatggtctgcacctgaaacagaaaaaggattgatggatttgcattggtttatggagagaattggtattgttgaaattgcctcatatttccaaagtcgtgggataactgcaaccacaaaccttttagaggcaaaaatggacgaagaaggtaaattgttgaaaaccaagctaaaggatcattggtcgtctattttcccaataagagcaacaagaattttcattcagtatagtatagaaaagttgaaccacaattctcctgaatatttgcatctattgaagctttggaaaccaagaattcagccgattgtgccgcatatcttacagttattgacacaaatccaagcttatcatgatcctcaaaattggaacgatttaccaattgaagttcaatcgtttgtgaaagagagttgtaccgagagattttggcaacaaggagtgtctattcaatcgaaagaaacatttatggaggagaatgttaaggctgccttgacattgagagactttgcagattccgttggccatttgattagatatactcgagaatatgcatttttgacggtgggttcgatagctcagttggaagacacgttatacgaaattcctggtgttgccctgatgatctggaaagcggtggcaggcgatactgtgggtgttacgttacatanttggaaacatatgataaacagttgtttaagagtggttattaaattttgtcctgtcaagtatgttgaagtatttatgagtgaactattgccagcagtgttttcagacttggataagttacttgtcgatagatgggctaaaataagtggcaatggaatacaattgcaaggaaacgaagatgacgaaacattgtctgaagagatgatggaagagcatatgttaaggcaattgactgctactattgtgaggttattgatggatgtagttggtcagtataatactagaccggctaccgacacacaatttgcatgcaagaaattagtggcagagaataaagaagttttagctccattcttacaaatatgttgtcatttgtttttgtttaaagatacaaagtgctctttcaatactattttggtgatacgtaatattttgcctgatgttgtgttaaaggacgatgaagttgataagtatctttctgatcacctcatcaaatctttgctccaggtattgcttgatgattattttgctgaaacacacagtgaagctgcaattgcattaacaactttgtattgtgccttgagatccaaaaacgactacccagccagaattttgattcaaaacttacaaaatataaataccagagacatcagtagttttgagtctcagttggtgaattcaaaatccttgcgccaccaaagaggcgctttactagatttggtgagaagatctaaaaaccaggagattgatgaaatgtctaagagaaagaaagagttggaggcagtatctatagccaataggaaaaagagaaatggtggtgtagatgtcatgaatgatccatacactgagaatggtgcattgggacaattgttcggtgaagattaa

SEQ ID NO: 205 - DNA, 1968 bp, Candida albicans
atattttgtcgtttcatctggataataaatcaaatgacaatggatagtggaggtgttcaacagatagtatctgcattgcaaatcgtatacgaccccaaatctacaaatgatcaaagaagagaagcacaaacgtttttagataccatcaaatcaaacgaggaaagtcctttttggggttaccaattggcattaccagaaaataatggcgacaactacattgtaaggtactttggattgtcactattacaacaatcgataactgcaaactttcacacttttgatccaacaaagacatttgccgtaaagcaatggataattgatttatcaaccaaagtcgagccaagtgatcctcattacattaaggaaaagtttgttttgttatgggtctcaatagcaaagagagtttggggaaatcatttgatcaaatcacgagactctcatcaccacagtgttgacgaaaacacgacattatcaacaaatctagatcacaataatagactgtcgacttctatcacagaacaagaatctgccgatggttgggtatctatggatgctgatttgttaaaattgtggaataacaacgttacttgtcgagaactttcgttgatcattattagaacattgttcgaagacatctacttgttggatgatccaatctcctcaaaaagaagcaccttattgaatcaattatcgattttgattgtgactcctcaaagtgtattagaatctatgtatgaaaacaaccctaacgttacaatctgcaaagcactggctgaaggttggtttataacctggtcaagatatttggttgaattgttaactaacaacgattataaagacaagatttgccaagcatttgtgcccaagatattatcggcattcaaaacttgtttacattggatcaatccttcagtgttgagacaagaaaatatcatgcaaacgttaattggtatattaactattcctgatgtaccaatgaaaattttagccgttgattgtttgcatattttatttacaagaacatacacccaacctgaagatttcgattttttcattggctctgtgtttaccagtgaaggcataacaaaattaagtgagttttatcactcattacatttagatccagatgatgtggacgaggttgtatattcgcttttgaagaaaacagtggaaatgatagtatctttgagtgagtacttgaatattgcctcaagaaataaagtttcttgggaaagttctgatgttgatggttacttgaaattggtgttggagacaacaagccaccctagtttgataattagtggtttatcgttgcagatgtggatcaccatattaagattcgatgaactaagtgcgaaacctcaatttgttaaactcatgccagatttgctagagattgctgctaatagaaccataaattatacctacgatgagaataatatctcgaagaaatttttagacgtggatttcgattcaactcctgatgccaattcatttttgcaaaactatagaaaattcaatgaagatattacacgtatcacggtgtgcaaggatcctgaaaatggattggcatggctcgaaaatagacttcaagtatttttcagctcagaattgggtggcaagtgcatcaatgaatttaaattaggcgaaaagtcagaagagttcaattatgggtcatcacaacttagcacaattgactacactttacgtggggtcacgcgttggaacgaatggtataatcgagaggacaaaaatgatattaaggagagattaaataaattagttgaatctttatgtgaacgtttattggcgatgaattttgccagccccttattggttagaaagcagatgcaaacattagttcattttgcaccacttttgaaagatgtcaacccaccactcctgttcagagctttagaaaaaattcttactacagctacttacccctatccaaacccccccttttaa

SEQ ID NO: 206 - DNA, 489 bp, Candida albicans
attaatgaaggtatgtcaccgtgtttagctaatatgatcttgaataaaagaaaacgaataattcaaattactaacattatcaagctatcttccattgctggatcgaaagttcagtacgaactaagcctcaataatttgtataacttgttgttaaggactcgcaagcaggaagaagaagaaactttcatttttcccacagtaagtaccgaagagtttgcgttggaacaaataacctttgaagtaagcgaccagatggatgatgataaagatagcgaagatgatattttaataaaaggggaggaaataaaaaagtctaaaaagaaacgacaaagactagacaattctactaaggaatttcttgaaaaagtattcgagaagaacaaacagcctaatcgaagagaaagggaattgatagcagaaaaacacggtgttagcctttcccaaataagagtttgggtatgtattatcaaacagaatattgctaactaa

SEQ ID NO: 207 - DNA, 849 bp, Candida albicans
  unsure (820): Identity of nucleotide sequences at the above locations are unknown.
agtttaatttttttgtattgcttgttagatatgtctgaagtaaaagtagatttggatcaaatagaagaaaattcgcttgacactgaagcctatttgcagaaagaaatagaggatgaaaacaaccatgctatcaactataggaactgttcttggcaacgaactgctggattattatttagcgagtatatatgtcttgcaatcatgtcattcccttggagttattctgtgcttggattaggtttgggcttaattgttactgttattgtttcgttattgtgtctttacactggacttattattgctgattattgtgcagcatatcctcatttaactgatgtgtgtgatattgggcgtcacttaattggtcccaaatgggtttggtatgctaccgctgtggcattcctcttaaataatactttaatccaagcactacatgttttagttggggctaagtacttcaacactatcagtgataatcacactatctgttccattgtttttggtgtcgtatcagcaatcatttgctttcttatttcgcttccccgaacttttagtcatatgtcctcagtcgggtatttttctgccatcactatgtttatagctgtcgttttagcaatggcgtttgttggtgtgcaatctcacccgtacgggtttaaagaaggtacccctgttcattggagggcatggccagctaaaggtgaaaaatacgtgaacatcatgtctgcggtgttgaacattgtctatacttttgtggggcaaatcacgtatccttcgtttatttcccaaatgaagcaccccaaaaaattcaaaaagggctttnatcgtggtgactatctgttaattgaataa

SEQ ID NO: 208 - DNA, 537 bp, Candida albicans
ctgggatttgccccatctgacttgcagtcgtaccattatgtcatgtacgacaagtttttcaaccatttagatatcccgcgtgaaaatatccacatcttgaacggattggccgcaaacatcgacgaggagggtgcccattacgaaaagaaaatcaagcaatacggaagaatcgatttgttcttaggcgggttaggcccagaaggtcatttggcattcaacgaagcgggatcatcaagaaactcaaaaacaagaaaggtcgagttggtcgaaagtaccatcaaggcaaactgcaggtttttcgggaacgacgagagcaaggtccctaaatatgcattgagtgttggcatttccaccatattggacaactcagacgaaattgccattatcgtgttgggcaaaaataaacaatttgcattggacaaaactgtaaacgggaaaccaaacgacccaaaatacccatcaagctatttacaagaccacgcaaatgtcttgattgtttgcgataacgctgccgctggattaaagtcaaagttgtag

SEQ ID NO: 209 - DNA, 315 bp, Candida albicans
gatttttgtcggaaagccaatataaaaattttgggacttgtggaaaatatgtctggatttgtttgtccaaattgtaagggggaatcacaaatttttaaagcaactactggtggaggtaagaaattatgtgaagaattggggattccatttcttggttcagtacctttggatccaagaattggtaaagcatgtgatatgggtgaatgctttttcgatagttatcctgattcaccagcagccactgctatattagacgttgttgatgccttacgagatcaagttgagttgagtttagagaatttggccattaaataa

SEQ ID NO: 210 - DNA, 453 bp, Candida albicans
gaaagaaacaaaccaataacgaaaaaaaaaatataccaagtccaaaaaaaaatcaaactacatatatcatcaaccctttccatatatacatatacacatcttccacataaccaactcaacataatgacattagccacacaatttgccgaaacaacccgttattcagtttcaaacacagaattaaaacgtcgagttctacacttgtatcgtaaatatattagaaatgctaatgaatttgctgatttatacgaattagatatgccagtatccaatataaaaactaaaattagacaagaatttgaaagacaaagatttggtaatgatttatccgttaataatgtattattaatgaaaggacaaatggaatttcaagaattgattaatttttggaaacaacaatgtcatgttatgagatatgttcttgtaaatcataagtgtcagccgtctgggtaa

SEQ ID NO: 211 - DNA, 237 bp, Candida albicans
cttcttgtctcctgtttccttttttgtttagtttcacaagatgattgtcaaaaatataaagttccattgaaatggagagatagatgtgctgcttattttgctctctatcaaacctgtattattagacaatcggccaattcatcagtgagttgtaaacatgataaacattcatgggaagaatgtgaaaatttggatttgattagaagaaaacaagaattaaaagaagcaagtcaataa

SEQ ID NO: 212 - DNA, 1305 bp, Candida albicans
cgcgatctctaccccgtggctgaacaacagcagcagcaacaacaacaacaacatttgcaccatttcggtcaccaaattccagccccccctgctcaacaaggcccaacacctcagcagccacatttgcatcaacaaattcctcatccattatcacaccaccaaactccccaaccaacaccacaacctttggctcagcaacaactgcctcaaccagcaagacaaccacgtcaaaccaagaaacaaaaacaacaagcacaaaaccaagaccaagctgacgctcaatcacaagcccaacagcaccatatggctatgatggctcgtgctaaccaaaacgatatgttggaatcgtcgaccagaaaagtcgcacctagatctagcgatttgttccgtgttgggcctccattttccatcagcaaacaacaccagccagtatattgtgtggggaccgatatgccagtgacaccattgttgcatgcccgtattgatagagggtttgagatgggcgaaaccggttcttggattggctataagcgtaactactttaccttggttgcatcgtttacattgcaagacttcgattttgaaaagttcatcggcaacaagttctacacttacgacaaggtcaacaacaaggttaatggtttcccacctcatcaccctagccacccacaaaaccagccccaaaaccatcccggccatccacaccacaaccaacacgctggcgaactgagagttccaattagttattttgcaattaggttagtggccaagtgttctgatgaagatgttgccatctccttgatccagcacactgctaaaagagataaaggtccacagttcccaccaccaatctaccctgcagttccttcagagttgcctgaccacgagactgtcaaagtaagttgtaacaaacgtaacaacaacaagatcgaaactatgaataaaatcttttactttgataggggaaactactaccaagagtacaatttggatagctacaaggaccagtcgatattgaaaagctaccctagtcaatccatttccaaggtggctagattcgaaagaatccaattcaccagctctattagagttaaaagcaccaacacaactgctagatactttaccttgcatgtcgaattattgggtataatcgaggacgaggacttgcagatccaaccaatcttattgagttcaattgaatcaccgcctttaattgtcagaggcagatctccgtcaagctaccacaaagatagaacttctgggtatagggctacaaacaccccaacccctactcctccacagtaa

SEQ ID NO: 213 - DNA, 657 bp, Candida albicans
  unsure (625),(647): Identity of nucleotide sequences at the above locations are unknown.
gggcggctattgttcatgactaacctctccttccataggaaacaaaaatcaaagaataaagcttgtaaccttgatttcaagtctgattctgtattggaacttttgaattccaaatcaaaagttgctcctagatcaggattacaatttaaagtaggtcccccttttcaagatactattcaggtatctcaattatttataaaagaatcacatcaaaaaattgttcctgttttgaatgcacgtattgatagaggttttgatttgacaaacaatgaatgggtgggatataagcggaactatttctctgtagttgcctcattttcatttgaagagtatgagatcaataaatctattttaccgaagaatggattttttattgtgtctggggaaaaagaatatcaagtcaaacagtttgctattagattagttagcaaatcagtccaagacaatacagagattagtttgattcaacacaccgcaaaaagagatcgtgggccaatctctgaacctcccattgttcctgtaatcacgggatctattcccagtcacattgttgtgaaagaaggttcaaatatacgaaagatttccaaaatcagacactctgattcgttattttgtcagcagccgngggctggaagagaggcgctcgngaagcggagg

SEQ ID NO: 214 - DNA, 1008 bp, Candida albicans
aattcagtgttgagttatttagaggataaaattgacatttcagaattaacagaaagtcattcgccttcgaaaaatacttttgaagaaattgttgatgcagctattgccactccagaaatcaatcaagtacctgttttcgattcacaaacttcaccaaatggaattggtttggatatcaagcataaagaatttgatgaaactagtttagtagtagagaagaaatccaaggaaactgtttctgatagcaagagtgaagaactgactaaggagacccaacagcaggaaaatgttgttatgtatgaacctattgtccccgttgaagaatacattaagaaaccagaagaagtaaattctgttgaagctaaacaaccagaagaagttaaatctgaagataagagtctacaaggacagaaatcacaacaacaacagcaacaaccggaaaaacattcagcagatattggcaagactaaagtggatttgaagaagtcagcttcacagaagaaaaaagtaaaggaagaatccataaagaaacaaaaagatgttgattccaaaccaatagagagaagacacacaattgctgccagaagacatcacaacgatgaaaataaagaaaataaagatgtgaaaaagcgtaatagatttagtttattatcattctacagttcatacaattcatcaaactcaaatgtttcacttgcaactagcaaagtaccttccaattctgaaaataataccacagtgttgaaaccaacaagtatgaacacaactagaaaagtattggaaccttcgaatgaaactaatataatgagaaaggagaccaaacaaacaaattcaaatggctcaacaacatcaaaatcaacaacatcttcgtcatcctcatctgctccagcagcttcttcctcctcatcgtcatcaacatcaaaacgagcatctactgcgactaaagaaacaagtgcagccaggaaagtaatggactttttcaaaagaagaagtgtcagagttggttaa

SEQ ID NO: 215 - DNA, 195 bp, Candida albicans
tggatacgttatcatgcacatgtgaatccagcattatttgtttccgtggcattaggtgtatcagcaccattggtattattgttaactccattgagaagaaaatacttatatgccgatcaagaaccagttccacaagtttatccattaccactaagaccacgagataagaaattaactggatttgatgatgaataa

SEQ ID NO: 216 - DNA, 2214 bp, Candida albicans
  unsure (179): Identity of nucleotide sequences at the above locations are unknown.
aagctggtctttttttataaaaagaacgcatatccatcattctctgatccacattgttatggacacgagaaaagaaagagaacaggtttggactgctacaactacagctttaaaaatgaaaaagagttccgggaatggctcgaacaaagacagcttggatgtgtctgggttcgagaaangaaaactccccccaagggttcagcttatatcaaataccaaagctatatctgcaacaaatccagatcttatattccaaaaagcttaaaccaccaaccgaatcaaaactatgctgtgaatgaagaccgtgctgtgaatgaagacggtgccgtgaatgaaaacaatatcaacaatcaaaaagctgtcaaaaaaagaaacagaaaagaaacaataaaaacccaatacccagccaaaattattgcgttccaatacgaacaagatggaaagttttatgctgattggatttatgagcataatcaccccttgactgatagttattatcataatagtagacttagaaaagacttaacaaaagaattgaagattgcaatagaacaaaaaacaccaatagttgaaataattaattcaatgttagatccaatttacaaaagttgccacagatgtaatattagtgatcgaaatgaaattgcagcattatttaaagactactatcctcaaagtcttgatgtctattcatatcatttgaaaaatatttctagtgaacttttcgaatccaaagtcaaaaaaggtcaaacaataaaggattccttattgggttggaaaaatattataaaaacacagtacggtggatgggccaagttttgtaatgaatataatacaacaaattccaaacatcacaatgtattttcttttcaattctgtgttgatactcaaattcagttactaaagaacgtccacttgtttagtttagatgcaactcatggtttggtaaaatctttaaacggtcaatcaaatgcctatctttttgttctcacaggaataataccttctagtcgcaacacttttccattatcatttatgttgacaaattatactggaaaaataactatccaacattggttaaataatctcaaaacagaatttggaattaaccctacccaatttgtaattgatgctgatcctgctgaaatttcaggtatccaatccatattcaaggacaccaaaatagttctatgctactttcacgtattgagagctgttactataaaactcaaagaagttgtaattcttccagacaaagagcagcaaaaagctattcatgacctgataacccaagacttgaaacgaatattattcaattcagaaaacacagaaaatgatattcaaaaattcctagaaaaatatgcatcttttcgaagatttaaatcatattttcaaaagcaatggatgagtaaaatcaatatgtggttacgaacagaaaacaatacctttgatatacttcttttaacaaataatttaacagaaaatttcttttcggtgttgaaaacagttattctcaaaaatcaaccaaacaaacggcttgactcattagtctatgtgttagtggagatagtaatcccccgcttctggaggaaagaattcaaagtgattacgggtgatgaaaagccaaatacgaggggaccagaagtttcacaaaaaaaacagttagatattcttgaggatgaagaaataaaagaacttgttaaattaaatattattaataacctggaattgtttgttgtgcaatcaccacatcgaagcgaaatgtcatacaacgttgaattgaactatcaaaacaaaaccggccaatgctcttgtgaaatgtttacaattgaagaatgcagctgtattcataccttggctgtatatcgttatataaacatccacaaaaatttctatcgggaaaaaatcagaggtagcccccaaaatgccatacctctttgtcttagaatagaaatgttcccgttggttggtcaaaaaataggtgcatatgttgcagaagaattgttggaagaactagacgaaaaaggagaattggaaacaagtgtttccgagataatgaatcaactagctgcatcaaatgaatcgcttgagggatgtcttccaattagttccctattaagtctggctattgccataattgatgaagcttcagagagcagcaatgatgaagccccaactattcttaccagcaatcacctaggacgaaatcggtag

SEQ ID NO: 217 - DNA, 333 bp, Candida albicans
atatgctccaatgcttgtcattataggtattatccttattgtatctgttataggggctatcgctatgactcgttaatgcaatatattgaattattaattatgttcttaagtgttttacttgctgtagccttcttaactgtagctgagcgtaagacattaggttatatgcaacggagagttggtcctaatgctgtaggttattatggtattttaatggctattgctgatgcagctaaattattacttaaagagattgttgttcctacacatgcagataaacttatcttatttgtaagtcctatgatttcattgatatctgcattactatgttga

SEQ ID NO: 218 - DNA, 327 bp, Candida albicans
ttattagctaagagtaatcctaatattgataaagcaggaccttttgaatgtggatttacttcatatcaacaatcacgtgctgcatttagtgtagctttcatattagtagctatattattcttaccatttgatttagagatatcatctatattaccttatgtaactagtgcatataataatggattatatggattaataatattaataatatttttaatgatgttagttatagcttttatattagagatacaattaagagtattaaagatagagcgtagttatgataaggatagatcagatagtaattattatgatcatgagatataa

SEQ ID NO: 219 - DNA, 465 bp, Candida albicans
ggttttgtatcatcaggattatttatttgtgcaggaggagttttatatgacagatcatctactagattaataacatattatagaggtatggctcaagttatgcctatattctctgtattattcttcatattaggtttaggtaatagtggtactcctttaactctaaatttcttaggtgaatttatgtcattatatggagtatttgaaagaatgcctatattaggtgttttagctagtacttcaatagtattctcagctgcttatacaatatttatgtataatagaatagtttttggtggttcatactctatttattttgtagaaaatataggtgatgtaactagaagagaatttattatgttattagtatttgttatactaacagtattatttggtatttatccagcaccaatattagatggattacattattcagtttcttctttaatatatagtataaactaa

SEQ ID NO: 220 - DNA, 228 bp, Candida albicans
attagtctaggtgatattgttataccttttggtctgtcattagactcattagctatgactgttatcgtacctgtaggtattatcactctttgtgttctagcttatgctattgaatatatgagtcatgaccctaatcgtaatagattctatattatattaagtatatttgctgtatttatgactatattagttgttagtgataattatctaatgatgttcattggttga

SEQ ID NO: 221 - DNA, 234 bp, Candida albicans
tcaacacgtatcacagcaatgaaatcagctttatcagctatattacttaatcgtatgggtgatactttctttgttatagctttaggtcttatgattaattattatcatgcagtagattatgatacaatagcattagttacaccatatatgaatacatttttattaaatacattaggtttattgctactcttagctgctacagctaagagtgcacaattaggtctacatgcatga

SEQ ID NO: 222 - DNA, 957 bp, Candida albicans
ttaggtggattaactacattagttagtggtctaatcgccatagtaactaatgatattaagagagttattgctctttctactatgtctcagttaagtattatggtcttagcgattggtataagtgcttatgacttagctatatatcacctatattgtcatgctttctttaaagcattattattcatgggtgcaggttcagttatacatagcttcgtcgctgaatctcaagatatgagaaaatatggtggtctaattgaatacttaccatttagttatactgctatccttatagcctcattatccttaatggccatccctggccttactggttactatagtaaagatatcattatcgaatctctctatggtagttatacacttagtggttatatcttatattatattgctgtaggttcagctacccttactagtatatactctttacgtgtattatatttaacatttatgggagtacctaatgctaataaagcctcatatagtcatatacatgaaagtttaggtatgatgataccaatgatagtattagtaatttatagtatatttataggatatagtcgtgatagtgtcataggtcactatgcactatcactacctgctaataacgggttcattgaaactgagtatactcttccagcatatattaaattattacctcttatattaggtttaaccttatcagctatattagtatatgtatatgaatatgcatataaaattaatagatctgctgtatatgattatttaaataatcgtatatattatgagcaaatattaaataatatagttatacgtaatacattaagattaggtggatatatgaatgcatatatagatcaaggtttacttaaggtattaggttctactggtgtaagtagagctgtaacttatattaatgttatagttataattaacatcttatatttattctttatatag

SEQ ID NO: 223 - DNA, 444 bp, Candida albicans
ataatgtccttaattagtggaatcgctagtatattagctataggactattatcacctgttcaaagtatattggccttaatcctactcttcgttactgtagctattaacctttatacttcaggttatgtccttatgggtattttatatatcttagtatatgtaggtgccatagcaatattattcttatttatattatctttattaaatatagaatataaacctactggaggtatgcatcctttagtaatagtattaatattaatacctttaataccattagatatagcatttgagcctatagccatagtggaatcagtatctactacatacaacgagcttagtatcgtaggtacactcttctatagtgaatatgctccaatgcttgtcattataggtattatccttattgtatctgttataggggctatcgctatgactcgttaa

SEQ ID NO: 224 - DNA, 666 bp, Candida albicans
actatgcttagcaattttaaaataaaaccacgcacattactacgtggattagccactgctgctgctgacccagctgccaatcctaatagagtacatggtggattaaaagatcaagatcgtatatttcaaaatgtttatggaacttatggtcatgatttgaaatctgctcaaaaaatgggtgattggtataaaactaaagaaattatattaaaaggagataaatggattattgatgagatgaaaaaatccggattaagaggtcgtggaggtgctggtttcccctcaggtttaaaatggtcatttatgaatccgccaggttgggaaaaaaatgttggaccaagatatttggtggttaatgctgatgaaggggaaccaggtacttgtaaagatagagaaatcattagaaaagatcctcataaattagttgaaggttgtttattagctggtagagctatgaatgccactgctgcttatatttatattagaggtgaattttataatgaaacagttgttttacaaaatgccattaatgaagcttataaagcaggattgataggtaaaaatgcatgtggatcaggttatgattttgaatattatatccatcgtggtaggggtgccaaaatttgtggtggagaacacgctttgattgaattcaacaaatgttaa

SEQ ID NO: 225 - DNA, 375 bp, Candida albicans
gggcaattcaaaggattttctcatttctataaacatgaatcttgtggtcaatgtactccatgtcgtgaaggtaccacttggttacaaagaatgatggatagattttacactggtcaagccactgaaaaggaaattgatcaaatttttgaattgactaaagaaattgaaggtcacactatttgcgccttgggtgatgctgctgcttggccagttcaaggtttaatcaaatcatttataccagttatggtagatagaattaaagaattccaacaaaaacacgctggtgaacaccttgaatatggtggatgggttgatggtggtaaagtaaagaatggtgttgttattgacaatccattaccatctggccatcattag

SEQ ID NO: 226 - DNA, 360 bp, Candida albicans
ttccaatgtatcaatgatattcctgaaggacctgtcaaggttgaagactacaagatctcccctccatcaagatcattaatgaaagaagatatggaagctttgatacaccatttcttattattcacaaaagggtatgctgttcctcaaggggaaacatatactgctatcgaagcaccaaaaggtgaaatggcagtctatgttgtttccgatggtagtgaaagaccatacagatgtaagattagagccccaggttttgctcatttaggggcttttgatcatatcgctagaggcaatttattagctgatgctgtggccattatcggtactatggatttagtgtttggtgaagttgatcgttaa

SEQ ID NO: 227 - DNA, 303 bp, Candida albicans
acctacacatctactgttgaacatatctcaatgttgaaattatcagcaagaccaataagtagatcaacaggagtcttctccagaagatcggtctacacatctgttctagaatccgatatcaatattaccaagaatggtaaagtcaatgttgctgtaggtgctggcggtcgttcttccagaactgggtacacagccactgtatttggtgcatctggatttttgggccgttatgtaacctccaaattggctagacacggtactaccactattgtcccagtcctcaccacgggtgaaagaccgcgt

SEQ ID NO: 228 - DNA, 966 bp, Candida albicans
cgcggatctgggcccttcgtggtgagacacggtagtaccactattgtcccattcagagatgatatgaaaaaaagatttttgaaagtcactggtgatttgggtgttgtcaattttgtagaaattgatgctcgtaatttacaaagtattgaagattcagtggcccattcagatattgttatcaattgtattggtgttgattacgacactaaaaactttaaaatggccgatgttaacattgccttggctgaaagaattgctgaagccactaaaaaagccaatgttcctcgttatattcatgtctcatcatataacgccgatccaaattcagaatcagtattctatgccacaaagggtattgctgaacaagttgttagagacattatcccagacaccactattgtaagaccagcaccaatgtatggtagagaagattcattattaaactatttgggaccaaaagttaaaatgtggactccaaacaaaaacgctaaagaagtttggccagtatatgttttagatgttgctagagctcttgagagaattgcttatgatgattctactgctggtcaaacatttgaattatacgggccagaaaaagtcactttccaagaaatcagaaatatgattcatggtataactgaaaattacgcccaagtaggtccatggtcatatcaatttgctgattatgctataccattaccattagctaaggccattgctaaagttcaacaattggtgtggtggaaattaactaacccagaccaagttcaaagacttgtcataaaccaaaagattgatccaaatgctaaaactttccatgatttgggtattgatgatttgactagattaccagatgtgttattcagttacgtcaaacaatggagacatccattaattgctcaaaagggggctccaggtaagaaagaattagaaagattaagagacgtccaacatttcactccatag

SEQ ID NO: 229 - DNA, 528 bp, Candida albicans
gcatcaagtcccaccttctttgacaattcgtctgggtttttacttgccttcttctcttcttcggtggggtcagtttccattttggcaacatgttctttcaaatgtgccaattccaacactttccaaacaagaattagagttaaaacttatgccaatgaaactaccccagttccatcaattactcctttatttaatggtgctaattggtttgaaagagaaacttatgatttatttggagtttttttcgaaggtcatcctgatttaagaagaattttaactgattatggatttgaaggtcatccattaaggaaagatttcccaactactggttatactgaagttagatatgatgaagaaaagaaaagaattatttatgaaccattagaattgactcaagcttggagaaatttcaccgttggtagttctgtttgggaaccagttggtgaaggtaaagatttcactcctgaatcatttaaattacctactcctgaaccagaacctgaaaaagaatctgatgaaaagaagtaa

SEQ ID NO: 230 - DNA, 771 bp, Candida albicans
tattcaacacataccattttacatattcatataactaccatgttggttcgttttattgggaaatcaactacaacaccagtgggtgtatacgcttctactgtatcaaagagatactcttccatcatctccgttcatagagacaccaaagaagacaacccaaacatagcatttgaatttaattcagaaaacaaaaaaagagctgaggaaataattgccaaataccctccacaatataaaaaaggtgcctgtatgccattattagatttgggacaacgtcaattaggatttacttctatttcagtgatgaactatgttgccaagttattagatatgccaccaatgagagtgtatgaagtggctacattttataccatgtacaatagacatccaatggggaaatacaatttgcaagtttgtactaccacgccttgtcaattatgtggaagtgacagtattatgaaggccattactgattatttaaaaattaaaccaggacaaaccactccagataaattgtgtacattacaagaggttgaatgtttaggtgcttgtgttaatgctccaatgattgcaatcaacgatgattatcatgaagatctgtcaccagaagctaccataaacttgttgaaacaattacaagaaggtaaagagttgactgaaatcggaccagtagatggtaaaagacaatcttgtgaacctttcagtggaccaaaggtattattgaacaaagaacctaatgatataagaaaattcacgagagctgatttgtaa

SEQ ID NO: 231 - DNA, 627 bp, Candida albicans
aaagggaaaaaaaagtatccatttattatctattcattaactatgtcaggaggtccagttccagtttggaagaaatatactaccagaccacagggtatctgggagaaaataagacaacttttggttttggtgccaaatagatcatctggtaatcctttggtatcgttgtttagacaagtcccacctgctgaaagaatcaaagaagcacagaattacaaggaccctgttaccataccagcaggagatatcaaaggtaatccatacttcaagagagattatagaagaaattatccacaagttcatacatttaaccagaccaaaatctctgggttgttgaatttaggttctgaatcaaacccaagaatctccattggagagaagggaaataaagaattggcagtgtttacaaacggacaagacgttagtttagcatctactttgaagtctgtgcctgcatctgtggtgaagggagaagttttgggcaaatcaggagaaccaattgttgctccatcattaaacaaatttaaatgggaaattttacctgaacctgttcatggtatgtattctgaagcttacccatgccgtatatttacagagaagaaagttcgttcacaatcttctgcttag

SEQ ID NO: 232 - DNA, 645 bp, Candida albicans
acattgaattttccattatttaaacatataacacaaccatccatgtctgataaagtagaggtagcagaagtggcaccacttccagatgcaagctataaatatccaaacccattagcaaatttcacaaaggggcttggttatccagaatggcagccaattgataccaagaaagaagttggtcaaatttttagatttgggttttactccactgttggtgcctatgcttggttatatttctggaaaagaactacattcaaattagaattaccactttccgttattgggttcttttcaattgctaagggtgttcaagactctattgccaatatcagagaaattaatgattgttggaacacattttgggggttgaccgctgccaacaccgttgttttgagtgcaggtttcagaagtatgccacccaagcacaagattataactggtgccttgggtacttctattaccacaattcttgatagagcctactgggcacaatccacttcttctccaagattagacgccaaatatgaattggccaacacaaatgaaaacttgccaaaacaacagttctgggatgtttggcaaagaagaccaataacccaaaccgtggaggaattaggtgttggtagaggaattttcaagccataa

SEQ ID NO: 233 - DNA, 303 bp, Candida albicans
ttccctactcctccttataatgcccctatattacattattcatttattatgatagctgttattactacattactcacttattatatgagtagtaataatctaattaccttattaattgctattgaaatattattattaactgtaacattaaaacttatacatataagtggttattatgatgatatatatggtactatatttagcttaattattattatactagccggtgctgaatcagctatcggtctaagtatattagttgcttattatcgtttaagaggtactatcggacatagtatctaa

SEQ ID NO: 234 - DNA, 1638 bp, Candida albicans
tgttcaccccagcaattggtgattacagtataccttattttagtagaatcatttgattcagaaacagaaccccaatcattggacgaggattctccttcaaagagcatcaaatcatcactttcatcaaaagaattacaagagtcgagcaaattgagaaataaacaaatccaacagtatgcatcttcaaacaatctagtgatggtaccttttgaagaattggagaaattgaaatcaatagacgacgaaaagttgttgttgactgcccaagagagaggttaccatttacttacagccaaagagtatgaagaattgattgatgaagaggaaatgaagaagagattagaaagcaaaggtcttgtaactattccttttgatgaacttgaatctatcaaaacatgtttagataaacccgataaggcatacattaccgataaagcaaatctgatgggactaattgttacatcaaatgatttgtacgataccctagtaaagaatgccaatgagccttccgtggaccaccttaccgcaaaggcaaaagcccaaaacttaactttattatcaaatgaagagttggaacaattaaagaacccttctttggatcaattaactaaactagcatcaaagcacgagtctcgagtcgtatcgaacaacgagtacgagtctttgatagacccatctgttgaaacaatcacccaaaaggcaaaatcccataaaatgaccattgtgtctgatgctgagtaccaaaaacttatacatccatcattagatgtgttgtctacccatgccttggacaagaaacatactcttgtcaagaattccgaattggaagaattgaaaaagtcagcaaatagtccaagcttatctcaagtcaaagtgcatgctgataaattaaatttagtaaccatgtcaaaacctgatttcacagatttatttaaaactgcaaatgaacctagcatctcgcatatacgttctaaagcaagtgatttaggatatactgttgttaaacaacaggagtacgacgatatgacaaatagcataaaccatccagatgttgctgatttgaaagggaaactccctgactacaaaatatcgccattgtctgagtacgatgagatttataaattggcacatgaaccagaagtggaccacataaaaaccaaagcaactagtttgaaccattatttggtaagcaacgaagattatgataaacttcaaaacccaactttggaaactttgcaactgcaagcagatactttgaatcattcagtattagataaaaccaagttggctgatcttgaaaagttggcatacaatcctgatttggatcatcttcaaaaagtcttgaaagagatagattatgaagcattaccaaaacaagaattggaagccttgaataatccaactactgactctttactggagaaagctagtaagttgaattgtgaaataatatctcaagaggattacaaagaattattttcattagctcatgatccatcacttgagcatatccatgccaacgcaacaaagttggatcaaactgtattatcaaatgatgaagttaacgaattaaaagcattagcctatacatctagcattcttcaccacggaactggcaagatcgccgcttacgtaaca

SEQ ID NO: 235 - DNA, 510 bp, Candida albicans
aatttcacatacatgcaaacattgatcaatgagccaaccaagggagaaattgattccaaagcaactaagcttggtttagttacaatgcctaaaactaaatttgaggaattggaagcaacagtaaacaaaccatcgtctgagttcttatcagaaaaagcacaattgtatgattctattgttatttccaagaaacaatttgaaaatccaagtcttgaatttattaaagagaagtctgcaacacatgagcatgaagtaattcctagtaaagatttagcaaatttgaagaattcattggaatcaccatcagacgagtacttacatgataaactgaaggtcaaaggtttgaaattagtaagtaatgatgaatacaactctttagttaatttagctcataaaccagagaagtctcatttggttgaaaaggcttcagcacttggtatgtctttgattggtattgatgctttaaacaaattaaagaaagacttagaacacccacaagaggattcttaa

SEQ ID NO: 236 - DNA, 654 bp, Candida albicans
tctgagcatgagaaattgattaaagactccactattcctgacatagatcacatcaaattggttgctgaaaaacaaatgcttacagtcttgacaaacagtgcattcaaggatttgacagaaagagttgaaaacctaacattagatcaaatcaaggaagcagcagaaaagaataaccaagtagttgttcatactcaagaatatgacgcgttaatgcatccagatgaagtagcaatcaagacacacgcagaccgtttaagtttgaatgtaatgcccataaaagaacatgcaaaattaatggaagatttagaaaagccaactttggaatacctagttaacaaagcagctaagtatgactccattgttgttaccaaggatgcaaacacaaagttggaaaaattggcttatagtcctgatgttgaacatatggcggaaattgctgatgccaaagatcttgttgttgtaaataaggaagagtttgctaatattacaaagttggccaatgaacctcatgaagatcatattatatccaaggcaaagaatttgggattagttactattaatgaaagcgatcatagggagttattacagccttctaagtctaaacttgagcaacatgcttcaaggattgatcatttattagtagcccgaaaatga

SEQ ID NO: 237 - DNA, 450 bp, Candida albicans
agattgttggataaggccaataaatcattagagaaacttgctcaagaaaagggaatgagtgttgtgtcacctgaagagttgagagaacttaaagaaaatgccgagaaacctcttgatgtaagagctaaagaacaaggaaagacagttgttggcattgaagaatttaacgaattaaataataagattgagaaaccaagtttagaatatttgaaggaatgctgcaaaaagcatctcaagaagattgttctggaagaagattatgaacaacttcaactgagagcgaatcaaactgttgaagaaaaagctaaaagtatgggattagtggtgattaaaccagaggaactagatcagctcaaaaaatcggttgaatctccaagtttggactacataagattaaaagccgcagatcaaggattcgaagttattgaaaaagatgaattctctttgatc

SEQ ID NO: 238 - DNA, 528 bp, Candida albicans
ctaatagttcacccatcattaattaacctattccctatctatatattcagaataatgttgagaataactagattatcaactagacagcttgtatttttacgtttcaattcatcagtaacatcaagaccagatgtagcaagaccagaagcatcacaattaaccaaaaaagatttacaatcaaatgcttttgccaatcaagctcccaatagaaatgtcacttggtctccatcacaagaagaaagaatagaaatcattagtaaatatccttatagatttgttcaaaaagatttagaagaacaaccaagaccttatgctgccatagatttaattgctaaagaaccaatcaaatatttaagtcatgaacaaggtaatattgctgtttgtgatggtaatagaggtagtactttacaaggacatcctaaagttttcattaatttggatcaaccaaaagctgctacgtgtggatattgtggattaagatatgccaaagaagaatttaaagaattaattgaagctggtgaagcgtaa

SEQ ID NO: 239 - DNA, 327 bp, Candida albicans
ctaacaataataatattattttttttcatttcagggcgtttagatagttatgaaaaccatcaaagaccagaattagtgtcgtttgatgatatcagttataacaacttatctcaagtggaagctgccagaaaatctatgcttagggaacaatggatcagagtatatgaattaagggtgactcatgaagctttaagaaaatgcagacaatatcatcaagaagatgcttcaagaaattgtaaatcattggtatcaaaatacatgataatgttggaaacatatccaataccaggttatatgggataccaaaacaacgatccatctcaatag

SEQ ID NO: 240 - DNA, 432 bp, Candida albicans
gagcaacatcagcaccattattatcagcatcatattatattggggataaatgtaaaccatttaatgaggactttttattatgtaaagaagaacacaatggaggtactcctagaatgtatgaaagaaggtagaagggtgacaagatgtgccatttcggtattgaaagatataaataaatattgttttgatgaattcaaattacattatgaatgtttagaacaaaataatcaatattttagtcgttgtcgttcaagtgaaggggttttaagtaaatgtgtttttgataatatgaaattggttaaaaaaattcctggtgttgaacaacaaattcaagataagaaaaatccaatttatccatctgatccaaatgatgttaaaaagaccgcagaatttttgaaatcaaaagaagttacagctgttgaacaaagttaa

SEQ ID NO: 241 - DNA, 867 bp, Candida albicans
tcccccgcaattgggcatcttccaggggccgtgtgtgaagacaggattaatattgagccggcgggtcgtgctccaaacataaaaggtacattttttgacgatgaagacaaggatgatatcaaaccttccattaaagaagttgagtttttaccctttgagaaaagagaaagcacgagctcacattcacacaatcgttctagctctgaccctgatggagtaattcttgaagaagaagatactgataacgagataaccaatcgtgacaaaatagaagaaatagatcaagtcaaatgtgctgtgattttcgatgaacgggaaatggaatttcaaaacatagttgcaaacttggaatatttccatcaattcatgaacttgcgaaccaactatttaacaatgacatatcctcggtatttggaacgtgtagatgggaaagttcaacatattacaaaaaagtcggtgtacgagattttattatgcatgtcgcaaatcaatgatgaacatttacctgcttatgaacaattgtatcttggatttatggaagagataaaatcagtcattcatatggtgaatgatgtatattcggtcaagattgatacgttattaagttctagtgatagatctatctcagaaattaatgcttctttgtctcttgatttgagaaagattactgagaaactagatcaattggatttctcattgaataagaatatctttaaaaaggccatactgaaaagaaaaggtgaacattctcacaatgttggtttgatttacaagattttgtattcgtgtcttgagaacattattgttgttttgttgagagtaatatggattgtggtgaacatttataaatttttgagatatattgtg

SEQ ID NO: 242 - DNA, 1221 bp, Candida albicans
tttacaatgaagttttcacaagccaccatcttagccatctttgcttcttctgctttggtttctgccgctccagccaacattgtttccgaacaaaccatggttaaaagagaagatgttaatgctattgttgaattaatcaatgaaatcaaacacatcaaccaaaagagagaccttgccgaaggtgaagacttgttggaattacaaagaagagccgacagtgttattggtgaattagtttcagctttatacaactctggtgtcattggtttagtctgggataaattgactactgatccatctatttccagctcccttaccaacatcattaaatctgctgttcaaggtgctattgtccaaggtggtgctttaatccaagctgtttggaactctggtttattgggtgatgtcttcaacaaattaatcaacgatactgatttaagacaagctttattggatgttggtaaagctcttttcaactctgctgctaacttaatttccatttggctcggtggcagctctagttctagttctgctgctccagctgctgctgctgctgctccagccactaatggtgcttcaaagagagaaattatggaagctgccgaatacttgagtgaaagagacttggcttctatcctttcttggattgttcaaactatcaaagacactggaattgttcaatctttggttaaccaagtcatcaacaacccagacactgtcatcagtttcttgacttctgcccttaaaaacggtttagttattgttgaagatctttacgactgggctaaacaatccggtttatgggatcaagctttagtttacattcaaaacaatgccggtagctggattaaagctcttgctggattattcggtaacgctttatctaacggtactatcactgcttctgatattaacaatgctggtagttcatctaaaccaactggtactactactgcttctactgccactgctgcaccaaaagccgccactccagctgctgctagtgctgctgttgcctcaaaagctgctacctctggttccagttctggttcttcaagtaacaatgctgacttgaatgctttaatcaacaaatacggtggtggttccggttctacttctactccaactgttgatacttctggtttatctagtgatgttaacactttatttaatgctgctggtcaagctgcctcttcattgaagaaaagaaaactttattag

SEQ ID NO: 243 - DNA, 453 bp, Candida albicans
gagactatagttgcagaatatggtccacattctcccaccatgaatgccaacttgactaatctggccaaatatacttcgccgtgggctggtgctcattttcgaccattcccaagtaaaaatgaacaagaattgaaagaaataaaattgacaagattgacgttacaaaaattcaaacaattgagtcagacatctccagaatcaagcattaagtttgttaaggggatagagtatcttgaaaatccagatgaacattattcgaaatttgcatatggatggagtgaagaaattgacaatttcaaacacaaaacagataaaccagggtttttaggagttgaatatgatacttgggtagtcaattctccaatatatttacaatttctttatcgtaagttatcaattgaatatagtaatatcaattttttgaaaataagattagactcattaaaacaaatc

SEQ ID NO: 244 - DNA, 549 bp, Candida albicans
cacatattgttcaaggttatttcagtgaatcaccgaaaattggttttcaattgtactggaattggcggtacatcaattggtggtgttgaagataataatgtttatcctggtagaggacaagtagtagttattaaagctcctcatataatggagaatgttctaagctggggtgatagagagccaacttatattattaagcgtccttattcaaatgatcaattgatcttggggggttattttcaaaaagatgattggacagcagcaactttaaaagaacaaactcaagatattgtacaaagaaccactagtttatttccaaagattttgaaagaaaaccccaatggaaataaaattgaagatttggaaattttaagagtagctgctggattaagaccttgtagatatggaggtgccagaattgaaaaagaagtggtagaactgggtaagattttgattcataattatggtgcctcaggttatggatatcaagctggttatggtatggctaataaggcaacagacttggcattaggtaaaagtaaattgtaa

SEQ ID NO: 245 - DNA, 1725 bp, Candida albicans
gaaaaactaaaccatcatcacaagtcgatacaaaaccaacaacagaaaagtccatcgtcatcaatggtttcacctgggtttttaattacacaacaagaatcatcagactctcagcatcaaccatctccagctttatcacatctgtcagtatcaacatttggtcataagaaacgtgaatcaatgttgtccacatactcaggagctgttgaatatgatgctgtgcccatgacagttaaacgatcaagtagttccaaaatcaaatacgttggtaatgcatcgcaaggcaatgctaataataataattacaataatatggtgtcttcaagagctcatcatcggaaaaggtcatcattatcatcaacgtcgacatcaaacaagtatagtgatcttaatacagtttccgatacaaaactgattgaaacaagtcaattattaggaggtgatgctaataatagtaacaatactagtaatagttctagacgcaattgtagctattatgatggcgacgaagaagaagaagacgatagttctatattaatggggaaattgccaactagatcaagtaaagaagatgagttaaaggctcaacaacctgataaaagtgtgaccactaatattgaagggtcaattcctgctagatcaccaagaagaccggcatctgtgatgtcacctaacttttctagtatcgatatgattaacagcagttccatcagtaacaataccactggttcaaaagataaaagtcgtcgtaaaagctatgttgaagacaataaaagaagatcaatccagattaatgatgggttagaaaaattaatgttagatgctacttcatttactagtcaagatgagaatgaacaacaagaacacgaagaagcagactatgataatactagatttattaaagatgtgacacctaatcatttaaatattcatcgtaaaaatgatgcagatgaatataatgaagatgatgatattacacctaaattcgatccatctttagtggcggcagggtcacataatggagttggaatagatgaattagataataatattccaatatcatcaagaaatagctcttatgaactgtggtcacgacatgaatctaaaagaaaatcattaactcaaccacttaatttaccaccacgtccaactaaagataatctcaccaaggcaagaacaatctccaataatttacaacaacaacaacagcaacagcaaaacttacgagaacattatgacactttggatggaaatcccgataatcttaatgccactgaaggagaagagattcttccatcaacaaataattatgttgatgatgaagaatacggacaagaagaaatgccaagaagccagaaaaccaaccaccatgttgttgatgacgacgatgacgatgatgggttttatgatataactggagaaccagtcattgttcaaccaccattagtaagagcaaaatcagtgaaaaattccattaaacgtccaagtagacatacaaaatcatctaaagataaacataaccataattctaatgattccgaaaatcatcataatgggaaaaaacatcatggtagtggtagtagtagtaagaaacaccgtaataataaaaaatcaagagggactaatggcggtggtggtttgaaaccatttagttatactacattaatatcattattagaaagtatgaatgatcttgaccacgggctggcagatccgcgctcttat

SEQ ID NO: 246 - DNA, 927 bp, Candida albicans
caagttacaagtgttcatgttctgagagcccaaagtagtaatgctaattccaacgtgattccgcagcaagaaactgcaactgaaaatgtgaatacggtatcgcaaccaacatctaccgacacagcaaagcagtcttatcatcctcatgagagtaatcctttctcgaaaatgaataacaatacatctcaaaacctgacagtaaccaatacaggcactaatcctttcttcaaatcaacgagtcaagaaaccaagattgatccacacaaagccgaagctcaaagagcctctcagcgtggtgttgctagtagtggtggatggagcgattccgaggaggaagaatcagaggaagaatcgccaaacagagccggtgcagcaaaattagctagtttgttatttggtggtatgccccaaccaccaacaacttcaagctcaagttcgaataatgatacagaaaaggtttcagaacaggagcatgaaaacgcaaaacaagtggcttctactcctttgtcaaatgatgataatggaaaaacagattcaggtccttcgggttttgctggcgagaacgaactgtctttcagtcaggccccaccaataccagttgacgcaccacctgctccaaactctattccgcctccaccgccccctcctccacaattttcgaatgaagcaccacctgtgccagattctattccacctccaccacctcctccttctgtaccaagtactgtacctgcattaccagattcaatgccaccgccaccacctccacctccacctcctgctgccccaaataacacttcatcatctcaacaggcttcaggtgcaccaaatattggtgcattgttaggtcaaatcactggtggcgcttcgttgagaaaagtggagacaaaagtttcctctggtgctacagttggaagagttttgtaa

SEQ ID NO: 247 - DNA, 1251 bp, Candida albicans
tcttttgagaaaatggaaaagttgattcatgagaaacgaatcttgttagatgctttagatactgaggatcaagctaataattattcgagatcaagttcctcgatgcacgaaaaacaaattattgaaaacttgaagaaggaaatcatggcagtgcaaaccaagttggacgaaagagggaatgatggtccttcatctgacgaacgtaacaagctattggctacgttggaccacttgacaagggatgtagtccctaggttgatatctgatatacacaaagttaaccaagaaatctccaggaaaaaagcagaagtgttcaaattagaattgttgaagaaaaacccatcgtggaatccagaagatgatgagctgcaaattcaaggaactggtccaaatggagaagtgacagattacgatagaatcaaatatcaatctcgtcaaaagttaaagcaaagaatggctgcattaactggtaagtcaactggagggaactctgatttggatttggaattgaagcaagctacagaaaaggcgcaagatgaagcatctcgtcaatcagagatgattcaagatattgctgccggtatcaaaacaatggaagatgaatgtgccgctaaattgagctcgtccgttacggaggatgttggacatgaaaaatgggaacaaggaaagggtatttcttctgaagtagccaagtttgtgaaagagttagaagcgttttccaaagaacaaagacgtaatattgctaaatcccaaaaacaagaacaaacacgagaaccattggctaagcaacaaactaacgcttctttagtgtcggattctggagccgcaaaatcagcttatgctactcctgaagaaagggctgcttatattaaacagcaggctgagaaaagaatgaatgaaaggttggctaagcttggtattactaggaaaagcaagtcgactgaacagaaaccacctgttgagtctaaatcggtcagcaatcattctcctgttccagatagtgaagttaaactggtcacaagaaacgccaatgaagttgaggtacaaaaaccaaaacctgattctcaaccagtttccaagaaccgagaacccgctgaacaaccaaattcaaaggctgatactaacagtgttggttctcaaaatgttgtctcaaatacaaatgatgatacttctggtgatgatgatgatgaggagtacaaagctattttgaaacaaaagcaggaaatggaagctcgtgaaagggaaagataa

SEQ ID NO: 248 - DNA, 1413 bp, Candida albicans
gtgatgtataacccgtatcaacagcaacaacaaggtatggggtacaatccccaacaacagactggatatggctacaataattaccaaatgcctcagcaaccccaattcaaccaacaaccaatgtatcctcaggcaactggatttgttccccaacaacctaatttgtatggatcaaattttcagaccagtggtggtagtggtatggcaccacagcaaactggattttcacaacagcaaaccatgcaaccacagcaaacgggctacattcaaacacagcctacaggattcggtggaactgcaccaattgtaacagaaaatagcgagttgaaaattccaagtatcagattatcgtttatatctgcagaagatcaaaagaaatttgaacatttgttcagaactgcagttccgaagggtgagcaatccatcagtggtgattcagccagtggcattttattgagatctgggttatctgcggtgactttagccgaaatttggaatttgtctgatatagataaaaccgggtccttattatttcctgaatttgctttgagtttgcatttatgtagcatggctaaaagaggcgaaccattgccaggtatacttccagaaaagtggttaaatgaagtgagaagttttgttgatcaaatcaactttactgttccagatgatccatcgaaaattttagccaacacgccatttgcaaattttgctcctaaaaaggagtctgattggttggcccctcaatcgactggatatttgcaaaaccaactggctccaccaatgacatcatttcaacctcaagtcactggttttggtggacagggattggtttcgcaggcaacaggtggagtgccaatgccttcaactacatttggaaatgccgcgggattgactgctcaaaggacaggtggtggtacgttgattcctttacaaccacaacagactgctggtttgattccagctcaaaaaaccgggcctttgaatcctcaaaccactgggtttaaccaacaaagtttacaacaacaaaggactggtggattacctcaacaacttactggctatcaaggcccaccccagggccagggccagcagctacaacaacaaagaactggtggcttcccgcaagttcaatctcaacctaccggcggctttgtgccacaaacatcttttcagcagcctcaactcgtttcccagagaacgggtccaatgcaggcccaaccaactggctcattgcaagcacagcccaccggtagacctggtgaatggggatttgtttctatgccaacaggtggcattcctggtttaaatgcaatgcaacagcattttttaccaaacaaccaattgccaacatccaatttgcatagtgctatggacaacaaattgaaagagaatgtaacttgggcaattactaaa

SEQ ID NO: 249 - DNA, 606 bp, Candida albicans
cgcggctctctccaagcccgtttggaagaccctggtaaattagataaaagtgttatatgtgatatgcctaattatgaagatcgattagatattttacaaagtattactacaaagatggatttgagtgatgatgtgaatttacatgaaattgctgaaaaaactactggatttagtggggctgatatgcaaggtttaggatataatgcttatttaaaagccgttcatgtgacattagaggaattatctcaaagggaacaagatgaagcaaataatgaagatggtaataataattttgaaaaaaattccatagaattctttcaagtgggtaattcagaaaagaaattaaagaccaatgaaaaaatccaattattacatcaaattcaacaatttatgaatcctaataaagataattcagattcagaaagaaaagtaggtcaagatccaatgaataaatcaaaagttttaattactcatgagaattttttggaatcattaaaagaaactaaaccatcaatttcccattcagagaaaatcaaattaacgaaaatttataaagaatttgttaatgatcgagatggtaatatgcctgatgggacccccaagtaa

SEQ ID NO: 250 - DNA, 705 bp, Candida albicans
  unsure (12),(18),(669),(699): Identity of nucleotide sequences at the above locations are unknown.
gcatcggcaganattttnctttccccgcacttcccccaccacctttcaaacaaattgatcggaacgaaatttttcatccaccgcccacagaacaaaaaaaatttcttatctgttctccacattgttcttcttacaaacctatgttcattacaagtacttattaatcaaatggataatcataaagctagaatatcttataagacattaaagtctaatttggttaatttaccatctagtttaaccaatttattattcaccgccaacattcaagttcaagatgtgataatagaaatggttaccaccacttcaaatggtaataaaaagaactctaccaccactaaacactatgctggttggtctggaatgtcatcctctgatatttctaatttagaaatagatccagtatttgctcaatcattaaatcttattgataaaacccctatcatagtcaatttaaaacttgggaattatgaatcaactaatatcaatttagaaccattaacaagttctgattgggaattagtagaattacatgctcaatcaattgaagataaattattgagtcaaactcgatgtgtggccttaaatcaagtattggtagtataccctagtgctacaactagtgccaaattattagtaacagatttaggtagtaccgatcatacgttnttctctcacagacagccaagaatccgaatntattgt

SEQ ID NO: 251 - DNA, 765 bp, Candida albicans
agacaattagtgaaaattaaaacagggacagaaacagaaacagaaacagttgtcgttagagtattcacattcactgaacctcaaaacagttttaaaactggtaccgtctatatgtctcctattttgttgataaatcttaaattacaaaaagattcctatattgaattcgaacctgttactcaattagatactttatccaacacaatccctattgcagaatcagtgacaatttctagagttagttcacaaatcaccatggataaaacttatcaacaaagttttttctcaagtttaaagacaactttgagtactcggttgaaatgtgtcaaacagggtgattatctccctgttgtgatcgacactgtcttggctaaaaccatgtttgataatttgattgaagacggtaatgaaaatgaagagacttccgggtccaacgaaggtggaatcgatgttatccctattggtaatccagatgcagtcgcatggtttaagataactgaagttaaaggggcaaacagtattgataccaaccaatttcttattgatccttcaaaaacaatgctagtgtcatctggcgtcgaaagtattaggttgccacaaaattcatttgtaaaatggtatcaatatttgaatttacctccaattttcaattatgaagaaactggtgatttcgaatatgctaaagaatttaagaagactttgtctacttgtctggattccaagattaatttgaaaaacttcaatattatcgacatcaatgagtaa

SEQ ID NO: 252 - DNA, 831 bp, Candida albicans
acatcaatcgtaatgccatccgttgcatcttcttctaatgaaggttcctccactagagaagcttttgaatcagtgacttccattgctgatgtttcaataatcaatgatccttcacttgaccaacatgatacattagatataggtgatgcattattctccaaattgtttcctaaggaggaaataaattcaactaccgaaactgtcaataataaatatgttttggtcaagttattaggagctcctgattattttaataaatttagaatcatgaaacttaatcaagtccgttatcaattaagagaatccatagtgattacaaatgattcaaatttagtaaattttaataatgattcgttgactttaaataaagctgtcataaaatctattgattatgatgatatacccaaattatcacaaatatttgtttctatacctcatgaaatctatcaattattacatgaaaaatcccaacaagctataaaacaaaagtttttaacacaattattggttgataatgggaatgttgtaaatgaaggagactctataagattaattaatggaaccgtcaatttatgtgaacctttgactcaaggtagagttgaatatgatactaatattgtgttgattaatcaaaatgaagataaatataatgagcaagaaagtattgatatagaaaatgaacgagatttggagtctgatcaagatgagaatcttgatttgtctagttatgtatcatcaagtttacaatgtgacaaatttgaccaatatacgaaaccagaaaactccattagatttaagggtgggtccattaacacaaaaattcaatattga

SEQ ID NO: 253 - DNA, 807 bp, Candida albicans
tacaatacccatcctcctactatgttgacattagcaattggtgatctttttgttcctgaacgggcagtcgatttgccgagcaagtttcgtaaactattagctcctcaaccaaacaatacacccagtaatagcaaaataaaccaagtgatatgtttaggcaacattacaaattcgtctaccatattacaattcttaaccaatatatctccacaattcaacttggttaaaggcgagtttgataatcctgtggttctatctcaacagttgtccctgttgaataagagtagcaatatcccactatacaatagatttgttcatgacaatttaaagataggatacaccaacgggtttcaagtaattccaagaggcgacccattagcattatcggcatttgcaagagaactagatgtggatgtgttgatttggggaggtactcacaaagttgaagcatacactttagatggcaaattttttatcaatcctggcagtgccactggtgcattcaactttgactggccagaaaacgacgaggaggaacgggaagaagcagacaagagccaagatgatgatgaagcgacagacaaagaaagtcacgacaccgaagaagctgaaccgaaagtagaaaatgagaccagcacgtctgctctggacgatttcaaacaaactttacacgaagtgagcgagataaactcgaatatcccttcattttgcttacttgacacgcatggctcgacatgcatattgtatatttacactcaaattgatggagaagtcaaagtagataaagttacatacacaaaagattag

SEQ ID NO: 254 - DNA, 903 bp, Candida albicans
acacttatgcagagttatatcataaagactatcattttcaatccccaacctcaccactccaagatattaatcttccgccagtcaatttcaatttcggcaccagcagcagcagaatcaatgaatgctccacatgcaggtcaaacccagacttccccagtggccactccggagcccaatccaattccgactgcaactatgcaattatcggacactgggctgaatttggagctccaaattcaacgaattattgaacgtgaagttcaaaatgccgttgcaaaagcaatggatgcaatgttacctactattgcaccacattttactgtttcgtatccatcgagtgttgcctcagctaatggcactaccaacgaaacggtcgtcatccctcgtccagacttgacgaacaatacggccacttcagatccaagtaccgtcgcactgtccaatagtcatcttgctaccaatatcatgagtcaaccacagtcatcaactgtcactctttcagatgcacccgcatccaaattggttaatattagaaagaggctccaagaccttgatcaaaaattagcaccaaaaagtgttaaattgaccgatatcgctcgaattcacgagcatttagcagtcattcatgatccaaactccaagcttgaacaattatatggggagtattacgatctcttatggtcaatcccagttagtgaacgctctaaggaggagaagaatgcacttaagcaattcgagatagggtctttaccttcgcacaggtcaattgattcgagggtcaatttccgtatgtggatgcatgagctattatattttaagctcaagtactatatcccggatcttatcataggagctgtgattaaacctgctgcgcagaaaacgcgggctaccgaactaatttgt

SEQ ID NO: 255 - DNA, 1128 bp, Candida albicans
cgcggtcttccactcgtggtgaagacagcaggtcttatgtgtgcaacctggttggcaaggtgtggaataccttttagaatcatcgataaaagatccaacgaagtgtttgctggtcaggccgatggtttacaaagccgttcgttggaaattttcaagtccttttccgaaccagcatttgattttgcaacattagaccaaagttggaaaatggccaatcatgtcattgacatgtgtttctggtcacctgatgaaactgggaaattgattagaaattccagagttgccgataccatcccaggtatatccagatataccgaatcagtgattcaccaaggcaatgttgaaagatggtttgaaaactcaattgattatttctctgatgggaaagtcaaggtcgaaagaccattgttgccaatctccctcaagattgataccaacaaagccactaacccacaggctcatgctgttgaagtgttggttacaaagttgaattcagaagctgccaaacctgaacaatatggcaaggttgccaatggtcttttccgtgcctttgatggtgatcaagaaaagttttataaaaacatagatgataccaacgagcacgaatacgaggtcattcacgcaaaatatgttgttggttctgacggtgcccacagttgggtgagaaagcaattaaatatcgatatggaaggagaacaaaccgattttgtttggggggttttagatatggtccccatcaccaatttccctgacattagaaaccgttgtgccattcatgtgaaagattctggttccgtcatggttatcccacgtgaaaatgatttggtccgcttctatatccaattgaaagaagtggaaagagatccagccaccaaagccgatgataagcaattcaatggtaatgttgaagacaccaaagccaaaaccaaaggtagaatcgatcggtcgaaaatcactccagaatctatccttaaacaagctcaggaaatattcagctttcacattgaaatgacgaacttagctggtacacggcttatcaattggaccagaaattattcaagttttctaaccaaaccgttttcttttcggaatgcattcatattctttctccaaatcggccaggaataa

SEQ ID NO: 256 - DNA, 579 bp, Candida albicans
attattagtcaagccgatggtagaccaattcatattgctgatcgtctttcatctgatggtagatttagagtattaattttcccaggagatattaaacaatatcctaacaatttaaaaattttacattcatttcaagatttattagatgattccaaaaattttttgaaaaaattcactccgttaaatgctttccaagattcagttattgatataattactattcataataataatcgtcatgaagttgaaatttttgatttcccagatttcactcatccattagattataaacatcgttgtgattattggaaattatattctggtaaaggtgatacttatcatgaaggtaaaatcaatatgtatgatgattatggtattgatcctaaacatggagtaattcttgttattagaccagattctcatgtggctaaagtggttccattttcaattgatggattgaaacaagttgatgaatatttcaagaaatttatgattgatcaatctaataatgttttagcttctaaaccaattgattatgatgattccaaaagatttattcaaccaagattagccgtataa

SEQ ID NO: 257 - DNA, 1074 bp, Candida albicans
tgcggttccttccaggcccgtggtgaagatccacagttttctaagcaaaaccgtgttttcatttctggcgatgcatgccatactcattctcctaaagctggccaaggaatgaacgtttctatgcaagacacttataatcttggattcaaattggctttggtctgtaaaggattagctaaaccagaaatcttgtccacttatgaactggaaagattaaaagttgctcgtgatttgattgctttcgatcataaattgtctcgtttgtttagtggtaaaccaatgattcctaattctgatatactagatggcgttgacatggacgagttccaccaagtttatcttgaaggcaataaatttgcatctggtactatagttgattacgaggattcgttgttggtttcaaaaacaggtgcattaccagtcgatagcaatgattgtacaatggatcaaaaagctgccaaagtccctattggaagaaggttgaatagcagcaatattatttgccaagcaaatggccaaccagttcatattgctgatcgtcttgcttctgatggcaggttcagagtgttgatttttcctggtgacgtcgtcaaataccctgaaaacttgaaaacattgcacaagtttcaggattccttggactcaaagcatttctttgccaaaaaatttacccccgtcaatgcatttgccaactcagttattgacgttatcacggtccacggatccagcagacacgaagttgaaatctttgattttccagactttactcacccactcgactttaagcgtcgttgtgattattggagattgtactcaggggtaggagatacatatcatgaaggcagtgtcgacatttatgacttctatggtatcagtaagagcgaaggtgttattttggtcataagaccagattcccatgttgctcaagtttctcaatattccattgatgggttgaaagaagtcgacaactacttcaataactttatgatcccacagaccaataacgttttaccaaccaaaacctctgatatcaatgattcgaaaagattcattcaaccccggttagctgtttga

SEQ ID NO: 258 - DNA, 3192 bp, Candida albicans
agaagttgcaacaaatcaaatcaatatttgaaaagacatggatcagcaggggatgatagttctttatcaaatgccgatataaattttcgtaattctatttcatttttgaatttatatcaatttttcaaaaaaattcatcaagatctacttcgattacaacaatttattgaattaaatgagaccggtttttctaaagtggtgaaaaaatgggacaaacgttcaaagtctcatactaaagaattgttcatttctacagcagtaagtgttcaaccagtgtttcataaaaatgaaattaatgaattaagtgatttagttacacaatcattatttgatattgaaagtattatggatggtgattattccagtttactgaattataatgcttcaaattctggtgtggtatccactacagccaccacaggaacaggcaatagttcaacacctccagcacctaattttaatattccaagtgtgccaggtattggtgaagatcaagctgaagaaattttcactagacattcttctattgttagtaatcaacccaacaataatgaaattgatgaattatacaccagttttgttaatgttgcaactattaaagaacctgatttatcgttattggctaggtgggtggagaaaattaataatggtggcagtaaattaccagaacagcctttcacccctgttgtgaaatataagatatcaaaaattttcttattatctataaccaatttgaaaatttcagattcatttcttgaattgtttttacaatttattaattacgacgttgattttacttttattaatgacgatttcaataataataaaacaatattacatcaatgttgttctataccaacggcttcatcacagctggaccccaacaacaacaacaactctaacaaccatcatccacatcatgtcacaattaacaatggtgttaaagttattaattcaactgatttaataaatcattctcgtacatttattgttaaatatattgttgaaaagttgcagttcccctctgtggaagagaaaactaaattattggttcataaggatttcaatgggaaaacttgtttacattatgcagcacaaatgaatcgacctgatttgttggatttattattgttgtcatacccacaatcacatattgatgaattagataatgattctatgtcaccgttacttttagccattaaacacggacatttaaacatcaccaagaaattagttcgatttggttccaatcctttccctacagctagtaaagatactttacagtacttaccaattaattatgcttgtaaatttggtgattataaaactttagaatatttattatccaatgcaaaatctcaagaattaatcgcaaaattaattaatcaacaagatgtcgaaggtttgttgcccttacatgttgcatcaagacaaggtcattataaattgataaaattattaattcaatatggtgcacaaattaataaattggacggatttaataaatggactcccatattttatgctgccgctgaagggcatgtgaaaactactcaagaattgattaaatttggagccaagttaaatattattgatgaagatggctataatgtattatattattgtgttgttgaaggtcatattgatgtgattaatgagttgttgagttattatcaaaaagcattttcttcatctaagttgacatcagattcagccaattcaacaaactctacaaattcaacgtctatgtcgattttaggtaacgataaggatatggattctggagaagaggaagaggaaggggttctggctataacaacaacaacaacgccaacaactgcaactgcaacagcagatgttgatgtatcatctttgaatgaaaactctagcaataacaacaatgttgatagcatacctgatttacaattaccgccaccaattttaccattacgaagatatggtcataattttttggaacaaaaagttttaattgaattaattttcccttcggatcaggtgtttattaacttgtttaactcaactgctgatttgaaacctggaagaataaccattacttcaaatatatcagatattgttcctagaaatattctattgccaataaaagaagatagctacaataacaatagcaatagtaataataactgtgttttccaaactgatgttgattcattatgtgaatttcgaattgattttgaaattttccctaaatttggtacgcgattaattgctaaaactacagcattatcatttgaacatatcactggaaattcaccagaaattaatactgtcctgcttccattgtttgacttaaggttgaaaaatattggtgaattaaaatttagctatcaagtgattttcccttattcagggacattattagaaacttctaagtttgatacttattggaaaagttctactagttttgttaaaaatagacaaactttgaaattaaatgcagctggtggattatcaccaaataactttttatcgccaggatcagtgtcaaccatgccaatccccaacaatgtcaatactattaacaacactatcgacgacgacaactatattaatagtagtaatggtaatgggcctgctggtggtgatggaacgaactccactttaataccatcaacacaatctatagttactgcaacttcattatcaggagaatatattcgaattaaagtttgtttattgagtgatggaacacatattgtttgtcataattggtcaatatccattaatgataatattgatttgtatttgcccaaattaactttaaaacaattgaattccattactaatgatatatttgattatccaagaattattcatgatttatatcggttaagtaataaagatataccattaattaagaagttattacaaattatttatttaccattggatttggtattggatattttaaatattgatattaatttgaatttggaaattgttttcccatcaatttatgaattagaaacattaccatttattaataatattctgaacaacttgaatcaatttattgataatattttaagtaatgttttcaatcatattagatccaataaaaaacgtcaacgagaaacctccctactggcaacacccctcctaataataacaacaattataggtcaattatttttctttcttcaaattcattga

SEQ ID NO: 259 - DNA, 591 bp, Candida albicans
aaaacgtcaacgagaaacctccctactggcaacacccctcctaataataacaacaattataggtcaattatttttctttcttcaaattcattgatttgtaaaattttaaattggaaacaacccaatttcccagtatttttaatcatgagtggtattgcctttaatactaaattgaataaatttgttaagagatcaactaatggattagagattgctccacatgtttcccaaccacattctcaagataatcttttacattcgcattctacttcatcgtccccttcttctgcttcattggaattggatgatttaaccactagatctattaaggaagcagttaattttactatcaacaataatttaattggattaattacatcaattcatttattagatttagttcccaaattgatcccattgattagatctacaggattaatattagtagcatcaagtgatgtaattaatgaagataaagataaacaagatgacgcaatcttacgcaaagaattggattgttataccaaaacagaaatcaatgggttgagatttgatgatgtattaagttttaaagaagacataagtatgtaa

SEQ ID NO: 260 - DNA, 762 bp, Candida albicans
tttttatttttatttgatttcgaacctttggtgtccccccccccctcaaacaacatgagattgatcttacttttattcattagtaccacagtaacatcattaaatattcttatcactactactgacagttgggtatctaaaaacactagacttttatacagtagtctaaaagaaaagcataatgttaaattaatggcgcctttatatcaatacaatttggaaaaaaacaacattccattgttttccaacaaattagccaaagatggtggtgaatatggtcatttgttatctgtccatcaaacatacttccacaatttgaggtctattaatagtaaaagagctaaaggagttaaatttgaacaagatgaatcacaatcagaatcagaatcatctactcaagacattgtccaatctaatcaatttggtcaggaccccttggataaaaattgttggtatgttgattctaatccatttaatagtttacaaattgggttagatgtaatattaccaaattattatccagacttcaaaccagatttaaccattattggaccaaatgaaggtttgcaaaatcaacaaataatcaataaaatgattcactcgactatcaccaataataatatatctaccattgctttttctactgaagatgaacatcatatttattatcaagatgaaaactatttccatattagttcaaattctattcatcaattaatgaaacataatgttttcaccaataaacatcaagttcataaataa

SEQ ID NO: 261 - DNA, 990 bp, Candida albicans
gaaacaaatcaacttacaatgcaattcttaacttccgctttagttttattattatcagtcggtgctttggctaaaaacattttattaaccaacgatgatggttggcaagctaccaacatcagagccacttactacaaattgaaagaagctggccacaatgttttcttggttgctccagtttctcaaagatctggtttcagtggtaaatttgatattccaacttctccaactttacaaaccaacggtgaattcaattacccaccagctggtgctccatcttggggtcacgaagtcgatgataaccatatttggtatttcaacggtactccagcctcatctgctgttttcggtatcaactacgttattccaaaatacggtgacaatgttactattgacttggttgtttctggtccaaatgaaggtactaacatgtctccaggtttattcaccatttctggtactgttggtgctacttacaccagtatctacagaggtattccaggtgttgctttctctggttcaaactccaacaactccttcttcaaagatagcttggatttgaaagacaacaaagaaccatctaccatttacgctaacaaggttgttgaatttgttaatcaaattttcaaagctcaaggtaacaacccaagagctcttggtctcggtgttggtttgaacgttaacttcccaaaagttggttacgaaaatgaaacttgtactaatccaaaatgggttttcactagattgactggtcaatatgctgctggtgccaacttggtctacaatgaaacctctaactcatttacctggggtcaaaaaagttgggatggtcttactgtttgtaacaatggtgactgttcattaccatcagaaaactttatcgttgaacacaccaactgtcaatcttcagtctctgttttctcagttgactacgatgccaacttgggtttgacttctcaagttaaacaaatattaaaccctcttttctaa

SEQ ID NO: 262 - DNA, 237 bp, Candida albicans
agccaaaaaaaaatgtattcattaatcaaatcattggccacatttgccacactcttttcattaactttagccaagtttgaatcgtccaccccaccagttgaagttgttggtaacaaattttatttttccaataatgggtctcagtttttaatcaggggtatcgcctatcagcaagatgccgcgggctcagtttcctccggttacgacgccgatcctaatagaaaatacaatgatcct

SEQ ID NO: 263 - DNA, 621 bp, Candida albicans
actccattaatttcatacacttatcaaaaacagtatacacagcaatcatttgtcatgttctcacacagtggcacccaaactcctgtttcggcttcctatcaacaacaatcgcaacctcatcaactacaaaacaaagtacaatttcatgaacaattggatgaaaccataacctggatcaacgattggtattcaccaaacttgatcaataataatactataagagatgctaactataacaagagcggacaatttgtacattacagtgttgacaccaataagggccatcagggccattctaatcgtgtatccacaattaacaattttgaagaggaaaactcgactccggcagtaaacgattccatcagattgaaaggttggcaccggacaaatttgaaccacaaacatggtgaaagtaacgaacactacaataatttgaatccaagtgatgtgttggatttgaataaatggaggtatttcaatgaagttaaccaaaatgaaaataatactaccatgactacaaacaaagatgctggtgtttcctctgctgctgtcaaacaagaagatccagtttccaaagactctgcagttgaaaggtttagcgataccatcaagctacagtaa

SEQ ID NO: 264 - DNA, 1602 bp, Candida albicans
atttttttttttacgcgttgcgtgtggtcgtgtcaaagacgaatttatatcgttcgagggggacttttttttttttcacacccgaatgtaattcaaccgaaaaaaaaaattaacactaaaatcagttgtcgtcaaacaagccacagacatacgctcacactattgttaaacttacaccaccaaacttgtcaattgactatcatggctacaagtaaaattattgactattttagattgaaagatattgtaaatcaaagaattgtgtatgatttgcctttaaattacactgattctcaatcttcctccactattaaggtagctattaccattacttctaaatatgataagaatttgcataatgacaaagagggatttgaaaaagtgttattacctgaaaaaccaaagataattgtatatttacagggagggcctgggtttccatgtccagttcctacttctaatctggggaaaaccaaagttctattggagaaaggataccaaattgtttatctagatcaacgaggcactggtttaagtactcctttggaagtcaaaacatttaaaaatttggttttgaaagagtacgggaattttgaagtggattcgcagttgaagtttattttaaacttccgtgctgactcgattattcgtgatttggaacaaattagaaaagatttaattgggaatcatcacaaatggtcaataatgggtcaatcatatggtggattttgctgtttcacttatttgtctttgttcccagaatccattagtgaagttattattacaggaggtgttccaccagttcaattcaaagctgatgacgtatacaaggcgacatatcaaagaacaattgaaagaaatttgcactactacgacaagtaccccagagaccaaagtaaagtggttaggatttgtgaatatttgaatgcaaataaggtagttttaccaaatggtggtactttatctgttgaaagatttcagcaattgggtttaagatttggtggcacaggcggtacagatggtattcatcttattgtcagtaaatttgattatgatttggacttgtttgggtatccaacttatgatttgttaaatacaattcaacaatttttggggtttgaaacaaatgtgatttatgctttgtttcaagaagcaatctattgtaatggaaattccaagagcaattggagcgcagataggttgaggtatgccctcgacaatgaaaaattgtttactttgaacaaggaacaagttttctttactggagagatggtatataagtccatgtttgacgattatagcgaattgaagccttttaaagagctagcttacgcgttacacgacttttccgagtggtcgaccatttacgatcccaaagttttgaaaacaatcacttgggataaagtgccaattgttgcagccacctactttgatgaccaatatgtcgattttgaaataacaagaaaagtgaaacaagacataattcctcgtggtaatttaagacaatttatcactaatgagtattttcataatgggttaggccaagatcccgaaaccatattatcgtcattatttgatttactcgacagagaaatagattaa

SEQ ID NO: 265 - DNA, 711 bp, Candida albicans
  unsure (51),(711): Identity of nucleotide sequences at the above locations are unknown.
ctgctactgttccgtgatgaacattattcaacattatcaccttcagctaanattccatctggtgatagtacagatttcagtgtaacttgtggtattcaagttgttactgttgaatcagcttctgctctttcaactgatactgatacttttacattgactagaaatgataacaaaaaagaggccacccctgttgcacaaataactgatggtcaagttcaacatcaaactactggtggtgtttctgctattaaacaaattagtgatggtcaagttcaacatcaaactaatgctgctcaaccaattgctcaaattagtgatggacaaattcaacatcaaactacagcaaaagccactgatacaccagtacaacaaatcaatgatggacaaatccaacatcaaactaccgttcaaccagtagctcaaatcagtgatggtcaaattcaacaccaaaccgccaaggccactgccactccagttcaacaaattggtgacggtcaaatccaacatcaaactaccgttcaaccagtagctcaaatcagtgatggtcaaatccaacatcaaactgttaaagcctctgctactccagttcaacaaattggtgatggccaaattcaacatcaaaccactgctgctgctgctactactgcttctgctgttacacaaatcaacgagtcttcaccagccggggcgaaggaacaacgtaaaggctan

SEQ ID NO: 266 - DNA, 537 bp, Candida albicans
atcatgaagtattctacacttgttagtattgctgcttttattagcacctctttagctgctactgttcctgatgaacattattcaacattatcaccttcagctaaaattccatctggtgctagtacagatttcagtggtacttttggtattcaagttgttactgttgaatcagcttctgctctttcaactgatactgctacttctacattgactagaaatgataacataaaagaggccacccctgtagcacaaataactgatggtcaagttcaacatcaaactactggtggtgtgtctgctattaaacaaattagtgatggacaaatccaacatcaaactaccgttcaaccagtggctcaaatcagtgatggtcagatccaacaccaaaccgccaaggccactgctacaccagttcaacaaattggtgacggtcaaattcaacatcaaactaccgttcaaccagtggctcaaatcagtgacggtcaaatccaacatcaaactgttaaagcctctgctactccagttcaaacaaaattg

SEQ ID NO: 267 - DNA, 753 bp, Candida albicans
ctcactatgaaattctctactgttgctttatctttgccattaattgctatggttcaagctggtatttccagtcccacctattacaagccagaacacaatgaagaacatggggttgaaactgttgatttcgaatttgctttaggtgttagagaaaaatgtgatgatagcatcatttacttggtttatgaagttgatgatggtcaattggaacgtaatgataagaaagtcgattgcaactgcaaatcaaaaagagttttccgcccagccccaagtccatcggcaattgctgtagttggtggtaatgaagaatgtgatgaagattgtgatgacgaacacagaaagaaggggtccaaacaatacaagcgtggtgaagtcgaaaacccacgtgaaactagggattgcgacttctgtactattgagaaatctttctgtcaagatcatttcactttatgtgaaggtgttttgaaagatcaacattctgctattggttcaattgtttccaaccatcaattccaatttgataaaccagcccaaaaggatgccttacatacttgtggctggtcaattgttgaaaaagattgtgttaaattgttagcagttgatggttgtaccgatttctgggaatgtccagttgatgattgtgatacttacaaattatataattcagcaattgatgccaaatgtaaggaaattgaaatcattgttattttattcgaagaagaagaagaagaaagtaaacacaaatcatggtaa

SEQ ID NO: 268 - DNA, 276 bp, Candida albicans
aaaatgacattgaccgatggaattttacgagattctgatgatagaattggttgtattgtatcgggtcatcaatttcaatttgatggacctactcctcaacatggtgctatttatgctgctggttggtcggttacaaaacaaggacaattggcattaggtgattctactaaattttatcaatgtgcttctggagatttttataatttatatgatgaaccaattgctttccaatgtcatcctgttactttagatgttgttgaattaattgaatgttaa

SEQ ID NO: 269 - DNA, 927 bp, Candida albicans
atcatcactaacaacaactcaacttgtcattacgatatgaagttttccactgctgctttaacattttcattacttgccattgtcaattcatctgttatcacatatgacacagagtttggagacaattatgaacataaacacgacaaatacgattgtgaaattgatacctttaattggaaatttgctttggtggttaaagaatggaaatatcacaaagatgagaagttctgtaaagacactgatttggatttagtttatgaaggtgaagatggtcaattatatcatggatgtgatggaacctatccttactccaaatgtaaacattgtacaaatgtttttgctggtggtgacgataataaatggaaagatgacaaatgggacgataaatacaaagataagaagtgtcatgataaatgggatgacaaatgcaaggacaagtgtgatgacaaacacaaagatgatcattgcaaggatgacaaatgccatgatgacgataaatgccatgatgatgataaatgccatgatgatgataaatgccatgacaaatgcaaagacaaaaaatgtgatgacaagtgtaaggatggtgatgataagtgtcacgatgattgcaaagatgatgataaatgtgataaacaccactgcaagtatccatattgtgaaattcataacactgattgcgacttgctcattaccttatgtaatggtgttttgaaagataaaagagatgccactggagaaattgccgctaatcatcagttccaatttgacaaaccaccgcaaaaggatgccttacacaaggaaggtttctctattgttcacactgaaggaacttattatttggctcttaaccacaagatcgagttctggcattgtgaagttgacgacaaagggttataccagatttatgataaatctattggtccacaa

SEQ ID NO: 270 - DNA, 906 bp, Candida albicans
ttcagaaatttccattatggttggaataccaaaattggtttaaaggatattgacaacaataccagaatctctaaattgtccatcccaggaactcataactctgccgcttgtcacactgcattgccatctgttcaatgtcagggagcaagtgtcaccgaacaattggaacatggggtcagatttcttgatattagagttggaaagttgtttgtcggtaatgatgtaaaggacttgcaggttattcacggcaaattccctgtcaaaatccctttccctttgaaattaaacgacacgttagaagaagtttataaatttttagcacacaattcttcggagactgtcattgtatctataaagcaagaagggtccgatgattgggacaattctcaagatgaatttggtaaattaatttgggataaatacgtcaacccaaataaggacagatggcatttgaacaccgacattcctaaacttggtgatgctagaggtaaagccattttgttcagaagatttggtgttcaagatgaacaattgaagaaacagtttggattctctgcctcgtcttgggcttacaataccaccaacgatgaccgtggtcaatttgtggttcaagatttttgtgaagtgaataccgctgacgacttgccaaagaaaatcgattacgttaaagatttggccaagagagctcaagattatacttctaagggtgatgacaaagtgttccttaatttcacttctgcctcaaacttttttgatcagtcatgctggccacaacctattgctgaagctatgattaaaggtaacatccaagaaactttccataagggtgttggtatcattgtgttggattatgccgagacagataactggaagttgcctgaagctttaattgatactaatttctag

SEQ ID NO: 271 - DNA, 768 bp, Candida albicans
atttcatttctatatatactttcgtttaattcttcaaaatcttttttttatcttctctttcttcattccttcttttttttatcatcgattggtttctatttcaattatttgttaaatatggtcgactacaaaacttggttaaaggatattgacaacaataccagaatctctaaattgtccatcccaggaactcataactctgccgcttgtcacactgcattgccatctgttcaatgtcagggagcaagtgtcaccgaacaattggaacatggggtcagatttcttgatattagagttggaaagttgttcgttggtaatgatgtcaaggacttgcaggttattcacggcaaattccctgtcaaaatccctttccctttgaaattgaaggatacattagaagaagtttataaatttttagcacacaattcttcggagactgtcattgtgtctataaagcaagaagggtccgatgattgggacaattctcaagatgaatttggtaaattaatttgggatagatacgtcaacccaaataaggacagatggtatttgaacaccgacattcctaaacttggtgatgctagaggtaaagccattttgttcagaagatttggtgttcaagatgaacaattgaagaaacagtttggattctctgcctcttcgtggacttacaataccaccaacgatgaccgtggtcaatttgtggttcaagatttttgtgaagttaataccgctgacgacttgccaaagaaaatcgattacgtttaa

SEQ ID NO: 272 - DNA, 912 bp, Candida albicans
tacattaattcagatatttcaataatggtcgactacaaaacttggttaaaggatattgacaacaataccagaatctctaaattgtccatcccaggaactcataactctgccgcttgtcacactgcattgccatctgttcaatgtcagggagcaagtgtcaccgaacaattggaacatggggtcagatttcttgatattagagttggaaagttgtttgttggtaatgatgtaaaggacttgcaggttattcacggcaaattccctgtcaaaatccctttccctttgaaattaaacgactcgttagaagaagtttataaatttttagcacacaattcttcggagactgtcattgtgtctatcaagcaagaaaggtccgatgattgggacaattctcaagatgaatttggtaaattaatttgggatagatacgtcaacccgaataaggacagatggtatttgaacaccgacattcctaaacttggtgatgctagaggtaaagccattttgttcagaagatttggtgttcaagatgaacaattgaagaaacagtttggattctctgcctcttcgtggacttacaataccaccaacgatgaccgtggtcaatttgtggttcaagatttttgtgaagtgaataccgctgacgacttgccaaagaaaatcgattacgttaaagatttggccaagagagctcaagattatacttctaagggtgatgacaaagtgttccttaatttcacttctgcctcaaacttttttgatcagtcatgctggccacaacctattgctgaagctatgattaaaggtaacatccaagaaactttccataagggtgttggtatcattgtgttggattatgccgagacagataactggaagttgcctgaagctttaattgatactaatttttag

SEQ ID NO: 273 - DNA, 621 bp, Candida albicans
atgctccagtatttggcgtatctaatcaagtatccgttattaacaaagtcgatcaccagtggagtcttttctgggttgaacgagactgttgcgtcggtgttgaccaacgagtttcaggaaacgaaaattgcaggtatcaagatcaaacatgtgtttacccagaaattgttgacaatgattatttatgggagttgtattgccactccaattagtcactacatgtactttatcattaataataagatatttaaaggcccattgacaaagtccggaaagatcttacagatcttgacgtctttgagtacggtcacaccgacccttgctgcgtgttttgtatcatggattgcgttgatcaataattacaagttacccaaaggttccatcaacccaattgctgaactcaacaagattgtggctatagtgcgtgctgggttaaagaaagggtacttcggagttttgaaaagttcgttagtgacttctagtgtggcccttgtcattgcacagaaatttgtaccgccagaactttgggtggtatttttcaatgtggtatactttttcttgggcacttaccaaaacacgaagttgaaaagattacagaagcaacaacgattagcaaagtag

SEQ ID NO: 274 - DNA, 1158 bp, Candida albicans
cgccctaattccacaacacacatttttttttttttgacagatgaaatctctaaacaaaaaatatctaatattttctttgacgtacacctacatatacatacatatttacatatacacccttatagttgcaaatatttattgcatttatcattaaataaaaatcagatattcaacataaaaccatcaaaaataatgactacactttttccaacctatatagacgacaaagcattagctcaagatttaatcttatctcaatttgataattttttaattgattgtgatggtgttatttggttatcggaacaattattacctaaaatcaaccaatttttacaatttcttactaagaataataaaaagtttacatttgtcacgaataactcatccaagtctcgtcaatcttatgtaacaaaatttaaaaacttgggtatagatggtgttacaatcgaccagatctatactacagggtattcagctgtcttacaattgaaaaaaatgggtattttaccaggagagaaaatctgggttttaggagacgaaggtattgaagacgagctacttagtgaagggtatattccattgggtggcagtaatgaactattgaatcaaagttggtctgacaagaatccattattaattatcgaccctgaagtaagagcagttatcgctggatcaactttaaatttcaattatatgagaattgccactactctacaatacttgatgcacaatgacaaaacattaccttttattggaaccaatggagaccgtaactaccctggatcaaatggattgactttacctgctggtggaagtatggtcgagtatatggcgtatagttcgcagcgagattatgttaatgtcggcaaacctgataccactttggcggaaaccattttggcaaatactgggtacgacaaactgaaaacaatcatgattggtgatactttgtattctgatatcaaatttggtaatgaagctcaattgggaggtgataacggtagtggaaccttgttggtgttgtcgggtgtcactgacaaggaagaattaaccaacactgtaaacattgcacgtgaaaccaaacagggccaaagcttggttccgagatactacatcgattcattaacaaaattaattgaacttttagaagaatag

SEQ ID NO: 275 - DNA, 978 bp, Candida albicans
catttgttactgatgactattaaacctaatcctaaacatatttcttccaaacaagaggcagaacgtattttatcaaagtacgacaattttttatttgattgtgatggagtcatttggttagatgaagatttgattcctggggtagataagtttcttgagtggttaacgaaaaacaataagaaatttgcatttgttagtaacaattcatcaaaatcacgtaatgcatatcttaagaaatttgaaaatttaaatattcccaacatcaccaaagaaatactttacccaacgtgttactctgcagccttagaattacaaaaattaaacattcctaaaggatccaaaatttgggttttaggacatgaaggaattgttgatgaattacgtgatatgggatatttaccattaggtggtaatgataaattactagatgaagcttttgatcatcaaaatcctattttgaccgtagaccctgaggttaaagctgttgttgtgggatcaaccaaggaattcaattatatgagaattgccctgactttgcaatacttactacatgatcataaatcattgccatttattggatgtaatattgacaggacctatccaggaccaaaaggtttaatattacctgctggtggtagtatagttaactacatgtcatacacttcaaacagagatttcattaatgtggggaagccaagtaaacaatttttagatataattttagaagatcaaaaattcgataggtcaaaaactttaatggtaggagatactttatatactgacattaaatttggtaatgatgggaatcttggtggtgatgaggaaaacggtggtacattgttggtattgtctggtggcaccaaaaagaaagatttaagccatcttttgcacaatcgtcacgaatgtaaagatagtgaaagtttggttccgctgtactttgttgaatctttaggtaagctcatagatttgttggagtaa

SEQ ID NO: 276 - DNA, 1794 bp, Candida albicans
atgaaaataaaccgggcgttgttattcaacagatgcatcccaattgggttattggagccatattcaattcaggaacatttaatccaaggtcaaaaactgttgtccccagtggcgatggtatctctccgactttcagctactcaacaacgttacggtactttagaacgagagttgctcaccattgtgtatgtactacagaagtacaaacagtttatgagcagggaagtccaattctataccgaccaccaggcgataacgacaattggctctgctagactggaaccagctaatcgtatcaaacggttcatcgatattattcaatcctttaatccttccatatatttcattccggggcagttcaattttatagcagattttttatcccgatataatttggacaaaatacctcatgaacttaatgaagaagcaattttgaatcaaacactgtcgatttaccttcccacacttcggactactgaaccaataccacttgcaccaatccaaccagtgcaacgacaccacattcatattgacaatcttaccgacaatcaactacaacaaatacatgatcaactttgtggctcttatgaaaacaataattcgaatgaacttttaccaacagatcaatttgtcattcttcaggatcaatttcatgtggtcttatcctccacacaggtggtaccagtggttacggcagatacgttagccaacactgcaaccaaggttcatgagcatcaccatgcttcaattagagtgaccgactacctcgtctcgaagattcaatggcacccaaatcataaacttctttgtaccaatgtgattcggaattgtctggtgtgtcaactatccagtacttttgaaacagcacatcgtgaattatatccgttgacaccaacaaaaaccttttcccgatgggggctcgattttattggtcccttaccgatgagcgacaacttatcatgctgccttaatgccattgaatatgtctcgggtttaatttatagctggccttgtacatcacccaactctgatgtggttattctgatgttgaatctcatccgtcaagttcattcgactccagtcgaagtcatcactgataatggttcagccttcacctccaatgccacgcaatctttttgtgccacggcaggcatctccatcaaatatgctagtgtataccatccgatgtccaatggacggatggagcttgggaataaactcctaaagaagatattgaaatctatgacggacgcctattacaccaaatggccccaggtcttagccaatgcagtcatggtttataactccacaccaactacttttaacaaaacaccatattatttgctgataggcatttccacagatatgtctgaattcaccacttatttggccaatgaatttgaatggaaagagggacagttatcacaatcttcattattgcaggacctccataatgacgtacaagttcgacttgctgaattggatggtgtaaataaaaacgttgaaaaacataatgatcttagggttcgtcgaatggcttatattaatctgatgagacaaccgttccaaaaaccggcttcatttattaaaggcgattgggatttgctacgccgtagagtcaaacgtaagaaatctgaatataattatatgggaccatatcaaattgctaaggtattggacaaacatgcctatgttatttgcgatactaatggaaacatgataaatgggacgatacatcacgatgatttgaaatactgctattcttttaatgataactccatatccaggccctaa

SEQ ID NO: 277 - DNA, 1227 bp, Candida albicans
cggagtactaattatgaggtgggagatatcaatggagctcaggttgaattttccagaaacaagataccggagaccttaattaagaacttgtcagttgatgggaaagtaataacccatggttatgttcatggacatatccataaacataaagatcatacccacatacatggccacattcataatcacgatcacagaacagatttagagaaaataaatacacaaataaatgatacgtcgatggaacctatttctaatcaacccaattttaacttttcatgtcctgcgttggacgacttggatttttgcaaagacgtattttgcaatgatcttgatgattgcttttatttaaactgcgatgataatgaaaattccaacacttgtgatgtaaattgctgtgattctcaagttgatgaaatttgttgtaccaatgataaatgtttggaaccaaaactggaacaaccaccatcatgtgaaaagtctgaacatcttgagtgttgcgatgatcctcactgtgaatcatataatgtttgtcattctgatttaggggatctgtccagtgttgtttgtacagatcctaattgccctgaaattgatacttgttgttcgtcattgccacaaccgacactcccgtctcatctggaaaataatttatgtcaaccacaactttcaaagagacctatatttgaagatttaattacaaacgtacatttgagttgtaaacaaacgcaagcagaagaaatcaatagtgtttatcctcctaagaagaaaattaaacgtgaatccgatttcgatattcatttccctcatgaatgccatcaagattataaaaacccatttacagctaccgcgactacaaaccaccagcttcatcaatcgtgtttccatactactatacccgatagaaaaaatacatctttagaatatgatgagaaactaatgtctgattttgatttcgtgatacagtttaataatttcaatcaactattaaatactgcaacaaaacatgagcaacaggggcagcatgagcaacagaagcaacagaatcaatttgtgaaggagactacagatttcaatcaagtgtcaaccaatagacctacactgtattcatgtctatgggaaaattgtttcccaagattgaataacaatacctcccttaatcatgtcattgaagaatctttagaacaagaagatatcgtccaatcagagaaatccaatttatcaatgtga

SEQ ID NO: 278 - DNA, 750 bp, Candida albicans
  unsure (680): Identity of nucleotide sequences at the above locations are unknown.
tttgttcccattttttttctaaaaaaaaacagtaaaagctggcttgttgtaccttggttcagttttgtttttcctgtcaaaaatatcgtttgtttgccttatatgactacaccactatcgagttattcaactaccgttaccaatcaccatcctacatttagttttgaaagtctaaactcaatatctagtaacaattcaacaagaaataatcaatcgaatagtgtaaacagtttattatatttcaattccagtggttcaagtatggtgtcatcatcgtcagatgctgcgcccacgagtatttccacaaccacgacttcaacaacttccatgacagatgcaagtgccaatgctgacaatcagcaagtgtacaccatcactaaggaagacagtattaatgatatcaatcaaaaggagcaaaactcatttagcatacaaccaaatcaaacaccaacaatgttaccaacctcatcttacaccttacaaagaccaccgggtttgcacgagtacacgtcatcgatatcttcaatttcatcaacaagttccaactccacatcaacaccagtatcccctgctttaataaattactcaccaaagcattctcgaaaacccaattctttgaacttgaaccgaaatatgaaaaatctatcattaaacttgcatgactcaacaaacggttacantagtcctttacccaaagcaccaaattcagtttttacacaagacgcctggaaggaactactgtgctcgaga

SEQ ID NO: 279 - DNA, 738 bp, Candida albicans
gaagacaatgtgagtagaatcacaaacgtattttatcttgcaattaatattggtgcctttttgcaaattgctacttcgtattgtgaaagaagagttgggttttggcttgcattctttgttcctatgatattgtacataattgtaccaattttcttatttattgtgaaacctaaacttaagattaagccaccacaaggtcaagtcatgaccaatgtcgtcaagattttagcagttttgttttctggaaatttcatcaagagattgtggaatggaacattttgggatcatgcaagaccttcacatatggaagccagagggactatttactacaatagtaaaaagaaaagtgccattacttggtctgaccaatggatattagatatcaagcaaacatttgattcctgcaaaatttttctttactatattatttttaatttggccgatagtggattaggatcagtagaaacttccttaattggtgctatgaaattagacggagttccaaatgatctttttaataattttaatccattgactattatcattttgattccgatccttgaatacggactctacccattgttgaacaaattcaagattggctttaaaccaatatggagaatctgttttggatttgttgtttgttccttttcacaaattgccgggtttgttttacaaaaacaagtttatgagcaagtatgtaaattatcagaggttttttttacactcattgtatag

SEQ ID NO: 280 - DNA, 447 bp, Candida albicans
tctccatgtggatactacgctaccaactgtgatagtccagctccaatcactgcctggaaagcttcatctcttttcatattagctgccgctggtgaatgttgggcttataccactgcttatgaattggcatataccagatcacctccagcattgaaaagtctcgtatatgccttatttttagtaatgtctgctttctccgctgcattgagtcttgccataactccagctttaaaagaccctaatttacattgggtattccttgcaattggtcttgctggattcctttgtgccattgttatgttggctcaattctggaatttggataaatggatggaaaatgaaacaaatgaaagagaaagattggatagagaagaagaagaggaagccaacagaggaatccacgatgttgatcatccaattgaagcaattgtatctatcaagtcatga

SEQ ID NO: 281 - DNA, 798 bp, Candida albicans
ttttataaccaaatggtatcttcagactttgaaaatgaaaaacaaccagatgttgttcaagttctaaccgatgaaaaaaatatttccttggacgataaatatgactatgaagaccctaagaactacagtacaaactatgttgatgactacaatcccaaagggttaaggagaccaactccacaagaatctaaatctttgagaagagttattggtaacataagatacagtacatttatgctttgtatttgtgaatttgctgaacgtgcttcatattattctaccactggtattcttactaattatattcaaagaagaattgatcctgactcaccacatggttggggtgcaccaccaccaggaagtccagatgcttcagctggtgctttgggtaaaggtttacaagctgccagtgccttgaccaatcttttaacatttttagcttatgtattccctttaattggtggttatttaggtgatagcacaattggaagatggaaagctattcagtggggggtattttttggatttgttggccatttgtttttcatttttgctagtatcccacaggcaattgaaaatgccaatgctgggttgggattatgtgttattgcaattataactttgtcagcaggactgggattaatgaagcctaacttgttacctcttgttttagatcaataccctgaagaaagagatatggtaaaagtgttgccaacaggtgaactgattattttggatagagagaaaagtttgcgtagagtggttccacctcggaactcgtcggtacccggcatatag

SEQ ID NO: 282 - DNA, 1455 bp, Candida albicans
cttgggttcccaagggtttttgttgcagaattcccagagacatatgaattagatgatgaagaaatggaaagaatcaatgccatggccaatttagaacttaatgatgccaaagaacaattagcagaagcagaaggtgaagaagaaacagaagacaatgattcggggaatgccccaaaaacatctaaattagttgaacaaattgaaatagatgatgatttaaaagaatatgatttagaaaattatgataatgatgaagaccaggatgatggaaataatttaggaaatactaaaatctccatgttcccaggtttatccaatactgatgctaaattattacaagatgaaagtggagaaggtgataaatatttatctttaccaactgaactagatgaacaagaagaaaagaaagaaaatcaaatttatccaactgataatttagttttagctactagaactgaagatgatatatcttggttggatatttatatttatgatgatggtgctggtgctccaattggtgctgaagaagaagaagaagataaactagacattgatgttgccaatggtatgattagagaatcaaatttgtatgtacaccatgatatcatgttacctgctttcccattatgtgttgaatggattaattataaaccaggtcaagaatcatcaaatattggtaattttgctgctattggtacttttgaccctcaaattgaagtttggaatttagattttgttgataaagcattccttgatgttattttgggtgaaccaaataaaaattcattcatagctacaaagaataaaaaatccaaaaaaaagaacaagggtggtcaacatattactactcatcatgtcgatgcagttttatccttgtcacataataaaatccatagatcaatattggcatcgacatctgctgataacactgtgaaattatgggatttgaacagtgctactgctgttttatcgtttgataaaattcatcataataaaactgtttcatcttctcaatggcattcacaagaagcatctattttattgacaggtgggtatgattctactgctgctgtcactgatgtaagaatatctgcatctgaaagttcatcatcatcagattcttctaaacattattccgtggttgcaggagaagaagttgaaaatgttagatgggatctttctaaaccagaattattttatgccggtactgataatggtaatgtatacagttttgatatcagacaggattctaagccattatggactttacatgctcatgatgccggaatttcttcattggacgttaataattatgttccaggtatgttgattactagtgccatgggtgaaaaagtagtcaaactttggaaatgcccttcatcgtctgatgaaaataacaccaccagaaaaacaaggtccttccatggttttgtcgagagattttggtgttggtaa

SEQ ID NO: 283 - DNA, 471 bp, Candida albicans
tcaaactttggaaatgcccttcatcgtctgatgaaaataacaccaccagaaaaacaaggtccttccatggttttgtcgagagattttggtgttggtaacgtgttaaccacaagttatgctcctgatattgaagttgctggtaatgtagtcattggtggtataacaggaggattgaaaatgtgggatgcattcagtaatagctcagttagaaatgggtttagagaagaattaaaagtattacaaaataatgctagacaagaagcaaagaaaaatggacgtgcttctcgaattgctagaaaatataacagcaatagtaataaagaagaaatcatgactgttgaagccggtggtttgaaagatgaatcggattctgatagtgatgaaggtgaagatgtacctatagaaatgcaagaaaaagaagaagaagatgatgatgatgatgaaggcatgtcagatgatgatgaaaattaa

SEQ ID NO: 284 - DNA, 2481 bp, Candida albicans
tctaaagtatatgacattaaattcagtccttgtggtaaatattttgccattgctatttatagattcattcaagtatggaagactcctgatttgactgaagatagacaatttgctccgtttgttagacacagaatttatctgggacatttcgatgaagttttgaatatatcttggtcattggattcaagattttttataagtaccagtaaagatatgactgccaagattttttcgttgaatagtgatgaaaaggatgttgcaatgactttttcgggacatcgtgattatgtgataaatgcatttttcagtcatgatcaagaaatcatttatactgttagtaaagatggtgcattgtttaaatgggaatatactgaacgtcctaaaccagaaaacgaagacagtgatagtgaagatgatgcaactgataagccaatgagttggagaattactgcaaagaatttcttctacgctgatgggaaattaaaatgtgcttgtttccacccacaatcaaaattgttggttgtaggatttacaaatggtgaatttagactttatgaaattgaagattttaaccttattcaactgttaagtatgggtcaaaatgccgtcaatactgtaaatatcaataaaaccggcgaatggttagcctttggatcggcaaaattaggacagttgttggtttatgaatggcaatcagagtcatatatattgaaacaacaaggccattttgattccatgaacacattgtgttattctcctgatgggtcacgtctagtgactgggtctgacgatgggaaaattaaaatttgggatgttcgatcagggttctgtttaatgacatttacagaacatacatctgctgtcactcaagttcaatttgccaaacgtggtcaagtgttattttcaagttcattagatggtactattagagcatgggatttaatcagattcaggaattttaaaacttttactgccacatcaagagttcaatttaattgcttggcagttgatccaagtggtgaagtcattgttggtgggtcacaagatacttttgaaatatatgtttggtcagtacaaacaggtcaattattagactcattaaccggtcatgaaggtccaatctcttgtttgacttttggtaaagagaattcaattttggcttcagcatcatgggacaaaaccattagaatttggaatattttcagtcgtaatcaaactgtggaacctattgaaattcaaagtgatgcattatgtttgactatgagacccgattgtaaggaattggcagtgctgacattagatggccatgttaccatttttgatattgaagatgctaagcaattgcatttaattgatggacgaaaagatattgtcaatgggagatacttggaagacaaatttattgccaagaattcaaacagggggaaatatttcagtaccattgcttattcctttgatggattgactttgttggccgcgggtaacaacaattctatttgcatgtatgatattgaaaacgaggtactattaaagagattcattgtttcggaaaatatgtcattggatggtactttacagtttttgaacagtagcaaaattaccgatgctggtacaaactctgatttaatcgatagagccggtgaattaagtgacttggaagatagagtagacaatagtttgcctggttcacatcgtggtggtgatcctagtgaacgtagaacgagaccagaagtcagagttactgctgtcgagttttctcctacaacagctgcatttgctgcagcttccactgaagggttactaatattttctataaatcaagagcttatttttgatccatttgacttggatgttgatgtcacccctgaagccacgttggaatcccttaaggagaaagaatatttggttgcattggtcatggcattccgtttgaatgaaaattacttgatccacagagttattgaatctattccattacaagacatcaaattagtgtgtcaagatttaccagtaatttacgtcaacagggtattaaatttcattggtgaattgttgactaagaaagaatctccgcatattgaatactatttgattatggttaaaaacttattgatacagcatggtcgatacattagtctgaataaatttgaatttcaatcttccatgaagttgttgtcacgattcttaaataagacagctaaagatgtgataaatgttggtaaaagaaatgaccatttattgacttacttaacagttagtaaagatttgaaaactgcaagtggtcacagtgaaggagaagagaatatagaaatgaacgaagacctggaagctgaagatatagacattgacgaggacgacgatgatgaagaaggttggttaggtccaaatggaaactctgtaaaggctgcaaatggaattgtttttagtggaccggctgacagtagcgatgaagaggatgaagatgagttgattgaagtatag

SEQ ID NO: 285 - DNA, 255 bp, Candida albicans
catttgaggtctgcaccggccgtgtgtgaaaacaatcaagatggagccaaactattatcgccagtagggaatagagtttcgtgctttgatttaatcaaatctcaatcatttacattcgattaccaacatcgtaagaatgttcaatgtattgccttatactatctttactctttaatgatttccatagatgaagatggtagagcaattcttgttaattttgtatcccgtgttgtattacttcttttcaatttctaa

SEQ ID NO: 286 - DNA, 1350 bp, Candida albicans
aaaatcagcattgcaatgtttcgtccaagtatcaaattcaaacagctgactttgtccataatagcaagaagattaaaatcttcagcacaacatcaacctttgagatccagttttgtcccttctccaattgtctttgttgccggattggctgtggctgcagttggtggatattactgtttagattcaagatcagcaatccatgaatatgttttgtgcccattaatccgaactttcacagatgcagagctgggacataagttggggatttttttcatgaagtatggattgtccccaagattattggatgatggtaaaaatgaccaaagcgacgttttaggtgtccaagtatttggccataagttgaagaatccaataggtttggctgctggtttagacaaagatggtgaagcaattgagtctttattcaattgtggcttttcttacgttgaaattggttcgataactcctgaacctcaaccaggtaaccctcagccaagatttttcagattgccaaaagatgatgctgttattaacagatatggtttcaattcaagtgggcatttcaatgttttggcaacattgaaattgagattcaataaattgttgaataaatttggaacctcacactcttcggagcaacatccattttccaatgcattccaacaaggcaaattattaggtatcaatttaggaaaaaacaaattcggtgacgaggtcaatgactacgtgaagggtgttgaaagattgggtccatatgccgatgtcttggttatcaacgtgtcgtctccgaacaccccaggattaagagacttgcaaagcgaagccaaattaactaatttattaactactgttgtgaaagaaagaaacgtattgggcaaaaacttgttaggaaataagccaccagttttggtaaaagttgcaccagatttgacggaaccagaaatcgagtctattgctaattctgccaaagaggccaaggttgacggtatcataatttctaataccacaattcaaagacctgttgatagattgttgactactgacaagcaattgattaatcaagctggtggtttatccgggaaaccattaaaaccattatccttgaaggccttgcgaaccttgagaaagtacaccaaggactctgatttggtattgattggttgtggtggtatttcaaatggtaaagatgccttggagtttggtaaggccggtgctacattcattgaattgtacactgcttttgcttataaaggtccaggtttagtaggtaaaataagagacgaattggctgaagaattgaggaaagaaggtaaaacatgggagcaaataattggctctgatgataagtga

SEQ ID NO: 287 - DNA, 462 bp, Candida albicans
gcttctctgaatcgggtgtggcatcaatgtagagctttaacatttatttccttaaaagttagaattaaagcgttaggattggtgttttttttatttggtagcgaagtctataagaacaatacggaaaaccacagttttttttctctctcgcatagtgaatatatgcagcttattaatcaatttagtaagagccccccactacttcagttcaattcccccaactttaaatttatatttaaatattcactcttactcttctttttaataattgttatttttctttttctttatcccccatccatttatcaaatcatgtccattttaccggaaacccaaaaagttgttcttcacagagaaaatggtgattatgatgtaattgaatattcagattttccaactcccaagattgaatcgtcccatgacattatcgtaaagaattttttcaccagcggtggagatccg

SEQ ID NO: 288 - DNA, 798 bp, Candida albicans
aaaactaaaactaaaaaaaatttaattcctcgaatcaaattacttttcattacatatatttatataacacccatcttacccaacaaaactagttttattaatattgctgaaatagaaagtaaaagaaatcagcaacttcttattattattattattatcatgacagttaaatcacaacaacaaattattgattcattcaaacaagctaatcaagatcaacttttccaatattatgattcattgacaatagatcaacaacaaaaatttatagatcaattgtcaactattgaagaaccagctaaattgatttctactgtagaacaagcgattcaattttctcaaaccaattctacatcaagaaatttcactcaattacctaatgaacaaacagcatcaactttagatttatcaaaagacattttacaaaattggaccgaattaggtttaaaagccattggtaatggagaagttgccgttttattgatggcaggaggtcaaggaactagattaggttcaagtgctcccaaaggttgttttaatattgaattaccatcacaaaaatcattatttcaaattcaagctgaaaaaattttgaaaattgaacaattagctcaacaatatttgaaatcgactgaaaaaccaattattaattggtatattatgactagtggtcctactagaaatgctactgaatcatttttcattgaaaataattattttgggttaaattctcatcaagtgatttttttcaatcaaggaacgtttacatgttttaatttacaaggcaataaaatctta

SEQ ID NO: 289 - DNA, 708 bp, Candida albicans
  unsure (28): Identity of nucleotide sequences at the above locations are unknown.
acgcggactttccattttcgtggggccnatggcgtagttgatcaaattttcatgggatttgccattgccataaaatttgatttggctacaaaagtggttagaaaaagagacgctaatgaaagtgttggattaattgttttagatcaagataatcaaaaaccttgtgttattgaatatagtgaaatttctcaagaattggctaacaaaaaagaccctcaagattcttctaaattatttttaagagctgctaatattgttaatcattattattcagtggaatttttaaataaaatgattcctatatggatttcatctcaaaaatatttaccattccatatagctaaaaagaaaatcccaagtttgaatttagaaaatggagaattttataaaccaactgaaccaaatggtattaaattagaacaattcattttcgatgttttcccatcagtcgaattaaataaatttggttgtttagaagtcgatcgtttagatgaattttctccattgaaaaacgccgatggtgctaaaaatgatactccaacaacttgtagaaatcattaccttgaaagaagttccaaatgggttattcaaaatggtggagttattgataatcaaggattagttgaagttgatagtaaaactagttatggtggtgaaggtttagaatttgttaatggtaaacatttcaaaaatggcgatattatttaa

SEQ ID NO: 290 - DNA, 861 bp, Candida albicans
attcccctctatatagttttcgatgattcagggatcgctcttgatgatacagaatttttcaaatgtttaagaagatttgctgttactgatcctattcttttaagtcgtaatgatataggagataatgatggcaataatagtaacgatgaggatgacgtagaggatgatgatctggatgaagaagaagaagctattactgatgaatacacattcaataaaacaaattggttaaaacttgggattctttatcatcaagttagtaaaaaatccatactggtagattttttaaatggacccttaaaagcagaaaagaggaaaatagttcgagcaagaaatgttgatgatactaaaggtagcgggatggcgaaaactgctcgacaagttcaagctagtgatatttctggtaatcaagaacaaaatactgccaacatggttaaatcagtttatcaaacatatattgaaaaatatgatggtaatggtgttaatttatttaaattttttataaaccctagatcatttggtcaaagtgtggagaatttattttacaccagtttcctcgttaaagatggtcgattgaaattatatgtgaataatgacgggatgccttgtattcaaagagtgagtagtgatgaaatcagagaggctcaattggaaagcaataaaatttttgctagtcatcatattgctagttttaattacaaagcatggaagaaatatactcaattatataacataagagaagcatttttgggacatcgtgatgaacctgaagaccaaatgccacctgaagatataattgattataatgacgaggaacctataccgtcatctcaaagaagggatctgaattcatcggattaa

SEQ ID NO: 291 - DNA, 1776 bp, Candida albicans
atattagaggaacttgttgatatatatttcccagttccattcaatgttataattcggatggtagatcgggtttccttaatacggcatgtaaattatttacaactgttgcccgagcataaaagaggttcgatggatggtaatattcttgcattggtatgggcagtggttgcattaggtgaatttagtagtattggtgggagtgttaaaaaatcactgatttttgctaagaatgccattatggcacttgaaaactcatttacaactacaattgaaacaattcaggcaatgattactcttgggttagtgtactaccatttaggtcaatgggacttttcgtgggtattgatttcatcaggtacacgaatggccattgacgttcgactaatgagaaatgcctccgacgaagataatccaagggttcaaagcagtgccagtttgaataacattaatagacaaagaacctgggccacggtatattttgtgaatactttgctttgtgcaagaatggggagatctcctgttgtgagagctctggattggccagttccagaaattaacaacgatgggtgggaagagtggctgccgtgggaatgctattatgcgccaaatgaaatcaaattagagagtggcaagtttttatcgacatttaatgaaaccctcaaaggtgtttacattttgaatctagctattacatctacaattgacacttccagaggttattatcaaaatggagaggtaaaatcagaattcaaaattaattatgacgacagacagaattcaaataacatgactttagagatgtttaatgacatgatagacgcatggctgaaccaattacctgaatccttcaaagacgaccagtctaacactggtttgaagctgccatcaactactatattggtgttacttcgtggattgatctggtgtgttttagctgttaggttgagctctcttaaaggcaatagtgagattaaggatcaaattattcaattcagaaatcaaaaatatacggaagcaattgtggcaatgaagagatgcatcaatgaaaacagcgagaatatatggaaacattattttttatttgattatttcttaataatgacgtttaacttcccatatatgatgaattttgaatctgaatttatgaaatatgctcacattcaagaaatgaaaaatattcttgttagttgttcagaaacttcaattccttgtagtatatgctgggacttgttgaaaatcatgaataatggaaccaaacaaagggagtcttctaaacttcacgatacacccaaagcacaagagtctccgacaatagctaatttgctaaatgaccaagctgacaccgaggcagttggacctcagccgccagcagaagtacaaccagtcgcatcagtaccaccaatggcacccgttgcaccaaatctgtcgttgacttcggtagctccggctcccgaatcagcaccagcacaggtggctgcacccccactagtaatggccccagcagccccaccaatatcatcatcaggaaacgctctttatatttccaatgataaaaactgggtaaaccagtttggcccaccaacaacgatgctacaagatttacaccaagtacaatctcaaccaatatatctgaactcaaattttcatcagcagcataaatattatccacatcaaatactgctagaagaaccaactctgctgttgttgcaggtaaatcagatcaaacaagaaaatacaaccctgcaacctaataaccataatccgaacgtaaagtaa

SEQ ID NO: 292 - DNA, 654 bp, Candida albicans
gatcaaatgaaatggaacacttattttatccctgcgatatcatgttctatttcattgttcgccgtgtggtatttattcccagaaacaaaaggtgtatcactagaagaaatgggttcagttttcgatgataaatcatcaatattttctcatcatgcttcaggaagtgttggcggtagcagtagtagtatttttaattatggtgcaactaatgacttgaatagaagaacatcaatgacaaatgattcaactccttcaatagcaggagatcttccaggggcagagccaggagctatagattcaattcatcaatcagcagcatcaatggcaagaaaccctactagcaacaataatcaacaattagatggaattatcacgggtgctgcaccaccaccaatgcctatcaatactaataacaacaacattatcaaaccagtcaaatcagataacgccgctgatactctttcattagattctggttttggtggttctcaatcagatattgtacaagaaattgaaccaccttcattagaagaaattttaaaatataaaattcaaaaacaaattgaacctaatgcatttattgctactttccattggttattttcgaaaaagggacaacccaatgatgaagaaagtagattattacaacaatag

SEQ ID NO: 293 - DNA, 1314 bp, Candida albicans
  unsure (1153),(1171): Identity of nucleotide sequences at the above locations are unknown.
tctgttccattctttttcatccattcattcaaacaaaacaatctagtcagttcaaagcacatcatcaatatcattatgtctgacgagaaaacaactgcaacatacgagtcacataccaaacaggattctatgtcatcaacaagctcccagtctattgaacaaatatcatcaccaaccaaatcagaaccaaaaaagaaatcatggtttaaaatgaaaaacttgtttgaaaaggtggaagatagaccaactccaccacaggtttataattatagaatttatatgactgctattatggcatctgctgctgccattatcatcgggtatgatggtgggtttatcggtggtactgttgccttagattcttttaaaaacgagtttggtcttgacaagtcagctcattctagttttattatttccaatgtcatctcggttttccatgctggttgtttctttggggccttgttctcttatccattttcattctatcttggtagacgtattccattaatctttgctgcatttttaattactgctgggtctggtatcatgttggctgcaaactcaagtgtcgggttgggccccatctatgctggtagagtcatggcaggtgtggcagttgggttttccactaacttgacagtggtgtatatatcggaaattgccccgccagcaatcagaggtcaattaaccagtagttacgagattggttggagagttggtgatcttgttgggttttggatcaactatggggttgactcgcatattcctgaaggtaaaagacaatggtacataccgtttgctattcaattaattcctagtgggttgtttttacttgggagtatcttcatgaaggaatctcctagatggttaatgcaagttggtagatatgacgaagccatcaagaacttgacctggttcagacaattaccagaggacgatgaatatattgtttacgaagtcaatcaagtcaaagaatccattgaagaacaaaaacagaaaatcgggcttggaatcatggatccattttatgaagtgtctttcaacaataaactaatcttgcgtcgtttgttaatcaccatgaccacctatgttgtgtgtaactttttgggtattcaatctatcaattactattctccaattcttttccaaggtntaggtgttaagggaaccnatagctcaatattttcaacgggtatgtttggtgttgtcaagtttaattgtacattcaattacatttggtttattgtcgacaccattggaaaaacaaatgcctttatggcttcgtccacggttggtccacttgtttttgggtaa

SEQ ID NO: 294 - DNA, 1389 bp, Candida albicans
gtcatatcccatagtcttatattctttggtaaactggttcataagatgtatcaacaaccaatgcactttaatatgcgtcgatctatggacataccgccacctttacatttatcaaatcaatctgacaacgagattccaagtcaatatactccgattacaccatttgacataagttatggccaatctatgataccatccaacttgttgatgaactcaccatatttcacaccacctccaacggcaagtcaatacttccctccccagtattcccgaaacagttctcgcactggttctcaatcgtcgtcaccgcgaggtacacattcaaaattgcgcttaaacggtaataaaggaataaataataaccatcaacacgataataccagaaaaatgcattatatatcctcgatgggtaatggtaatccaaagagcgcagtgtctatgaatcaaatggctgatcaaccaagttgctcgagaacggtgattttcaaaaatatatctgaaaacgtgtcgatgcacgagtttttggatgcaatagattttggccccatagaatattgtaaaattttttccaaaccaacaccaagactcactaaggaaaagtatcctgaatctcctgatagcatgcaaatatgctacgtttcgttcagcaattacaaaattgcattggccttctcctctaagtatacacaagacaccaatcttatggagggattaaaagaaaaattgaaaaactcaacctacttgaaaattcagttgaatgatacacaagggaagcacaaatctacttcctattccaatcaagattatttaaagttgaagacgctcaattatattttggagtttaatgcaacaagatgtttaactatttcgtttagtgcagcccatgagattccagaaaatgtcgaaactgattccgctcatgagagtattaaatcctcaatattgaatcattgtgaaaaatttggccaagttgaagattttgtatttgacataaaaagcagtaaggacatttgtggtaaggttgtggtacatttttgctcgatcgactctgcaatcaaagcttatgagaatttgtcaaagagaataaatcaaaactcacgttatgatcgtaaggaaaatagccatagcgacacaactaatgcttcttccactaagagttttaatagtttgaatgatatcaggttttcaggggtagagtttggtaaagatcgttgtgacaagaacgccgtatattcagaaagacccgtcttatattcttcatcatcgaaaaatcatattcaatgcattccagaagatgaagagacaggcacagaagatcaatcgaaagacgtgtcgaatttgaaagaatttatcacctctcctgagattgaaagagttcctggtacgtga

SEQ ID NO: 295 - DNA, 798 bp, Candida albicans
atacagataggatcccttaaaccaggttatatcttttgcacacaagtgttaactatttcaattacaatgaagctttcaaaactattacaactagcagttttttcaagtttggtcacttcgaaaaacatttttgatttagaatctttgaagcaaggtttacaagacgaagaaacagtaaacaacgataaacgggagccagttaacctactttatttagatagattcaaaatgggggtttcagatgaggcaaaaggcaatgcaaaatttaaaagagatccaaagaacgttattgatccagctagcttaaaagaaggttcagcagaagaagaacaaaaagataagagggaaccaaaaaatttattcaacttgcaagctttgcatgaaggtttaaaagatgaggaaactaagagcaagagagaggctaaaaacttaccaaatttggaagcattagaagaggccttgaaaggtggaagtttacctaaaaaagatgcaaagaatttaatcgatttagtagctttgaagcaaagtttagaaaaggaagctgctaaaagagatgctaaaaatataccagacttggaagctttaaagacaggtattgaagaggaagaagggcaagtagccaagagggatgctaaaaacgttattaatttgagtaacttcattgaaaccccatctaaaagagagggtaagaacttgtttgatttgaccaaatttcaacaatcgggacaaccaataaatgaaaagagaccaaaaaatattgaaacaagagaagtcattatttgttttgaattcggttga

SEQ ID NO: 296 - DNA, 357 bp, Candida albicans
gataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctga

SEQ ID NO: 297 - DNA, 792 bp, Candida albicans
tttgcggttaataggaacaacagcaacgacgcgcaagtagcaccaacaccagtagataaagtggtgaaaaaaaaaaaaaaaaatttcttgaacaacaaaacaaatttttttttctcttttaaaaagtccttgttgtttttatttccttcaattcccaccaccaccaccaccaccaccaccaccaacagtaaccaaacatatattaccatggctatagaattaccatttgaaattcctaaagataatccagtatatatcaatattcaaaaattttctgtgacttatcaaaaattagttgatgaatcagttccttatacttcacgtagatggattggatttggaattttattaagtttatttttattaagaatttttttatctcaaggttggtatataatttgttatgctttaggaatttatttattgaatttattcttagcatttttaactcctaaatttgatccttcattagaacaagaattgaaaaatgaatcaattgaagaaggactcgatcaagaagacccaatttcacaacaatcaaatcaaaaatatgatgatgatgatgatgatgatgatgatgagtttagaccatttataagaagattaccggaatttaaattttggtataatgcaattagagccacaataattgccttaatattgacatttttcaatatttttgatatcccagtgttttggccaatacttttaatgtattttattatattattcactttaaccatgagaagacaaatacagcatatgattaaatataaatatcttaccatttga

SEQ ID NO: 298 - DNA, 873 bp, Candida albicans
tcgagttctcaacatatgaaattgaatgaaaagaatgagaatgaaaatgaaaatggtgatgctgatgctgaagtggggaatgaagttaaagagccaattgaaggtagttcttcacaagtaactgatgaaccagagcaagttatggatcttagagaaagaatttatgaacaaaatattcaaaacgacacttcatcaattgatgaatcaacaccattaatatcacagaatgaaattagtgccttagatgaaataattgaatctccacttgaagacaataaaaacgaggaagtgcaaactgaaagccaacaattagagccaattgaagaaaatgaagaagaaccacaagtgtcaacgaatgaggtttccagaccccaaaaaaatgttttaattgaaaacacagaatcttcagtgagcaagaagaaagacaacttgaagtcatcagaagcaccatcagtgatactagaacaagaacaagaacaagaatcagcatcacaacctgtgccagctccagaacaaaagcaagaaacggaaccagcacaagaaccagtgcaagaacaagagtcagtatcacaacaagaacaagagctagtggcagaaccagcaccagcttatactcaaacagaagaaagagaaagagaagggcaaggcgacgaagaagtagacgtaactgatgaacaacctagtaatgaaggaactagtacagaaccttcaacaagtcctgaaccaactggaaataatgaaaacaataatgctggcgatactaccccacttgccacaaccataggttcatcttccaataataaatctaatcaaaaaaagaagaaaaagaagaatggtaaaaaaggaggaaaggaaaagggcaagaagaaatag

SEQ ID NO: 299 - DNA, 564 bp, Candida albicans
tcgcggtccttccaggcccgtggtgaagacctagcaccaattgatcaagtcgactcagaaagtctggaatcaggttcacctctagaaaagttagaaactgccacaaaagatgaaagtccactccaagaagatgaattaaccagattgcttacaccagaattacaatctcaactgatgaatttgcaatatgaacaacaaagcgactcggaagaatcatcggtggcatcggaaactgaatcaactttagaaaccaccagtttggtcaaagaagcagaaatttctgaaagtgcagactccaaaaatcatttgatcgaagattcggcaacaccacaatcagaactggattccaaatctcttgaagaaaacgtaccagaaaatgaacaatttgaaaatataaaccttgacggaattttcaagaatagttcaagtgatgcaagtgccgcagaagaaatgagagaggatatgcctaaagatttcgacgaggaagaaatatacaacggacaaccaacggtacctgaaaactatgaagaggtggagttagaaattgttaaccaggagaatgtc

SEQ ID NO: 300 - DNA, 297 bp, Candida albicans
ccagttggtgagataacatatatatacaagaataaaaataataacaataacaatatgcctgaacttgtgccaccaacaaacaatcggccccatatacatgagacacccgagttatcctcgcaaccttctttggacagtaatagacaaccccgtgaattatgcaaaaaatgtaatcagttgatagttgagggccacgcgtacgaattaggcgacgatagatggcacattcattgtttcaactgttcaaaatgtaacacgtctttgggttgcaactctaactttttggttttggggtaa

SEQ ID NO: 301 - DNA, 1827 bp, Candida albicans
  unsure (602): Identity of nucleotide sequences at the above locations are unknown.
aagcaaacatggttaaagaaggagagagaaaaagaagtggacactttaacggaaatgtcgtgcgtcagatacaacaaatttcttggtgttgggaaattgatgtttagtgccaactattgtgataacaccaacactacctgtgaatataaacttccgaaaaaaaaacaaaacaagtcaatacttaaacttgatgtcattatcgaaactgattggaaaggtttagcaaatgtgaaaacagtttatagaaaaacagtagtgttactagctgaggtggaagtttctctccagattgaaccatttgtagtcgcggtagcattgttgcgtgttcaaagtctgttctcggctcgttttattttcatattttattttcttcatttttgtactttcaatacaacgacaccacacacagccattaccaacacttttatgccaggattagtatcatcatcattaaatagcccatatatcaaagttctcaatgagaaactctccatatcgttgcaatatttaaatagtcaagaatcgaatcaaacatgtgtgttgacttttatcaacactgcagacaaagatgtcaatatcaatcccacaaaacaagcaagtantggcagttggttgagtggcttgtttgggttgaatccatcattggatgaatttttaagcaagttgaatgttgacacagatgccccggtcgatttattccttgggtatatacaattgtttggatatgttgtcttgaattacaaatttgaaatagacacaacatctttggaggtaaataagaacccacaatggtggaataacacagaatatttgaaccaatacttagaaattaacgagagcaaggatgataggatagatgagcatttgaaattagatacagtgccatttatagagaagaattgctctgaaaagttgacaattggagggaaactaggaggggtgcaagatttagtggtcaataacgataaaattcttatagataacagatatctattgcatgatttaattggtaattttaactcaaactcgttgtcaaaggaagttcaattgcttccgctacatgatctaaccgaagcaattgtgcccttctataccactcctcaatcattgttatttacagatttatccatcccgaagaattcttctcgcagcttttgcttgaaggtcccgattaaagatgatttgcctcctagttataacacttgtctgacaggttcggcatgcgatcaaggattaataagtatccggtactcattgatagtaagtctaattgaagaaaagttttccaataaaaccaaatcagtatactttccgttgaaaatgaatccaaaaaggtatggcggagtacatacgtatttgcaaaaaaggtattttgatagccctataaggttagataaggactggcaagtggaaataataacagacaagcaaaaaacaacacatcaagaaaaggacatatctgaaaaggggtcttttttgcaagatatttcaacattaatcgattcagatttgtacaacatgcctaaggtgtcaaccatggaaagaagaaagagcagtgtaaacggcatgtctgatgaaatcaattctgacggctacatttcgcagctacctgaccatttgaagacacaatttcgtttacgtgtgaacaatcaagaactatgcactattgggttatcgaaagcttattatcatccgggtgaagatttgaattatgttattaacataaatcccaatgcagacaacacaacaaaagtaatcggacttactacttatttagaggcacacgaagtgtaccgtttactagaaaatgggcaaaagactcaccta

SEQ ID NO: 302 - DNA, 2133 bp, Candida albicans
acaccgatggacccttcttctcaagtgccaagcttaaccccgtttttaaactctgtgtgtcctgggtacactggtttagatgataatgtccattatcccttggacgacataccccatgagtgtggcgaacttatttggccgaaatccactacaaatgcaactatcaagttggactacacttatttgaatgttgctagacctgggctaaacaaaaacgagtcaacaacgtacgtttcgttgccacttcatatcaccaatttgtttgacaatctagtgagcaaaagcgacaagaccctggaagggtatatgcacattggggccaacgtgaatgcattagcccacgatccattcaagatcatcaacttgaatcctggatgcataactagaattgttgattggaaccgctcgaagaacccttttgcggataacaaaacactttcatttaataaacttgcaagcaatttcaataaactatttgtgaaaaacgatttgtttgacgatttaggaaatagcaacgtaaagatcttgaactccaaaccaattactgcagctaagcttcttgtctcatcacatgtgaacgtgttgaacgtgtttgcgttgaacgaaaaatcggaatatttgaataccgtaaaaaaagaacgcacaacaggtccaccagacaccgaagagcctgttcttcgtcttgaattcaattccataattaccgccttatccacatttgtgcttaacgaagatccagtggctatcataggattccactcaggggagattatgattttgaaattgaatgaacaaaagtatcaactatttgatgcgttgaaagtccagaaactttcggaagtggatgcagtgacttgcattgaagcaattcgtcacccaaactacgagtatctagttgttgctggatactcaaatggggaggtggtgatactaaacccgtatggtgtcaaagacagttattcaaaatcggtcgtcgacaaagacgtctcaacaacgtttttcaaaaagtttgatttgagtccgctaggcaaggtcgataactcgtttgttttgggtcactttaaagtgagccacaaacccattacttcgctaagctcaaccttaccgataaataaaccgttgcaaccatctgaagcacaaccgttgattctcgcaattgccgctgacgatgggtatgtcaggtttgttgatttcattttcacatacaactgcaactatggcgataaacaacaggttattactaccgatataatctccaactatttcaacacaagcataactgatattgagttttcacctgactttaaattctttagtgttgttggcaagggcgacttgattgaagtgttcaaaatgagctactacaatgtcaatggcttgttgcataaaagttctggacgtcggtcgaggagcgggactgtcaacagtgctcattccgggtctgaaacaagactgaaagaaacaaaagaaatgtaccctccacttatcaaggatatccaaattgttggaagattcaaaggacatacaaatattgtgaaatccaccaagtttgtcaaagacgattttagcaccctggtttacaagttggtcagctgtggctatgacggtaaaataatcgtgtgggagtttgactacaaggcgttgccaaaaatcaagaaatcgcatctcaaacccacaccaacaagcccaagagagagtcgttctaaaacatcacacgaaagaaagccggtattgttgagcccaagtccgttggcaagacgtaatcaccatacaagaaacagatcaatcgaagacaaccagctccacacaactagcatgaatatgctcttgcaagatacaaacactaccaaaactccattatcgagcgaccaaatcgaggtggcagtcacactttacaaatcgctctatgaaatcaggttaaagagacactacaagaaaaagtcaacaaatcagattataatctgtcctatagagaacgacaaattagttccctcgatcgaggttccacttttaactattgacttatcgagattgataaaagatggtaaaatagataattttcatatagacgaatccacactttggtgctttgccaaaagcggtgacctatttagatatagtatattaacttag

SEQ ID NO: 303 - DNA, 495 bp, Candida albicans
  unsure (314): Identity of nucleotide sequences at the above locations are unknown.
caagccattgatagtgaagtatatatttcattacatttggataatcaattaaaaataataataatgttaagatcatttactcgttcatttacttccacagctgttaagcgtgactttgccaaagctcaattgtttggtagagttggaaatgttgactttagagaatctgaaagtggtaccaaatatgttacttatagtgttgctgtgaaccgttacgacagagagtcgaacggtaatattcctacttggtacagagttgttgcatttgatccagttcaaattgaacgtttggaaaagctcttgaaagttggtanccttgttcatgttgatgcagctttgcgtcagagacgtcatgaagatccagaaactcacaaagtcacaagtgatatttcattgattcaaacaggtttcgatattgctagttatagaaagaaaacagaaggtgaaggtgaaggtgaaggtgaaggtgaaagcagctctcaccaagaagagtag

SEQ ID NO: 304 - DNA, 486 bp, Candida albicans
aaaattttcatttctcaaaacaggttggttgagtactttgatatttattcacatacattagcaatgttaaattctacgataagaagttctttgtttccaagaaattatggagtattgaattccattagaaattatagaccaggaagaccaaagaaaaccgtatctaaatatgttcaagtacaattattgcaggacataccacatgttggggtcaaaggtgaaatcaaactcgttaaaccagggtttatgaaaaattatttatatgttgccaataaagcatgttatgtgaatgcagattgtccaccaaaaataccagttgttgaacctgaaatggaaatcaagaaagaaaaagttaaaaagaccaaacctgaagaagaaactgttgaagaaattgtcgatattgttgaagagacggagcctacagctatgtcattagaagaattatctacattgttcttattcaccacggggctggaaggaaccgcg

SEQ ID NO: 305 - DNA, 321 bp, Candida albicans
tttaccttaaaaatctgcttaatgtcattgacaactctggtgctcacgttgtttgaatgtatcaaggtgtcgcctcaccacccaaagaattgtgcccaaatgggtgatagaataacctgttttgttaaacacgccaaaacatggcaacaagagttgactggaacatccttcaaccacttgagtccagaacaatacatttatgcccagcccgtggtgttcttaaacatggctcccctccaaataaaaggagggagtgtttttaaatttaacaataagccttgtttgttgattcataataatggtgaacccttgggttactaa

SEQ ID NO: 306 - DNA, 726 bp, Candida albicans
gacgttaatgattttctattgaaggaagcttcaacatcagctaatctttcaatagattgcagtggtgtaactgtgtttcgaaagctttctccaaggttgattctaagatctttgaagttacaacgcatacacttggaaaatttacttctttatcacaactttgaaccgattgagatcaaaaatttatctttagggtttgaagaaaaagccccatcagttattccaatagcaaaaatattcaaattaaataaaatcgagtcccttgaacttagttttgaaacaaaaccaactgaagttgaaatgcagcaattcatgtcacaactagtatcactaaaacatctatccataatgtctcagaacttcagatttgatagagcactaaactctttagatcccaacagtcttgaatcatttcatgttattgtaatgggcagatatgatacctttctggctaaaattgtagcggaaattctcaagaaccaatcagagtcaatagcaagattgtgctggtccaacaagcgattaaatgtcagaaaaagaacatatgggttgaatgattttgaaagagtgtacagcgtagatacagttgcaagggatcaagatattgctgaaatccgagctttgcttagtgatggatatcctcgtttaaaaaatgtcattctgaacgagtcatactacagagtagatagaaaaggttcaaatatagacgtagtattgataaattga

SEQ ID NO: 307 - DNA, 1611 bp, Candida albicans
  unsure (1579): Identity of nucleotide sequences at the above locations are unknown.
tatttgcagcgattcaatttggatagacgaatgctaagtaaacataaacgacaaatatctatggaagattataaaaatttaccattacctccaattcctgtgcaggaaactgaaaacggcaaaataaatgaggaatcttcaaataaaaatgcaaatgaaggtcgtaaacattctaattcggtgtcttcaacttcagtattttccaataagaaaaatgatatgggagagttcaaacagaatcagaatgtaaactcggctaggtccagtgctggcacatccacttcgaatcattcacaagagaaagctactcagtcagcaccaccttatgtgactcgagcctcagacatatttgataaactgttcagtgatcaattcagctacatttacccaattttaaatgatacgatggaaactaatgaggttgatcaacaaaacacctcatcaagagagttggctacctctacatcaaggtttacaaagactacattgggagatatgatagctccagcaaagaatccagttggtagaaaagctcctccttcttttgtatcgaattcgtctattttagaagcatacactaacacaccaaattcacaagacctgtttcttaatcacagacaatcgggtactcccgataacactttttcaccatcaaaaagtgacaataatactattgatactttgaaggaagataaatattttgaaccctttgatttgtatcaccctgaaatggacacaagctcacaacaaggatcggtagagccatatgataactactatgtgggtatagaagctaagacgtctgcaactactgctcctcaaaaacttcaaccacctgctgctacacattctcaattttctcaacctctgcagaggttaccaaatgacattctgagtttaccttctgattctacaattgtttataaggacgaaaagttcaatgacgataataccattgctgctacaccaaataatggactggagaatattaatggagaaaatatgggaaatgaacttttggaagaacaaacaaaagaggagaaaaaagaagaattgcaacgcaaaattgaagaaaagaaacagaaaaagaaaaaggagaaaaagaaattagagaaacaggcagaagcagctcaattagcggctgctcaagctgcagggttcccatttgcattgttgccgtctaatatgccacctccacatattccagggatgcctgaaactccacatgaaaagaagaagaattcatctacatcacctaagaagaagaagcaaaattctcccaagaaaaatacatctccaaaaaataaaactccaaagaaagtaaagagaatcccatgcgatccaaataaaccattaccacaaccaacagaagtagttgaaaaacaagaaaattcaaatctcaactcttcttcagctacagacttggaatctcctgtgcgtgtaaatgataaaaaacttgttattctgtcaccaccagaaaatgattcaatacctttacttgcaccaccaccttctaacaattctataatgagttcaccaagaaatgggatttgttcagttcaccaaggaattccacctngcccagttctccaatcccgaggcaccatctaa

SEQ ID NO: 308 - DNA, 336 bp, Candida albicans
atagcattgaggagttgtgtggttgttatgggagcacactttttcttttgggctaaaaaaaaaattctcatcgaaaaaaaaaaaaacttcaacaaaacacattactcatcaaccatggcatctcctcaaagagaaggattcagcatcccatcatctatctcacatgctgctttaggtcaagttcaaagcaagtcgcttggtgttaaatacaactgtgcacagtgtgctgcgtcgttttcgttaagtaagagtgataccatcagatgcaaagagtgtggacacagagttatatacaaagccagaacaaagagaatggtacagtttgaagctagatag

SEQ ID NO: 309 - DNA, 612 bp, Candida albicans
tcctcaccaagacaaaccatttacgttaacaaccttaatgaaaaagtgtcgataaacaaattgaaaaatgagttacagcaaacattcaatgtatgtgggaaaatactacagatatctgctctcaaaacattgaaactaaagggacaagcatttatcacatttgaagatatacccagtgccacaaaggctttagagcttaacaagaaagatttattttctaagcctatgaatgttacatatgccaaatccgatgctgatgtgatttcgaccgacgacaatatagcacaacgtaaaaagttacgtagtaagaaaagaaaattggataaatcaggtactaagaatgacaagcagataaagaaattaagagatgaatggaaagaattacctcctaaccatatattattaattcaaaacttggaaaaatttgatgatttgaaaatttacttcgaaaaatttgctggatttgataatgtgagattggtcaaagtgaaaaatttggcttttattgaatttgaaagtgaagacttggccaaatcatgtttggatcagacaacagaagatgatttgaaacaatttgggcatgatgtgatactttcatttgctaaaaaatag

SEQ ID NO: 310 - DNA, 192 bp, Candida albicans
  unsure (118),(171): Identity of nucleotide sequences at the above locations are unknown.
gagcaacaaccttcacaatccaacacctcacaaccagtttatttatctgaatatgttggtgaatttaatcatagcgcggtcaaaatgccttgttctcatatatttggtaaaggttgtntatgtgaatggcttaagctacataccacctgtccgttgtgtaaatattcggtnctggaagaaactgcatcataa

SEQ ID NO: 311 - DNA, 882 bp, Candida albicans
aggcccttagttaatatatcttcaaatgcagcattagcttcagtggtggaaacaaatatcggaccaaatcaattgacacgagaattagtttcaccaactgtcatcaatacaatgattaatgatattatgttagtcaagataagtgatgaaaacgggaaaacccaaacaaacaagcacggaatcaataatgttgttagtataattattgaactcattcggaaaaataactccgactatgatcttaattgtgggacttatagttctatgttacaaaatggagacgggggtccaatagaagtcaattcttatgttatgtatcaatggctcaaagattttgaacaaaacccaccgggaccgcgagatcccatctatttgggcgaaatgttggatttgttttcatcaaatttagatagaattgccgcattaatacaaacggaacctattccaccaccacatgtcacttccaatattttggggttcacaagatttaagttatctgaattgattgccgagttgttacattgttcaaacatgatattactcaattccagaaaaataaagaaaattattcaagttagagatcaaatcagatctcaacaggagaaaagattacagaaagcgttgcaagagcagattctgttttccgattctcccaacatcaatcaagtgactactggtttagacgatgtatcattagatgacatacattttgctagtcactctaacgatgaagttcatgattatggcaaacttcttgataatttagaccaagaggaagattcagaagatgatgaaccttctatttcacctgagaacccgtttgtatgttctgaaagagacaaatctatgagtcttcaccacgggcgctggaaggacccgcac

SEQ ID NO: 312 - DNA, 744 bp, Candida albicans
acaatttcagcaaccatgtctttttggccatttacaaactctatgaatagcaataatgcattgctgaaatttttagattcggcacaagatctatcatcaatcactgctgaagatctaataggagatccaacattactggaagaacttttaaatgaacttcataatattaaaggaaattataactcaagaaacggcgtagctagttttctgtttctgcaaccgcaaacaatcaatgaagccacagtctcaaactcggattcagcatcatttacatcgtctagtaatgatatcaacactggcaacacaaaggatagcaggggaaggaagcttctagaaatattgattcaaccacatatattatctgggttgatagagtatgtggaaaaaagtgttgattttttttacgaacaaagtattaaagaaaatgaaaaagttttggatttactcaatgagaatccacctgagacagatatacaggaggaagaagaacttaaaaagattagacaaaaaaacggtatcaagagtgacgacgatgatgacgatgacgtcgaagatgatgagaatgaggaagaagaatcagaggatagcaagtttcgcagatgtgttcaagcggcagcagatatactatcaattgatttgtggattattctgaatcgaattatcgagactgaaagccttatacataaactatggcggatcattgatgccaataatttatatacgccacgaggtggaacacttggg

SEQ ID NO: 313 - DNA, 912 bp, Candida albicans
  unsure (42): Identity of nucleotide sequences at the above locations are unknown.
aaaattcactggggcataaaattgaacggttatgtaattcancctaattcatatgccagttcgcgtcatactaaaaagggtgcattagcacaaattgatccggaatcaattgccaagatgaaaattactcgtgatgattttcttttagcccttaatgatattcgtccagcatttggtactgatgaagaagatttatcacaacaagctcaacatggtattatacaatttaatcaaactatcagaaacatttttgagaaaggtcaatcaattattgatgttgttagatcaagtgaaactgaacatttaagaagtatattattatatggtcctccaggggttggtaaaacttccattgctactacattagcattgaattctgatttcccctttattaaaatgttatctgcagaaactttagttggtatgggagaacttcgtaagattcaagaaattgataatgtattccgagatgttcataaatcacctttaaatgtattggtgattgataaaattgaaaacattattaattataaccctattggtccaagattttccaatgatatcttacaagtattgatggtttatttgacgaaaaaacctccaaagggaagaagattattaattattggtactacttcacaatatcaagttttcaaacacatgaatttaattgatagtttcaatgatgccattgctgtcccaccaattaaacatattgaagaagttggtaaagtgttggataaattaggttttatgaataaatcagaacgtgaagagattttatcacaattgtctcgttatgatataaacattggtatcaaaagtttaattgatgtattaatggttagtaagtactcacgtgacactgtcgatgaagttgttaataacattgtagagaaaatgagtggataa

SEQ ID NO: 314 - DNA, 1266 bp, Candida albicans
tattcagtaatagacttgattaaggatcggatgatagacaaagacactgtccccttgagttcacccataattaagttatcacagactttgttcaacagggctactgtactcatttactacccttgtttcttttttttattttctttatcaaacaaaatggttatactaactcctttcacttttttttcaggatcatttaccaaacaaatcactgaatatttaactttatctaatccaactaatactccattggcttttaaagttaaaaccactgcaccaaagttatattgtgttagaccaaatgctagtattgttcaaccaggagattcattacaaatttctattattttacaaggattttctcaaccattaccaaatgattataaatgtaaagataaatttttattagtttctgtaccagcaccaaattcaattgatccatctaaagttggtgaatcttggagtcaattagaagctcaattcaaacctcaagttgtttctaaaaaattgagagttaattatgttgttggtccagataagccagatggtggtgctggtgtcaatcaacaacaacaacaacaaccaagtcaacaacaaccacaattcaatcaacaaccacaacaacaatctcagcaatttcaacaatctcaaccatctcaacaatccattccacaattgcaacaacaacaacaacaaccaagtcaatcaagtattgatgttggtactggtgctggtattgctgccggtgctggtgctcttgccggtggtgttattggtagttctggctataatcaagctcagaatgttccaaatggtgataattctttcaatcaaactgccaatagatcatttgacacttcttctgctcataatggtttcaataaccaatcatttggtggtgcttctcaacaacaacaacaacaacaacaacctcatcaacaattacaacaacaacattatcaacaatcaagctatcaagctactggtggtaatggatacggtggcaatgttggtggtggtgttggtgcaggtgcaggtgcaggtgcatctcaaccatctccagctttacaacgtgaattggaagctttagctagacaagttcaaacattatctactaaattggatcaaaatgaaaaatctgctgcctcaagaagtccagtttcttccttggttggaggatctggtgatgatgtcagtggtatttcattaccagttgctttagttttagtactcattgctttccttattggttggttagtattttaa

SEQ ID NO: 315 - DNA, 2652 bp, Candida albicans
gtagattgggatttagcacaggtatacgatccatttacagtgttctggaccaaccatcctttgtttctgaaccatgggttatttatcctgctaaacacaagaccaatggaaaaattgtttcagttttcatttttgacaaatcaaaatttgaaacccaaagttagtaggttgcatactattttttcgagtgtgaaaaatcgtaaagtagtgataagtgaatgttatgaattgataaaatatgaagttagtcaattaagtaaattgaaacatccacaattattacaagtttatgaagtattagaagaaaccaaatcaaaattcttatttgttactgaacctgtgattgataatttagttacggtgaatccaaaagatttagatgatttatctattcaaaagggacttttacaaatttctaaaggattacagtttttacatagttatgggtcaataatccatttgaatttacaaccttcatcagtttatattaataatcaaggggattggaaattaggtgggttcaaattcttacaaaacttgaatgaaatttcaccacaagaaagagaaaacttctatatattgaataatatgtcagtggtaccatttgcaaattttaatttaaatttcacagcaccagaattgattattgattctcatacaaaattggatttcgccaatgatatatggtcattaggtcaattaatttattatttatataatcatcatgatttattgatcaattgttttgatgccaatagtatttctgattataaacaagaatttcggaaatttgaacaaaaattctataatcataaaccaacagaattgaaatatgtattaaaagatattcctgacaaattatatcctttatatccacaaatcttggcaagatatcctcatgatagaatcacattggaccaatttatggattcagagtttttcaatggcagcattataaaggcaatgtggtttattgatgaattttccacgaaatcaattgacgagaaattggtgttcctaaaaggattatcagaaatcgacccacaacaatccaacaattcaccgttaatttcacaattccctccatcattcagatcactgaaattgttaccattattaattgatttattgacaaatgaattgaatgtgttgacagaagctgcaattgatcctaagaatgatgaattgatctcagattctttaaccattgtgttgaaaatatctgacacatgttcaagtttgacattccaagataaagtatttgatactcttttcaaagataatccaagggataaaaaggcgccacaaacattcactaaattaataaattcttctgtgagaactagtttgacattgattaacaattttgataccattcaaacaaaatcaaaagataaacaatttgttcaatttttcaagggcattattgatttagttttaacaatatctcctaaagaaagcaatcaaatagaattacaaattcaattgcaagaaaagtttttaggattcatacctcaatttgttgataagcttgatttcccatatataaagaatactttagttccattattgagtcaagtgttcaaaacaaccagtattttgtcaaccaaactaattactattgatacatttgaaggattagtcgataagaaaatcattgataaaatcattgttaacgaacaattattccccattatgaaaaatttgaaaagtagagataaaagaattgtcaccaagatgttaaattttttctccaaattggctacaagtgaacatattaatttagatttagaaacaatagtggagtcaataatccctcaaagttattcccttgcatttggatgcaacgattgtaatcaattggaattcaataaatttattgcaattataaattctgtgcaaaagcaattggttgagaaaaaattgtctactttaacgaagacttcatccaatggattttctaatggacacaaaggtgatacaaatgaagctggtagtaataattttgaagcattgttgcacacacaaacgatacacgacgtccccgatgagatttacgctccaaagggaaaagtaatgcaaccaaagagaaagtcattcacgtccaccacgaccaccaccactagtagtaccaccacaaaatcaaattctgcatcttcaagaaatacgacggagcttcgtaattcaaatactttaagaccaagaccaagaccaactaaaaaacccactagtggattagcatttggcgctacgaatgctcaatcaaatactaccaacaatagactattaaacacattgaattctacatttgataaaaagcaagaagaagatgattttgatgatttccaactggcatcaggtacatctgcatcagagttatcatcaagcaataaaaatggtactctaaactggcaaggtgaagtgaataaaatgaaaacattaccaaatactccaacaactgctgaatcgttcaaggttctgaagtcacaaccacaagtagaaacgaaaaacgttaattatccaccaggatttaacacaaacatggtgttatctccgaaatcatcatcatcagtcaatgccaatgtcaaatcatcaatatcaacaacatccaatagtaatatcaacaattctgatttactagatttactataa

SEQ ID NO: 316 - DNA, 249 bp, Candida albicans
agggactttttgaaaccaaaaagcccacgtatcaactttaaatcgaattttattgactaccatcttcctgaattaactatgttgagtagattgggatttagcacaggtatacgatccatttacagtgttctggaccaaccatcctttgtttctgaaccatgggttatttatcctgctaaacacaagaccaatggaaaaattgtttcagttttcatttttgacaaatcaaaatttgaaacccaaagttag

SEQ ID NO: 317 - DNA, 1245 bp, Candida albicans
ttcccagtagccgaaatgaaaacttcaagtgcccatcaacagcgttatttatcgtcgataattggaagattatgcaatgattcgagatgtattattgaatatcatttgaattatgattgtgacagcaacatgccaaatatttgtgaaaagcttattgattatttgaccacactttcattgcaaagagttgaggtcactccacaacaaaaatatgcctatcgtgaaaacagaagaaatggaatatctgtttacgacatcaataaaatttcaaacctcaccagtaagactatgtcttcaagaccacctgagccagagatctatagtcaattccccttggagtatgcattacaaatgacttcaattggatgtgctgaagcattcttacgctcgttatattcttgggcacaaaggggtcttaccaatgccaactctaaacagtttactattgataacaataacaagtcgttatcgtcactcagaaaccgttcagactcaacaaatacatcaattagtgcttcgagaaaccattcatttgtcaacggagacagcttaactgatagtgataatcctcagcaatttgaaaaccaaaagcaaaggaagaaggcatttttggaaggtgtacgacaatttaaccagaaagccaaaaaggggttgcgctactttattgataatgggtttattgctgcagatgatccaaaggatattgccaaatttcttttgacaacagatggattagataaagctactattggagaatacctcggggaaggtgatgaaaagaacattgctattatgcatgcatttgtcgatgaaatggaatttgaagaaacagggtttgtcgacgcaatgagaagatttttacaatctttccgattacccggggaagctcagaagattgatagatttatgttaaagtttgctgaaagatatgttttgggaaatcccgaggttttctccaatgctgacgccgcatacattttgtcatattcggttattatgttgaacactgatttacattctcctcaaatcaaaaatagaatgaccattgacagctttataatgaataattctggaattgatgatggggaagatttacccagagaatttttggaaaaaatttatgatgaaattcaaaacaacgagattaagttacaatcagaacaacatgctgcattattggcagtgatctttctattcctgcatccggtcattttcaccacggggctgcaaggaccgcgcttcaac

SEQ ID NO: 318 - DNA, 1476 bp, Candida albicans
gaggaattcaagaatctcatgttaagaatgtgggggttttatgaacggtataaggcccaaagagaaagatttccaagagatcacaatttattattcattagaagttttatcacaagttatttccatgaaattgctcaatacactgtgctcaacactggtgaagataataaaccaattgttcctgacattgaaaaaaatgaacatctagtaaaattgtggttcccagttttgtacggtttccatgatattatcatgactggtgaagaattggaggtcagatcacgagctttgacatatttgtttgatgtgttgatgaaatatggacaatattttgattttgaattttggaaaattatctgtgaaaacttgttatttcctatctttcatgtattgagtaatcattgggaaattggacttgatgatattaatgaccaattatcagtttggctatccacaactttaattcaagctttgaaaagcatgatgacattattcactcattattttgatgccttaaacagctttcttgatggttatctcgagttgatcatatcttgtatatgccaagaaaatgatacaattgctcgtattggacgtgaatgtttgatatcattgttaatcgataatgcccaaaactttaataatgaacactggggaaaggtttcagatgctcttagcaacttgtttgaattaacaactgccaaagaattgtttacatccgacccactcagaaatagaactgttaaagatagtgaaggtagttcaagtgatattggcggagaagatgtggaacacacagaaagcaagaactctattattgatgacgcggaagagagattaaagaaatcaaaagataagtcttccattgttgtgaagagtgttttgcagttgttattgatacaatcattgtctgaactctttgaaagtgatgatttctatgaaaatgtgccttatgattatttgtttaagatggcaaaattattgttcaagagctacaatttcgctaagaagtttaacgatgattacgatttgcgagtcagattatggaacgcgggtgtgattgaaaggttacctaatttgttgaaacaagagtcgtcctctgctgctgtgtttataaacattacattcagaatgtattgtgatgatgacaaggcgtcaccagcaaacaagcaaagtttattggattatcttgtaccattgtgcaatacaattgtcgaaaggtattcagaactcgatgagactaaccaacaacgaaatatttccacatggaagccagtaatagttgaaatctatgaaggttatgtcgaattagatgatgacgactttacaaaacactgtcctgcattgtatcatttgactttgaaattgttttcaaagagtatgtcaagtgagttgcgtttggcaatgaaagcttttttaactagagtgggtgaagagtttgttagtatttctgacaacaataaggaaagaaggtga

SEQ ID NO: 319 - DNA, 699 bp, Candida albicans
  unsure (659),(661): Identity of nucleotide sequences at the above locations are unknown.
ccacctttcaaagaatacgacgaagaagatgtcagtcgaacatgtattgaaggaattaagttatccattcgcatagcgtgtatgtttgatttgaattatgccaaaacatcttttattagtgctttggttcaatttcagaatctccataattacgaagaaatgaaacaaaagaacattgattcaatctacataatgttggagttggcagtttctgaaggagatcatttggggcgtgatgcctggattcaaattttaacatatatatcgcaattagaacgattgcaattaattgctcaaggtgtggatcaggattcaattccagatgttacaattgccaaacttgtaacgagaaactctttggagacttctcgaactagtggtagttttttcagatcattttattattcgcaaacaccatctcaaacagcagcaagcaagttccataatcagcaattatcgccagaagttgccagtttattaacaaagacggagttggaagttgctattgacaaagtgtttacaaacagtgctaatttgtctggagaaagtatcgtccagtttgtcagagcattatctgaagtggcacaagaggaaattgattcttctggtcaaagcaccaaccctagaacttcttcgtggaccaaaagttgtggatttgncnttatttgccagacatcgggactaatatcccgggggtta

SEQ ID NO: 320 - DNA, 657 bp, Candida albicans
gatagtttacaacaacaagtctcatatctaaaggaagatgaatttttagtgaatgtattgaatggtaaaagttggatgaatccagaagaccccacgaatcaagcattcaattctgttgcaatagcggagttaaatgccaatgatagaagatcactaaggaaacgtgaattagctggcagattcagtgttggcgaagcagcagatttgtccgatggtggtggtggtagtggtgtgggtggaggatctgctgataatttttcatctgtttataataatggtgggtattcatcagcagggaaaagaagaagaatatatgccacgaggtatagttcaaatgatgaattgagttcaggtactactagtggtatgccactaaataatcattatagcactcgacaaaatgggaatgccactagtggatatgaatctaacttgagtgataaagattatgatactttaaatgttttgatcatggagaatgaagatggaggggcttctttgaatctaacggcaaagaatggtggagttagtcaacacaaggttcagaccagaggtagtaataaacattttgttggtccacaaggattaaaacctgaggaattaaatgaagatttaacgttactacggaatgctatagttaaaaaagattggtcttag

SEQ ID NO: 321 - DNA, 372 bp, Candida albicans
cttatttctgttagttgttacttctataaaccatatatccatcagtttcatttaataatacatcatttttcagttatgtcagatacattatattctcaaagagaacatcagaacaatcagaaatttgaacaattagcttcaactttacaccaattcagaaccaccgtagatcatgatattcacaataatgttcaacaagaaaactccctactagattcattgaatgataatttcaattctttaatggtgctggttaaacaaacttctggagaattaagaacagttatgaatagaaatgctagtcttactcggatagtaggaatgatattgcttggattctttataatttggatgttgtataaattaatataa

SEQ ID NO: 322 - DNA, 705 bp, Candida albicans
agactagttgctataccatttctaaaggaattgttgggtccagatatatcccaatatcagggaggtgataccgattcttatcttcacgacatgtcattattggatcattttgaatgcttactagcattaaccaatatagcagccacagccaaaccagagcttaagcattacatggttacacaactatttgattcgtatttagataactttattatttcagaagattcgaaaattcgaaaagcaacttgggaattgatagcaaacttgagcacagaagttcctcttttagtgaaattctttaactgggatgccgaagctgccagaaagcgattcggcttatcgatgcaattgcttcaatcaggggaagtgagtttacaggcaaccattgctattttcttgttgcattctacagatattgatccactagcagcacagattgtgtctgacgacaataaattcaatactttcattgacataataacggacattttttcgactcaattgagtgaaaaaagtttgattttaccaatggaatacgtgctattaaatttagcaattgctgctggaaatcattctaaaacgaatttctccactttagcttcaaatacaaaattgaaagattgttgccgagatatacttcgatccggaggggaagaagaacgagaagtaataatggaggtaatcaaaacttgtcagtttaaatag

SEQ ID NO: 323 - DNA, 1458 bp, Candida albicans
gacgcctttgaaattatgaatgaccaagcggctattataattaccagtattttaggtattaatagcgaatctgaaaaaataatgcaaaagttgtattccagcttaagatggatcatgaagtcacgtgttaatttgccattctacttacaggtatatagctctttggtaactcattctaaagtcacaaatccagagcatttaaacttatttttaacatttgtggacggacaaaatgaagatgttcaccgtggagttttggtgttggttatacagaacttgcaactacaaaaaacgaaaacatcaaacgtaatatcagagtatctagaaatgattatggatgaaaacgaactcagttacggcagctttgttaatttcgtatctgttcaaaccatgtgtttccctattatccccgaaatatgtgccaccatttaccaggatgacaaaacaagaaaccacttgttgcaacgcataaacagcattatcaagggtgaggacattcctttagctttgcctactttgaaattgattacagcctcatgcattattgagaattgtcgaaattacactgtttccaactttctcaagttcctaacacaggggtgtaaaatcagtaatagcaaaatccaagttgtttcaagtgtaactatcagtaaactattgaaattactcgaagttgaaaagaaggattctgagataagtgttatacacttagctgaaattttgataaattatttcaagcatgccaaagttttagatgaatacgtggaatactccgtagaggggttgatgtatttgtcattgtactggaaggtcagagaattaattcgaatggatgtaaacttaatcaaactatttcttgcaaagctcaaagagacatcaacagattccaccaatattaatacgtcatttcaatatggagtgttgtcaattttctcaaatttgacaaaaacaagagataccaatgacaaagaatcaaattcaaacactagaaatcgtttaaaaacagcagcaagtcctaaatatggatccaataacgaacaagaaaaccaagaaggcattactttatttaaccgagaactacttaacgataacaaaattgtatccactatagcctcgttaaagtcttataaatcaggttcaaataattcactttctgaagtaatcaaaattatataccacttgtcatcagatcaaaggaaacaggtccgaatcgaattggtcaaacaaggtgcattgactatagtgttaaattatttaattaatttcagtgaaatgaaacgccacggaaacttaataagagcctttcctaaaccacaagacgatatagttcaacagtgtcgttcttacgctaataagtcgttggcaaaaatgtggattgttgttgatcctcaaaatgcgttttccaagtacgattcacgagttgctatcccatttcctaaaagaatggttgggtccaga

SEQ ID NO: 324 - DNA, 2658 bp, Candida albicans
actgttttatcagtaatggatacgtttacctctatgacatttgtaaacaatatttttttcttggtaccatctcagagatcaacagaattcaaaacacacatagcgtatacaaaaaaaaaaaatctcaaatgctcacacaatccaaccatagtttacaaacaagaaccatttttctgcaaaacctcggtttacatgtcaagtctaaaagataaagagtatccttctctaaaaagaaagggtctatccattggttcgggtagttacaagccagtaaacacattaggtgctgcccctcgaaatgaactacccaattctaataacgtatctgaagaaacatttctatccaacataacaatgaaagagagttacgcccctggaaatgatcccagcttttcattggaacgtgccaaagaacgtcgacatagattaaatggattaagccagtctttgaaaaccaaccactcacctgtggacgtgacagaatttcaaataacggattgttttggcagttctgtcaatgtttcggctaaagacttgagagatgagccggcggtgtcaatcaatctaaaatcatttcataaagttggaggagcgtattacaggagcatgagtcgccgacagcatttactaaatatatctaagaatggggactacatttgcatttttgaaagtgattatccgaaatcaaactttctcatcaacatagacacacaactaaaatctctatcgtttgcaccagaggctcttgttatggaactaaatgaagggcatgagactattattgcatcacattatggaagagataatgaggtacgagagtatttccagaacaatccaacgactaaagtcgatcccagcaaaacattgtcggggactgcattgcaccgacttgagaagacagtacagctagataacgataacgataacgatttggacgctaccgaaaggagtgtttctcggactcgtccaatccgagtacgaacacggcaagcatccaaggcgttttggtctctggttgctgaagaaaataaggaagatcctttggacatagtgaagattacagatgattcacctattgagagcgtttttgttgaggatgactatattccgtatgaaaagccagcgccatttgaacctgacttgcagtatacttttcctgataacaagatatttcgaatcacagctaaagattttgccacattgtataacaacgattggatcaacgacgctgtgatggacttttgcatacgctacgacatagaagaggcaattaaccaaggagtcgttaatcgagaagacgtttatgcgtttaattcgtttttctacacaaaattaacatctggtaaaaccgaagactactataataaagtgaaacgatgggtacacaaaatagatttaatgtctttttcccatattataatgcctattaatgaaaaacaccattggtattgttgtattattcgaggattgcccactttgttggaaatgatcaaactgcaaaaagaaaaatccaacaatgccgattctcccgattctgaagaaatgtttaaacgatggggagttgaaatatttgtgtttgattcgttgggtttacggagagataatgtgaagaaacccctaaaggcgtttttgattgattattgcaaagacaaatacaattatgacgtaaataccgaccaaatcagggttacggcagccaaagttccacgtcagaacaattacaatgattgtggcttacatgtgatttacaatgtgaagaaatggcttttgaatatcgaggcctgtgagtcgttttggagaaagtggcaacgaggagctgcgagaaccatttttctagccgacgagcgaaacaagatgagaaggtattggattgagaccttattaaagttgcatagtgagcaggcgccagcaatcaagaggagttcccatgccaatgaggaagaggatgatgacgatattgtggaaatagtggacactaaaactattgtgcctccccctacagaccagcccaatctctcgccaccatctaaccaaaaatcaaatgctgtatttgacaatagttttctaaatcaggaatttggtaatgaacacattccgagatttgttgttgaaactttaaacaagattttccccaagaggagtttgcacataccagatgaaatgaaaaaacttgtttcagcgtttatcaaagattcacagagcaacgtttcgtcagaacaagaactcaaagaagtatttataaggaaccacgaagtgataaaaaaagagattgaaaatcagaacagaccgaaaaacaaaactattagaattacagatgctgtttcaaatttacgaatagatccaggtacgtttttttgtccaacccataaagagattagcagtggattaagaaaagatcaattacttgaggagatcgatgccagaccaataatcaaggcaatacgcacaccacaagagtccgaccaaaattctaatgaaaaggatgcggaggatcacgccacatctgattctgaacacgtccaggtagaagaggttaatttagaagaggaccgcaactctcgtcaacggttcactagatctcgccaacgggcaaagcaaaatattatggatcttgcaatttttgataacattgatagaaaacgaagaaagtgtgaatag

SEQ ID NO: 325 - DNA, 210 bp, Candida albicans
tatatggataaaaagttatcaatacagctaaatggatcaaggaaaattattggtatattaagaggatatgacatatttttgaatattactttgacagatgcgttggaagttgattcaaaaggtgaaaaaatgaacattggagcaacagtatgtatttgtttttttaggggggtggatgaggaggagagttttattgaagacaagtactaa

SEQ ID NO: 326 - DNA, 597 bp, Candida albicans
  unsure (431),(432),(433),(436): Identity of nucleotide sequences at the above locations are unknown.
atggcatcttgtaatcttctagtcatacaaaccacatccataattatgtttagttcactactatcaaggccagtcaatagttcctatgatccgtcttatcacttttctcctgttcctagagagattaaaaatgattctataccaaatggagttgtctcaaccacaaagaatgcaacacctcttgccccatcaaaatatgatacaactatccctttaaagaaacgatatcctaatctagtgcataatttccctaaaccagaattagatgagaatgtaatactagagactaagaaaatcattgattccatattgaatccttctgatgaaccaactaatgatattaattatatcaaatatgaaaatccaaatccaaattcaaatcaagaacaacaacaacaacaacaactgctgctgctgctgaaaataattcnnntcnaacaccaaccagaagatcctatgcttccaccaaaattcaaattacgtaagaatcgacatgaaagaatcattgaagatgttacatttgttaaagatctcaagacgaaaaaattaactaaagaagctcgacatttgttttcaccaggcgcgccagatccacgt

SEQ ID NO: 327 - DNA, 978 bp, Candida albicans
agatttatcactaaacgtcccagcaagatgatctttattcccattatcatattaatctatctagtttcaatagctgcttcagacaagtcacctaaaatcaagaaaaaccctagaaacgtcgttgctgttgcagactttccctttggaggtgatacacaggtcaaaggaaacgtggtgtttagtgctaaagaaggtaaacatgtcaacgtccatattgatatgacagggttgcccaaagatgaaggaccatttttctaccatatacatgaacggtctgttccaggaaacggcaattgcgaagcagttgggttgcattttaatccttataatgctagtccagtttgcgatgaacaaaaaaacgatgcctactgtcaagtgggcgacttgctggggaaacatggttgtatcaacacaacttgctttgagttgaaatacagcgacccttatttgtcgttaaacagaaaatcaaagtcctatattattggaaagtcggtggtgttccattatccgaatttgacgaaaattgcttgtgctgatattgaagaggcaaacgagttgagactacagagtttgattgacgaatacacccaaaccgatgacgccattcaattaaaggaactaaatactcctcttgaaaccgattacaaatttgacgaggtagaagcgttatcatcggaaatttaccattctgataccgactccgacccacctcaacaagagttaattctgacagaaaagttatataacaaaactgacaacgtctacagcccagaagaaactaggcccagcgaccagaacaaaaagagtcaccggcactccttgctacccttggctaaatggaaaaaaaatagccccaaaaactattccaacatttctatccacggaatctctagtgattgtctcaatgatggtatgatggtcaccggttcggtctttggttctctcgtattgggaatagctgcaggaatatttgtttag

SEQ ID NO: 328 - DNA, 516 bp, Candida albicans
  unsure (494): Identity of nucleotide sequences at the above locations are unknown.
cagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgccataaagttttcacccggacntgccaggatccgaagtataggt

SEQ ID NO: 329 - DNA, 483 bp, Candida albicans
ctgttggttcatgactatgaatgtcataattatggacagcgcgcgttaacttgggtatcgggcacgattaatgtcgtatgtgctgctgatgtgctgattgttcccacgcctgctgagttgttggataacacatccgcactgcagtttttcgatatgcttcgtgatctgctccagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataa

SEQ ID NO: 330 - DNA, 309 bp, Candida albicans
  unsure (279),(285),(301): Identity of nucleotide sequences at the above locations are unknown.
ataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcacgggctgatttngttttnctacgcgaccgtcgcngatcatag

SEQ ID NO: 331 - DNA, 1107 bp, Candida albicans
ctacaaacaacacagattagtatgaaactacttgcacttttgacattgcttccgttagttatatccacaaacttggaagagaaatggggtggattatggccatttcagggaatcgctacatttgcacatctagaacatttccaatgcttgattgaatcggaaaaacaatttgacatagggataatcggtgtaccatttgataccgctgtttcttatcgaccaggtgcacgttttggacctcgcgcaatcagggatgcgtctcaaagacaaaataatttacgtggattcaaccctaaagcattgtttgatccttatcaatcatgggctagaataattgattgtggagatatccctgtgacaccaatggacaattctgctgcctataaacaaatgagtgaagccttcaaagacttgttgaatagaaaatctttgaataacacggagatcccaccaaggtatattgcattaggtggagaccattcggtgttattaccacatatccgagcattgcataagatttatgggccagtcaacattattcattttgatgctcatttggacacttggaaaccaaacaaataccctacatcggaaaagaatgacattaatcatggatcaatgttgtggaaggcgtacgaagaaggattaactactaaacacaacattcatgttggggtacgcacaagactttcagggttggatgatctacaagatgatgatgaacaaaattttgtcagaattgaagctgatgatatatggttgaaaggacctcaatgggttgttgataaaattttagccaccataccaaaagacacggcaacctatatttcagtagatgttgatgttttagatccaggatttacaagtggtactggaacacaagaacctggtggatttttaccgagagagttgatatatttattgagaagtatagatggtttgacagtggttggtgctgatgttgttgaagtttcaccagcttacgatatcgcggaaattactgcaactaatggtgctcaaatcgcttatgaagtattaaccagcatggtgaaaagagggaatatagataaatctttggttaaactggttgttcacgttttcgattag

SEQ ID NO: 332 - DNA, 1269 bp, Candida albicans
gaatattcagatatgaaactttacatttttgttttggttgcatgtgtgtcatcacaaaccattttcagatcaccatcacttcttgatcaattatatggagaattacatggaagaacaaacacagcaccaaatttgcaggtacaagcagaggatccaaatcagatggtcacacaaaaggttttagcaatgagatccaaattgacgttgcctgataaagatgatacttccgatattgctattgatcagaatatgtttggtggaatcttgacttatgcccatttcaatcatttcaattgtttcatttctgatgactttgataaacactccactacagatcaacaaacaaccaaaaatattgatatcgctattgttggggcacctttcgatactggaacatcctatcgcccaggagctagatttgggcccgagtcaattagaagtaattcccgacgtctaggaagtgcttggaaatcaaccaaaaaaagattcaattacccagttaacccatatgatgagaccactcataattactctattattgattgcggtgatgtggctatgactccatttgataatcgcattgctttaaatcaattgtaccgtggacatagaagtatttctaaacacccagggaatgtcaatcaacatcccaaaattatcacattgggcggtgaccataccatcaccttaatggcaataaagaacgctcatgaacaattgaggacaaaaattagagtatttcattttgattcacatatcgatacctgggatcctaagaaattaggtggtggaatcactgattatatgtcattgaatcatggaacattcttgcactacgctactgaattaggatacattgaaacaaaaggcaactatcatgtcgggataagagcaccgtatatcgatgctaattacgacaaacagcacgatgctgattgtggattccatattatccaagctaatgatattgacaagattggagttcaagggatcattgatgagttagcaaaagatccaaacattccaacttacatatcagttgatatagatgtattagacccagcctatgcaccaggaacgggaacaatggaagctggcggattcacgaccagagaattgttgagcattttggatgggttgaaaaataaagttaacgttattggtggtgatgttgtggaagtgagtcctccatatgatacaaatagtgaaatcaccaatttggcaaccaccagtgttgtcgattcattattgaaattaatgattgtctaa

SEQ ID NO: 333 - DNA, 1065 bp, Candida albicans
gaattgggaaattaccacgagggaccaaatttacaatttaaaattaataattattcattatgtaaagatgttaggaaaattttaaaacatccaaaactgataagtaaagataattcaatttttcaatcacctccattattggtattgaatggatttgggaaaattctggaaatgtcacaacatgaaaaattaatggtgacaatttttcaaaatatgttcccaccaattcaacctcaacaaactaaagtttcatcaattaaacgagtattattaattagtaagaataaagttactaatgaaattgaattaagacattatgctataaatactaaattagttgatgaaaatagaaatgttaaaaaattgattcaatctcatcataatttgaaaaaaaaattaccaaaattaactaataatcaagatgtttcagatttattattaaatccttattcaattggtggtttgacttctgatagtgaatttgaagatgatgctgtagttgaaatacaacaagaaacatttgttaaaaaagagccaaccaaggcgataaccaccaccatcaccgccaccacagaaaaagaagtagaatctcagtcacaaccacaaccacaaccacaaccacagcaagggaaaagtaaacgagcaattaaattgacagaattgggaccaagattaaatatgtcattaataaagattgaagaaggtttaattggttcatcgaaaaccatatatcattcatcgattcaaaaaactgaggatgaaattaaatcattagaaaagaaacatttattaaaacaacaattaaaattggaaagaagaagtaaacaacaagctgctgttaaagctaaattagataaaaaagaagctaaaaaggctagaagaaaagctagagaagaaggtagagaaaaagataacgatgataataataatgaagaagaagaagaagaagaagattcggctgatgaagaacaagtagatgatgacgattctgattctgatgcagttgatattaatcctgaagattatgaaaatgatagtgatttatatagtgatgttgatgtataa

SEQ ID NO: 334 - DNA, 1437 bp, Candida albicans
gagagatatacagctatcatggcatcaccaattagcaacgactcctttctacagtgggatgccgcccaagtgtcaacatatataaattcaattttaccccacgaacaacggcgtatcggtaatgtatttctagacaataatgttgatggatcgttgcttccatttatcacaacagaacatttgaaggaaatcggcatcatttcacttaaaacacgtcttgtcatcaaaaaaggaatcagtgatcttattgcagcacattattctaaatatccaccaaaatcatacaatgacccagattacaaattgaatcatgccaacattagcaacaactacacaacggtgcaatccttgaatctatatacagtgttaatgcaagatatgatgaaaaagctaaactatgagttacataaacaaaaatcaacatttgttgcctcatccccgatttccccaactcacgatgaaatgaagaaactcaacgacaattttatcaaactcaaaacggatttgataccaataataagattattgaaagattccaagccattaccaaccccgactctagatcctggtccagttgcatccatggactcgccctcatatttctcgtcacaccatcatttggagcatgacagttttgaaaaaggtttatctcgatcgggaagtggtaacgctatgaccagtaacaataggacaccaacgacaataccaagtccagcatcgaataggttttcttctgggtcattattatccatgggaactgggaaaatagtatcacagtctgtccccaaatatccagagaataaagcaaacaacgatttcacgttacaaaaagttggtctacctcgaaataattcaaataagagcttagagtctcatgacagacagcaaaatgctagtggaatcagaccaagattagtacaaaacccatcatctaattcaatgcatacggttacgtcaccgggtggcataccaccgcaatctgcttcagcagtagcaacggcagcaataaatggccatggtagtggttatattccacaggtttctactcctcccaatcagttgggccaccaccataatcctggaaccgagccattgaaacaactcagagcttcaacagatgactcgtgtttgaagattctacaacaggcgatgaagcgacaccatataccacgtgaggattggtcaagatacgtgttggttatatgctatggcgacaaggagcgaatcttaaaattagctgaaaagcctgtagtgatatttaaagaactactggaattggggaaacatcctgctattatgcttagacaattggcagattcttcaacagatgactcggggcctgaatctgcaatgtataatgatgctagaataggtactgaaatcccgggtgggactttgtacaaacgtatacatttaaataataatacaagtgtttaa

SEQ ID NO: 335 - DNA, 1380 bp, Candida albicans
ggatttggtaaaattttaaatgatcctaatctttatactaaattgaaaaataatccaaaaacaagtgaatttatgaatgatcctcaatttgttgctaaacttgaacgtcttaaaactaatccacaattgggtaatcctgatatgtttagtgatccaagattattgacggcttttgctgctttaatgggtattgacatggatttaccaaatatgggattcactgctccaaacgaatcacaatccaatgcatcagagccaaaactggaatcaaaatcagaaccagaatctaaaccagaaccaaaagcagaacaaaaggaagaagaatcaacctcagccaaagatgaagacactccaatgactgatgcccaaaacgacactaatgataatgatgccaaaacccaagctgataatgctaaagctgaaggtaatgccttatacaagaaacgtcaatttgatgaagcaattgccgcctataataaggcttgggaattacataaggatatcacttatttaaacaatcgtgctgctgccgaatatgaaaaaggtgattatgatgctgctattgctacatgtgaaaaggccattgatgaaggtagagacatgagagctgattataaattgattgctaaatcatttgctagattaggtaatatttatttgaaaaaagatgaattacccgaagcagtgaaaaattttgaaaaatctttaactgaacatcgtacccctgatgttttaaataaattaagatcaactcaacgtgaaattaaaactagagaattaaatgcttatatagatccagaaaaggctgaagaagcaagattacaaggtaaagaatatttcaccaaaggagattggccaaatgccgttaaggcttatactgaaatgattaaaagagcaccagaagatgctagaggatattctaatcgtgctgctgcattggcaaaattgttatcatttcctgatgctatacaagattgtaataaagccattgaaaaagatccaaatttcattagagcttatattagaaaagctaatgctcaattggcaatgaaagaatatagtcatgtcatggatactttaaccgaggcaagaactaaagatgttgaattgggtggtaaatcaattcatgaaattgatgaattaatgaataaagctacttatcaaagatttcaagccattgaaggtgaaactcctgaacaaactatggaaagagtttctaaagatccagaaattgttcaaattttacaagatccagtaatgcaaggaattttagctcaagctagagaaaatcctgctgctttacaagatcatatgaaaaatcctgaagtttataaaaaaattaatatgttgattgctgctggtgttattcgtaccagataa

SEQ ID NO: 336 - DNA, 1653 bp, Candida albicans
gtctgtcccacttcagttaatactatgagaaaagaattgaaatgcattatttgggcccatgttggtctaattgtttatctattatatttatcatttgatttactttcattattaaatgatgatattttcagtgatgcattattagacgttgaaattaatcctaaccctagcacttcattaaataaaccatccattattcctaagattatccatcaaacttataaaactactgatattccagaaatttggaaaccaggtcaacaagcttgtatcaatcttcatcaagacgattatcaatatttcttatggactgatgaactggctcgtgaattcatcaataaggaattcaactggtttattgatacttgggataattataaattatccattcaacgagcagaccctatactttatttggccttgtttaattaccgtgggatctatatggatttagatgacggttgtaaacgtaaattagatccattactcacggtaccagcttttgttcgtaaaactgcccccacggggatctccaatgatgttatgggaagtgttcctaatcatcctttctttttgaaagtaattcaagatttagaaaaatatcaacgtaattggttggtgccgtacatcaccattatgatgtcaacaggtccattatttttatcgatcatgtggaaacaatataaacgttggggtgttcctgaagctgggaaagtgcggattttattaccccaaaactataaaggaactacatcttcatattttgccatagttagaggctcatcttggcatatgggtgatgctaattttattaaaagtttgggtgatcatttggtattggcagtaattggtggatttttacttggtttattgattttatttgtggaatatttgttttattcttgggtgatttcaagtcaatgcaaaagattaacgagtaaacttcttagttttacttgggccatattaatgggggttttaagatttttccatttagataaacttctatctaagtgtgatttttggagtcgttcgacaaagtatgaagaaatgcttttaccaaaagatagcaatgatttgaaaaatatcaacaacaataacaccagcaataacaacactaatggtggtgacagtaacaataatgacaagagtgactataataacaacgataataacaacaataacattaacaaccacactggtaaaactagattatcatcaattttcaatattttgggtggtaaaacaaaggttaaaagaagaaatcgtaaagattcaaacttgcctattgaaattgacgttttgagtaaacttctagatgataccgtgataatagacgcatcaactactgaaaccccaactaaccctgtttctccaactccatcaccaatttctccaaccattaattcaaggacttctaataatgaacttttaattccaaccaataataataataataataataataatgataatactaataatgttaataatattaataatagaaccacttgcgatgatcaatcaactttacttccttattcgactcggttgtcatcatcttcctcgtcgtcatcatcatctccttcatcttctacttcttcattgcctagtcatgaaactataatgaaattaaataatgatattgtttaa

SEQ ID NO: 337 - DNA, 588 bp, Candida albicans
aacaacaaccttttagagttgaagaacaaggttggggtgaatttgatataccaattgcagttcatatcttgggtattctcagggaaagctggtgaacgtaaaattcaacatgatttgaactttttacaagagaaatatgtgaatgatcatgtgatcagcattcccgtttcacctaccaggaatccagcattaaacaaattattagctgaaacaggatcattaccatttgaagaaagtggagccggtgcatcttcagccaacagtggcagtattggaacaaaaagaaaattagaatcaagtaatggagctactgctactgctgctacttctgctgataacaaatccaaaaaatccaaaggtgccatgaaaggtaatatcgatttagagaaattatcacaaggattaactaaattgagtgaagatgacttgattgttgtggttcaaatggtaaccgacaacagaaccaacgagatgaatattaaaaatgatgtagataacggtgaattcactatggatttgtatactttaccagactcgttgttgaagagtttatgggattacgtgaaaaaacactctggtgaagcttaa

SEQ ID NO: 338 - DNA, 837 bp, Candida albicans
ctaaaatactttatgtggatattgggcaaattgccaacaatccattcacagttgaaaggcttgagcatgactcatggttgtttaccatatatatacaacgtgactttggattcagttgacaatattttagaatcacctgagttagtgtggcaattgtacgaacgatacctgcaatttgttcagagttcaagattggatataactcgtgatgacgtgattacaacattcctcgaccatttgttaagaactggggatggctcttcctttccagtgacacctgcaattgagaattatagaattgcaaagaagattactaaattttattacacagttccagatatcaaaattagttcgttaaatatcgagttgttaatccaaacggcattattaatccacaaagattattcatttgcattggaaatactaaagttatccagacaacgtgggaatccattcacatttaatcaaatatacccctttatcaagtatcattacgataacaaagattattccgaggctcgagtctggtacaatgaattagttaaactgggagctggttccactggtatcatgttgagtgaactttttggaattgctaaagaattaggctggccagttaacagctgtacttacaagttcaatttaaccaaaaggaaaagacacaataaagaggcattggacgagattcaaaaggactcagcaatgtttattgaaaaatctaatattgatacaacaggtaataatcttaaagttaccactaataacgataataacgattttgaaaatgaattggcatctattttacaaagtttgaaccaaaaactggcaagttcataa

SEQ ID NO: 339 - DNA, 591 bp, Candida albicans
ggaagaaaaaaaaaaatttttcaaaaaaaaaaaatacaaaaactttcccatctcccttctaacatcaattccaattttataggtacaatgcttatctttgaagacgttatttccggtgatgaattattatctgacgcttacgacgtcaaattagttgacggtgccgtctacgaagccgactgtgctatggtcactgttggtaacggtgacattgatattggtgccaatccatctgctgaagacggtgaagaagctttggaagatggtgctgaaactgttaacaatgttgtctattctttcagattgcaaccaactatgtttgacaaaaaatcatttaccacctacatcaaaggttacatgaagagaattaaggcttacttggctgaaaacgacccagattccgttgaagcttttgaaaaaggtgctaccgcttacgttaagaaggttttgggttctttcaaagattgggaattctacactggtgaatcaatggacccagatgctatggttgtcttgttgaactacagagaagatggtactactccttacgtcgccatctggaaacatggtgtcaaagaaaacaaaatctaa

SEQ ID NO: 340 - DNA, 1074 bp, Candida albicans
  unsure (4),(49),(992),(993),(1023): Identity of nucleotide sequences at the above locations are unknown.
aganagtacccaccatatgttgatgaactttatttcaagattgcaaatntccgtgtattcactaggtgcttattttttttaaagatggtcaaggcgttgcacatgacatcattaccgctagccgatctttcgttgtttatacaacactttgtagagaaattggattttaaggataaggccaccaaagtggcgaaagatgctgtcaaattagctcatagaatggccgctgattggatacacgagggaagacgaccagcaggtattgctggtgcgtgtgtgttgttggcagcaagaatgaacaatttccgtaggagccatgccgaaattgttgccgtgtctcacgttggagaagaaacattacaaagaagattaaacgagtttaaaaaaaccaaagctggtacattgtcggtaaagtcatttagagaggttgaaaacttggaaagctctaaccctccatcatttgaaaagaaccgtgctatggaattgaaaatttccaagaaactacagcagcagcaaacagacaattttgaagacttgtcaaagatgacagaagaagaaaaacaatccgtgtttggcaaattatctaaagaggaggctcaaaaacagttgttgatgaatacaattttaagcgatatcaccattaccaccgaaaatcttaatgatcagatggatagaatcttgaaaatgaagaaatctagtttggaaaactctctttacaaaacaccatatgaattagcattagccaatggatcagagcaggacccttcaaagatttggaatattaataaaccaaagaaccttgtggcaaacttaccgaaaacagacgatattttacagaacgtttcctcagaagtggaattaaattcagatgatgacgatgagattgtcctagaaagtaaacttactgaagaagaagttgctattaaagaaagaatttggaccgggttgaaccacgattatttggttgagcaagaaaaaaagaagttgaaacnnagagcagatgaacttacggaaacacatcanaatcgtccaacggtaatcctcgtaaaagaaacagttctcattacctgctga

SEQ ID NO: 341 - DNA, 435 bp, Candida albicans
ttggaaaaaacatattcatattatgtcaatatgagcaagcctagaaaacaacaaaaatgtaaaacgtgtggtcacacacagtttgatgtcaatcggtacactgcagcaggagatgtgtcttgtcttcgatgcggaacggtgttggaagaaaaccccatagtcagtgaagtccaatttggagaatcgtcatcaggtgcagccatggtacaaggtgctatggttggagcagatcaagcaagagcaacctttgctggtgggcgtcagaatgccatggagagtagagaacagactttgagtaatggtaagcggaaaattaagagaattgcagctgctttaaagatccctgattatattgctgaggctgctggagaatggttcagattggcgttaacgttgaatttcgtcttcaccacggggctggaaggatccgcgatt

SEQ ID NO: 342 - DNA, 849 bp, Candida albicans
caacctttcaggagaatgtcctcatctaaaccagttacccctagaaatgataggagacagaatagtggaagacggcatctgcatagatcttccggaattcaattaccaagtatgtcgccaaaagtccaccattacccaatagatgcagaaaacctacctatggattcaccagaaattgtggaaaaatttgcatcacttgcagagtctatggagacattggacttgcatatgcacgatttgtgtcatattcatgatcatatatcgaatcaattcaacgaatcgtttgcaagttttctatatgggttgtcaatgacaatgtggtgtgtagacttcccaggatgtccaagtagagagcaatgggaagcactaatatcgaaaagggaaagaaaagaaagaattgaagttttaaaaaagcgtttggcagatgcccaaaaattaaatgatagactaaaattgaggttatctgacgaagctaaacaaaaaccacaacaattaacatcacagcaaagaacaacacacgggcccactagacagattaaacaacagccacgatctgtgaatttcaatacacatctgtcagatagcatatcaacaaatagttatacatcaggagacttcaacaccaatcgtcgggtgtcaagaataccacaaccatctagatcaaaccttccgtcttcgagatttcaagcaccatccaaatcaggacctaatcttaatcaaccaccaaggtatatgcgtgggttattcgatggtaataacacgttgaatacttctaattatagtcgaatcaaaaaacctatccataaccgatcagtaaataatttgcaaaatagaccaccctttagatag

SEQ ID NO: 343 - DNA, 813 bp, Candida albicans
ttggttgagttaacggcggaccgtcacatccccgtaggtgtgagactgtcatatcaacaccattaccaacaagtgcaacaaaggcaaaatcaacaaccttatatgcagtcagcacctacgtatcaacagcctcatgttcagacaccaaaatcaacacggtcaaataaacaagaaaagcaacgacttccaaaaggacaagaacaggttccaaaagcaacacgtacaatgttcgaggcattcacaggactgaacatagcggtggagaaattaagacaacgaactttggataatggaagagagccagagaggttaaggacagagtatgtaaatgtgttatcactgcctgagagagctgctgagaaatctacttcacgttctaaacaatcatcgaaccagaaaccggtagtgaagcaacaatcatctttcccccctccaataaaacaccaacaaacacaagaacaacagggaaatatattgccaccagtatcacagttattagcaatacaatcatcgacggtaacttctcgtggttccaatgccagtggtgcagtaatgggtagtggtaatacccaacgtgttgctagtagatcattcacaaatacttttgttgctgaagctgttgttaacaatgctaataatagaggtggaccagtaccaccaacaggaccagaaactaatacaagaggtggcagagctagtactagaagtagtggtagacctcggggtaatcgcagtactcaaagagctgaagggaatgtgacaggaagagtagcaagaagcactgacggttctcaaagttcaaatattggataa

SEQ ID NO: 344 - DNA, 765 bp, Candida albicans
attgaaagattttcccaccatattacactatcaatgaaagctgctgttgtcccagaatcggtaactgaaaccaaattagctgaaatcaaagaaatccctaaaccaaccattgatgacgatcaaatcttaatcaaagcagaagctggtgctattaatccaactgattggaaacatataattgtggcacgttccagtaaaccaggtgatattattggatgtgatgttagtgggattgttgaagaagttggttctaaagtaacaaattttaaaaaaggagatgctgttagtgcttatattacagggaatatttctcctattaatggtgcctttagtgaatatgttgctgcttatccccaagctacgattaaatatactaatggtttaattcattctactgctgttgcaaaagcatcgactataattaaaacttttgaaggtgcagcaagtatgactttaggattagctacagttgccatgtcattttctcatcatttaaatattagtaaacatcaacaaaagcagggtagtgatgcaattttgatttggggtggtgcaacggcaacagggattttagctattcaagttgctaaattagtttataatttaaccgtgattactaccgcatcacctaagaatcatgaatatttgaaacaattgggtgctgattatgtgttagattataatgattcaagaattgttgaaaatattagaaaaatcggtaatggtaatattaaatttggattagaaacagtttctaatgctact

SEQ ID NO: 345 - DNA, 2082 bp, Candida albicans
ttggtacgcggatcggcagttcgtggcgaatatcctcaagctcgtcaagttgaatttaatcttggtgtgggtaaaactaaaaatggttcagcaattcattctgattctgaggaggaggaagaagatgaagacccagttagtaatactaaaaaaggtgaagcagacgaaaaggatccatttgatactactgattctaaattagaaaatgaaaactcaactccatcttctattactggtaaagaaattattcctcatccaactggatttcgtggatcttcagaagaactggccattagaaggaaaccatcaattattcctatttatcatgataatatatctcaagaatcggttataagaaatgccaatactccaacaacttataatcgggaaaaattccatttacgtcgtggatcattagatgaatcaacttttattcgacccaagaaatattatattaatgatgttcaaggaactcttagagaattattagctaatgaagatactgataataattgtcaaattaccattgaagatactggccccaaagttttacgattaggtacagccaattcattaggaattaatcaatcttcaattagaggtacttaccgattaagtaatttattacaagaattaactattgctagtagatttggacgtcatcaaattgtattagatgaggcaagattaagtgaaaaccccgtggatagaatgaaacgattaatttctacatcattttggaacaatttaactagaataattactaaagaaaacattgttgacatggctaaagatacaaagattaaagaatcttggattgatgatcaaggtaaattacatgaaaatcaagaatctcatagaatttatgttccttataatcgtaaagatcaatatgaatttttccaattgattaagaagcaacgttcagatattcaattggatgtacaatatttaccacagaaaatcgatgctgattatattaaatcaatcaataaaaaacccgggttattatcaattgccactagacctgatccccaagcgcctgatagtggaagtttgattagttggccctatgttgtacctggtggtagatttaatgaattatatggatgggattcatatatggaaacattaggactattaactgatgtcaaaattgatccttcaggtaatccacgtaatttgagacatttagaattagctcgtggtatggcggagaatttcatttatgaaattcaccattatgggaaaattttaaatgctaatcgatcctattatttaggtcgatctcaaccaccatttttaactgatatggcattaagaattttcaacaagactatagaagtaaccccagaactcatggatgaagctatagattttttaaaacgggctacattagctgccattaaagaatatgaaacaatttggtgtgcccatccaagattagatgacaagacaggactttcatgttatcatccagaaggtaaagggatcccaccagaaactgaacctactcatttcaatgcattattaaaaccatatcttgccaaatataatgatattgatcaacttgatttcattgaaaaatataattccggagaaattaaagaacctgaattagatgaatatttcttacatgatagagccgttcgagaatctggtcatgatacaagttatagattagaagggaaatgtgcttatttagccactgttgatttgaattcattattatataaatatgaaaatgatattgcctttatcttacaatcatttttcaatgacaatttacaagacccatatgatgataataacagctacaaaatccatagttcgaaaatctggttagaaagaagtcatcaacggaaattaaatgttgataaatatttatggaatgaacaagatggcatttattatgattataatgttaaattacaacaacaaacaaattatgaatcagcaaccacattttggcctctttatgctaaattagcatcatcaaaccaagcagcaaaattaattgatcaatcattacataaatttgaagaacatggtggattagttgctggaacattaaaatctcgt

SEQ ID NO: 346 - DNA, 426 bp, Candida albicans
  unsure (391): Identity of nucleotide sequences at the above locations are unknown.
actctactccctcattctctcagtcacttatcatattcctatatttcattggatattcttgtttgctatagttctccctttatcatgtttacgaagaatcatagaagaatgtcatttacatcaagtgatgatgacccatttgatgttgctgaaaaatattatggtgaggaaagaaagaaaaaattgaatcgtgttagaacatttagtgcctttgaaagtactaaatatggtgctggtccaatatcacctctacgacccacttatgaaccaccaccagtgattaaagaaacttcagaaccattatcttcatcatcgtcaacatcatctccaccgactttaactcctcaaactagtcaagttcaatttaatcttggtgtggggaacagtcctntttacttcggtaggaccagccgaccgattatactc

SEQ ID NO: 347 - DNA, 276 bp, Candida albicans
gaaaaatcgatatatgatgatttactcaacaaaattaaagaattaaacttagatgatgaaacaatggaaaagattgaacaattttccgttaaaccacaaagaaaagctcctgtgacaccattagaaaaacaatgtgggaagttaactaaaaaaggagaaaaatgcaaaatagccatctgttataagaaaacatgttgggcccatctcactaaagaagaatacggagtgttgaacatgaataagaaggattgcggggagtgtatgcatattgcctaa

SEQ ID NO: 348 - DNA, 585 bp, Candida albicans
tgtttttgcaagatgaaagattcacaatctgatataattgagctttgcaataaattaaatgaagcaacaaaactaaaacgtaatgggaaatcaatcaagctcaccaattttgtcagtaacactcaaatcaaattagattcttggaaatttttggaatgggattatggcaaacgttcggttcaacttccaattcaagcgcgtggattgtttacattaaataatgatactattgccgtaagaggatacgataaatttttcaatgttgaagaaaaaccattcacaaaagaaactaatttgaaaacctctactcatggaccctatgaagtcacattaaaagaaaatggatgcattatatttatcagtggattaagtacaggagatattgtggtttgttccaagcactctacgggagacagaattgatgataatgaaagtgacaagacaacaacggcaacggcaacggcaacggcgccgaccagaaatcatgccaaacaaggggaatctgaattattacaacaatttgatggcgatcaacaaaaagttaaacaactaggtcttcaccacagggctggaagatccgcgctc

SEQ ID NO: 349 - DNA, 381 bp, Candida albicans
  unsure (248),(266),(269),(300),(316),(327),(373): Identity of nucleotide sequences at the above locations are unknown.
gtaatgaaagtagttaagatttgtggtatcaagacggtggaggcagcgagtgttgctatagacaatggagcgaatctcttagggtgtatactagttcctaatcgtgcccgtacgattgatttggaggtggcaaagcagattgctcgcatggtaaagagagataggaacccaccgccaaagtttgcgggttggtactcaacacaacactttgaacaggttgcacaatggattattgagaatggggcgtntttagttggggtgtttanganccagccaaaggaaaaagtgttttcgtatgcnaaggaggtggggctanactttatccancttcatgggactgggaaaatagctaaagtttttggggtacagaatnggggttaa

SEQ ID NO: 350 - DNA, 471 bp, Candida albicans
tccttccagcccccgtggtcgaaaacgggccgtttttacttggggtgtttacgaaccagccaaagggaacaagtgtttcgtattgcgagggaggtggggctatactttatccagctccatggactggaacataagctacagtttttgggtacagaatttgggttaattcccaggtatgttgttcctgacgagctagaccttttggaagagcacagcttgctgttaacgcaatgtgtgagtttgccgttgcttgattcggaacttgggggtgaagggaagttacttgattggacgtttattgacaagttacctacaaaagctatacttgctggtgggctaacccctgacaatttgcctacatttgacaacattttgggctacgatgttagtggcggtgttgaaaccaatggggtaaaagattcattgaaaattataaagtttatacaaaagggacacgctcagtcgtcttga

SEQ ID NO: 351 - DNA, 1083 bp, Candida albicans
gaaatttgcccaattatcaattcaaaagcatgggcattggtggttacatggtttgaacatatcttattgttagattccgataaaatgattgtgtctaatcccgatgaaatatttgagagtaaattatatcatcaatatggtatgatcaattggccagattattggaaaagaaccatatctccacttttatacgatgtggctgaaattgaagtcaatgaaaataaaagagtgagatataatagattcccattatataacgcaccatatgttcgtagtaatatttataccgatcaagaacgtgaagaagttcctttccatgacttacaaggatcaattgctgaattatctactgaatcgggtcaattgattattaacaaacacactcatgggaaaactatattattggcattatactacaatttctatggacctaatttgttttataaattgttttcattaggtgaacaaggtgaaggagataaagatacttttgttgccgccgcagttgttaccagacaagattattatcaagttaaatcatttattaaaacttttggatatgctgactctgatgataaatttcaaggtgtttctatgggacaaagaaatcctttaattgatcgtaaacattatgaagatcatgttcttgctttacttgagaaagattcattcaaatcactgtcaattgctgatcaaattgaacaaatgaagaaatttgaaaatgaagattttgatcaacataattccatcccattatttactgttcattgtaattatcctaaattggatccaaaactatatatgtcaagagatgatctttatgataagaaggagaagaaattgaagtatagattatatgggaacttgaaatacactaaagaggtagttaaagacggtgaaacaggtacagaagcgtcaacagacaaagtgcaaattgattttgaattacaacaatggcaacatatgcaagatatattgtgtttgaaaaagatttatttcactcactttattgataatgatatgaatgaattatgtcaatttatagaaaatcaagttgcttggcttagtaagtctcagaattag

SEQ ID NO: 352 - DNA, 1242 bp, Candida albicans
ccgaactatgcgatatccgtgcgctgggcagtaagaactgagtccagaatgaaatatatagatgatattaaaaatcacttgaaacaagaaataactgaacaatatagtaatgagatttttaaacaatatgccttttcatttgagatttattcgaaaaaagttgatgaatatgctttacaacttgaaaattcattaaaaccagcgtcatgtttagctatcttacaacaagcagaaaaagacacagacctgattcctgatttggaaaattatttaaccaaagcaaatgataaatatttcaaacgtcaagaatattggagatacctattgaaagatattttattaaataataaacctaaatgtgaaccattgactaaagaagaaaaaggtgaaaaacttaatccaacttatcaatgggatgccaggattatatcagaacaatatttattgggaagcaaattaactatccctggtgaaaaatttagagctcttcgtagtgcacatgatcaagttgttaaacaattgaaatcattacctgaccctccatcacaattcatatcgggtcacggtattgttgttaatggtggtggtaacatgataggatcagcattaactgcaattgccaatatgagagaacgtggatctcaattacctgttgaattaattcttgacaccaaacaggaatatgataaacaaatttgtgaagagttattaccaaagaaattaaacgggaaatgtgttattgttgaagaacaagtgggtaaagaagtatttgatattattaatgaaaaattttccaggaaaatcatgggattattagtcagtagttttgaccatattattgctatggatgctgataatcttgcgattaaaaatgttgataatttattatttactgaaccttatttatcgacgaaaatgattttatggccggatttatgggttaaattaactagtccattatactataaaattgccagaattgaaccaggagaaattgttgatagatttgggatccccaatgatgcatcatttgctgaatatatcaccaaagataaacaactggaagttcattatcatgatcttgataatttacctagtacaatttctgtggaaaccggacaaatggttttctcaaaacgtgaacatttgaaaaatttattattaccattatattataatatcaatggcaaaaaattttatattgaattactttatcaaggtgcttattgtgaaggtgaatag

SEQ ID NO: 353 - DNA, 699 bp, Candida albicans
tatagagatattcccacaatgtatataaactttttatccatccctcgaaacagattcaaagcaatcggtgtgttatccgtcacttgtatacttatatacgttatattacactcctcaatcatcactactgattttgatgtttctgattatggcgataaattcatcccatctataatatttgatgacaacaatgacaatggtgaaaatctcaaggatcctcaacctgaattggataacgataaaggaaatggcgaaactgacactacaacttcaaattccatgacaactgcacacaccttttggaagggtatttttgatacttttgataaatacaaaatggatttaggacaagacccagaaaacgcggtatcatacgtggacaaattgaaacaaaagcaaggtccgcttaataaagaagttttactttcaaaagcaattgtttctagtgaattaatgaaacatttaaaagaaaaacattccggtgtagttgaagatttaccatcagtcatgccaggttccgtatacaataaaggttctaaaggggtagttataattggtggagggaaattctcttggttagcgtatttggcattagttcaattaagaaatgtggggtcaaaattaccagtggaaatactcaggccatttagagcttcatctgctggttgtaattgtggcaagtattttgtgctgtcataa

SEQ ID NO: 354 - DNA, 1791 bp, Candida albicans
tttgttaaacagaaaataaaaatatggattggtgtgataatcgtgatagctacatatcatttcatcgtctcttcaaatgtcagaagcaaagacttgactgatttggttgatctaggttcattagataaatcaactaccgaaaatgaacgtccaaagaacaatatagtcaccaacaatagacttgataaccctcctaatgaagatattcctcatgctgaacctgattctccacctcaagtaccaccaaaaagtggaaacaaggctgactttagtatattctttgaaggtttagaaaaatttgcaattaaacagcctggaattaaagacaaatacacctcagaaaaggctaaggagaaattctcgactgacgataactttttgttcggcaaagaatacttggaaaacgttttggatatcccacaagcaactttcaaagagttaaaagatagtcataaaagatatgtcgatgaacatatccctaaaatgcttcaacgtgtgaaaactttcggtagtttagcaccatccgacaaagagtgggaatcatataggggctcctcgggttacataattgttggaggtggaagatttacttggttatcgtttttagtgattaagcaattaagagctacaggcgccaaattgcctgttgaaatgtttattgctactgaaagtgattacgaaaaagaattttgtgaaaaggttttaccaaaatataatgcaagatgtaatgtgtttgattacaaattagcagacgatttaaagaagcgttttgacattggcggttatcaatacaaaatgttggctttgcttagttccaaatttgaaaacgtcttgtacttagattctgacaatttcccaactagaaacgttgactatttgtttgaaagtgatttatacaaggaaaataatcttcttttatggccagacgcttgggccagaactacaaaccccaaatactatgaaattgctggcgttcccgttaaagaaaacaaattaagatattcaaagtatgatgaaaaacaagctggcggtaaagacaaacttaagccattgtcagaatacacattcaaagactcttggtatcatgattttgaaggtacacttcctgatcctacttcagaaactggaatgttcatgatcaacaaaagtagtcatttgaagactttattgctttgtttatactacaatgtttttggaccacaatactattacccattgttgacacagggttcagctggggaaggagataaagaaacgtttattgctgctgcacatgtaatgaaggaaccatggtaccaatgtgctcgtcaatttaaatggaccgggtatgtgtctaaagtggacaataaatttacttctaaagcattagctcattacgatcctgttcaagctcaagatactaccagacaagatgtggatataatttttatgcacctttcttatccaaagttctatccaaactggttggctgacaaccatgaccttgtatatgctgacactgatgaacatatcagaatgtacagctctatcaataagaatgtcggatatgactttgatttgagagtgatgcaatttttcaccgaaggattgtgtcctaactattatgattccaagaccggaaagccaattgaaaatattcctcatatcgattatactaatgattatatgggcaaccatttgatgtatgttaaagacgaggaacagaataatattgatagatgtaataaagtctttattcctcatttgaaatggttgaaggaaacagctgaaattcctacagtacttttttga

SEQ ID NO: 355 - DNA, 1776 bp, Candida albicans
gtaaccatgggtagcatatttaaagatggccgtagaatattagtcagaccaaaatctttaataatctgcttatgtttaatttcaataattttcactcaactcattaggtatcaataccaacttatagctgacgaggttcaaccaactattaatgaagaccattcatcgtcacagtcactaaagaacaccaaactaaattcaacgagatgctcgtcaccaatatctccaccaaaatccttaaataagctaacatcacaagagttttgggagcacatattcaatatttctgagatcaacaaattcgacgatggattaaagccattaatcaaatacacaccaaaggaacaacaactaaccaccaagataaagactcgggactggttattatcaaaagctaacatattccacaaggatataatcagacagtaccatgaatcagtattgcgcaatttacccagcaagctacctaagtcagtttacactccaaacacctatggtattgtcactattggaggcaatttctattcgtggatggcttatattcagctattacagctacgtaaattaggatctaatttacccgtggagatactcattccatccatcgaggattattataaagaagcgcatttttgcgatcatgttttacctcaatataatgcaaagtgtattctagtgccggagaaattggggtttaatgttgccaagcactggaaattttctagctaccaattcaaagctttggcactttgtttaagctcatttcaacatgttttgatattggattccgataacgtcgtcctactgaaaccggaaaaagttttcgattctcctgtttaccgtgacaatggtatggttttatggccagattattgggaaagaacaatatccccggaatggtacgacatcattggcaaacctgtagtaggtaataagcaagtgagaactggccgttttcctgttaatatacacaatatgttaaccagcgagcttgagattaatgaaactagattccacgatcttgaaggtgctttacctgatttgtcgactgagtctggtcaagttatgtttaataaaaagactcacgggaaagtcatgttgatgactttgtattataatatttttggtcccgagatttattataaactatttagcttgggagcattgggtgaaggtgataaagatacttttgctgctgcggctcttgcttgtggagagaaatactatcaagtggcatcatctattaggacattgggatactttgacactactcctggtggtggattccatggaatggccatggcacaaaaaaatcctcaattggattatcagctatttcagaaaactaatcaaaatttcaaagatttgcatttggattgggataatgaagctaaagatcaattcagtgccaacaataaaatccctattttcactatgcattgtaatattaaaaagattaacccagcagcatatatgaaagatgaaaaaattgctaatatggatgaaaaaagaatgaatgtcagattttattcaaatttgaaatttaagttgaatgatgatgatatctatagtcctgataatgaaaaagagaaaaacaaatctgaaaaaacagataatgaccccaatgagattgattttgaattatcgagatggcagattgtttatgagattctttgtgaccaaaaaataacatttcaattcttgaaagatgacaatatggatgaagtgtgtcaatttgttaaaaataccattgcatggttagggaaaaagacataa

SEQ ID NO: 356 - DNA, 504 bp, Candida albicans
  unsure (5): Identity of nucleotide sequences at the above locations are unknown.
atgtntgagcaaaaaaggatacaacaaggatacgaatttttcgacaatatttttaaaatattttatcaagccaaacccagtgtgtcacaattaaacacttatccttctaagaaaagaatatatcatgctcgatttgattcattagccgatgacgatactatattcagtgagaaatatttatcccagtttttacaattgagtaacgaagaattggccgccatgaaaaaatctcacaaatacgttgttgagaatttaccggaagatgcccccgatggattatacaagaagaatgggatagtttacgttgctggtggaagtttcaattggcttacattattatcaataaagtcattacgtgcagttggatgtcatttgcctattgaagtattcattcctaaaatagaagagtatgaatctgatttgtgtaatagaatattaccggaattagacgcccgttgtatatatatgaaaaatcaattaatgaaccccaacaaagataatctg

SEQ ID NO: 357 - DNA, 1965 bp, Candida albicans
  unsure (1954): Identity of nucleotide sequences at the above locations are unknown.
tcatctagtatgtcgtcatcgtctcaacgacaagctaatagctattcacgaagagcacctttccatgatgatactaacaatcaatcatcattccgaaaccagcccaatagaaatgagccaccattgaatcgcggacgaggctataatgaacatcaaggtagaagaagtgatgcaatgccaaacagaggggatcctagacgcccagacaatcgcaatgacggctataatgatagaagagatgatggaagaggcgacaagaataagaggtttcaacacccagggcgatctgaggaacaaccaaaatattttggacggggtaatcgagaatcgtcacaacaccaatcacctcagtcgctgagacattccgggagagaagggcaagggcaagggcaagggccagacagaaatagaaacgatcaaagatatgaccccagacgcaatgacggtagaacaggtaataatccaccacactataaaccaaacagatcaaatgatgtcccaattgcgaatcgaggtacgaaaagatcaaatcaagagcatgacgcagggccttttaaacaaccaagactttctgatgagtatactcaaagatcacagcaacaacaattttcttcccgtaaaccttacaacaataaaccagatcaaaagaatggttccaatcgcaaatccgactcgaaattttctcaacccaaatttcaaaaatcacgttcgtcttttcaaaaccgaggcagaggtaatgattgggatcgttctggagaggcatatacaccatcatccaaaagaagtgacaatccaaatttttctgggcagcgtaaatttgaaccgcaatcaagcttagcaagagcacgtactatttcagttgctaaacctaaactgataaatgaaattttaaaagagatcgaccgtttgcaaaaccgtgtacaagaccttcagtctgttcaaccaatagaagaagtcaaagttattgattcaagatggaataaagtccctgaaggatttgagaatttgtctgctgccagagcaaagttgtcagggttgtttccacttccaggatacccacgtccaattgatttcaccaaattagaaggtacaattaaaaatagattgaataattccgatgatattttgaatgaaacttctaggattgatcccgttgattcgaaagccgccagaacgttgattgtcaaaaatgatttatcacaaataagtcacttgaagcttgttgagtttttcaatgattatttgaaagctatagattttgaaaaagggtcttccaataacattaagaagcagaaaaaagctcaggacaataaatttatgataattgaatttaacaatgcagaatgtgcaactatcatatactccttgaatgaaacggaattattgtttaatgcttacaaagaagaaaaggttcctgcacgacaaatggagaaatttaagttattgattgctagacctagtgagtacgtagttcaagatttggagcctgttaaatcagatgagattgaagaagttgtgagagataattcaagaaaaatttccttgacgattgtacctaacgcaacaccgagcaaagttattgaatcattagaaaagaatgttggcgcattgcaaggaattcagtttttaagacaaaagggaactaagaatttgcttggattggtatttgttgaattcaaagactcctctaatgatgtgattggcaaattgaggagattgccatttataactcgtgcgttccattcatgtatcttgcctaataagacgccaattcaaaagggccctatcgatttccatagtttgaaaaacttggtggaaaataagaatgtggcgccacatccgctgctgagagttattagattgttaaatgcagtcactgaatcagaattagcagatgatgccacctacagttttatcgtcttcaccagccggtggcaaatgaccgtcgcggganggattctgcgc

SEQ ID NO: 358 - DNA, 852 bp, Candida albicans
tttattttctttttctttgaatttttgcagaaacgttatcaacatattcacaacccctcacaacccccgcgcctctcgatcataatgtcagctattcaaaagactttaaaacgaatggttcgtaaatggaccacaaaagatggacttctaggagattatgattataaatatttatttactccagatattccttttataactaaagaacttaaaactcaaccatttttcggagttgattccgatatgccaatattattaggagcaatattaggttttcaacatgcattagccatgttagctgggattgttactgtaccgattatggttgcctctacggccaatttatcagttgaaatcgaacaatatttagttagtacatcattgattgttagtggagtgttatcattaattcaaatcacaagatttcatattcctaaaactccttattatataggaacaggtttattatccgttgtggggacatcatttgccactattactattgtcactaaggcattcccaatgatgtatgccgatggaacttgtcctatggccagtgatggtgtcactaaattaccgtgtcccgatggatatgggaaaattttggctagtgcttgttgttgtgcattattagaaatcttattatcatttatgaaaccatcaatgttgcaaaaaattttcccaccattggttactggacccgtggttatgttgattggagttcatttagtagaaagtggattcactgattgggttggtggtgccggttgtcaaaattctgatacttgtacttatgggacttttctgcaccttgtgatgaatcttggcgcacagggcaagaatatccgagtt

SEQ ID NO: 359 - DNA, 1269 bp, Candida albicans
aaaccaagaaaagtgaacggcaaacacgataatcagaactcgaactcaattgattctgggtctaaaagaagtttcaacaatatgataacaaataataacaatagtgataataatactagttcggtggatccatcaataaatgttgaggagttaccggattccaaaaaacaattgactgaagatgcgattgatcctacgcaacaacaagaacaacaaccccaattaatggaaatagatgttgaaaccaatcaaattataaatgaaaatggatttgaaaaccatggtgtagccagtcctgaagtgattgatatgacaggtgatgacgactatgatgttgacaaccacaacaataacaatcacaaccaccacaacaatatcaccattgaagatgatgacgataatgtggttgatgatggtgacgacgaggaagacgacgacgacgacgacgatgatgatgatgatgatgacgatgaaatacaaataattaattcagaacctaatagcaatgtcgttgctccaaaaaagtttactcgtaatttcccactagctaatgattttaacgctcttgcagccaaactaatgaaacctattgaagactatcccacaaaagaagaaacctattatgtttgggaaataaaggattgggcacaacttttaaaggaagaaaaagtccgatcaccaaaatttaaatgtgggggatttgaatggaatattttattgtttcctcgtggtaactcacaaaataaaagtctatcaatatatatggaacctcatccaccagttgatgaaaatgataaaccattagatgaaaattggtatgtttgtgctcaatttggattggatatttggaatccagctcacccagatgctcatttaccaaatcaaagtcatcatcgatttactaaaaatgaaactgattgggggtttagttcattaatagaattgagacaattagaacaagtcaataatccaagaaatcaatcgtcaatgtatgccattttggaaaataataaattaaatatcactgggtttgttcgagttatagatgattcttctaccggggtattatggcattcatttttagattatgattctaaggcaaatactggatacgttggtttaaataatcaaggagctacatgttatttgaattcattattacaaagttatttcacaactaaattatttagaaaattagtgtacgaaatccccaccgatctgaaatctgcaggagtacctttgtcattacaaagaattttctatttgttg

SEQ ID NO: 360 - DNA, 1866 bp, Candida albicans
  unsure (4): Identity of nucleotide sequences at the above locations are unknown.
gganagatagtacatttactcaattggttgaagcagtgggcaaaaccaattaaatgtactaatgagaaattatttagattagttgccgtttgtcatagaaataaccataccaatagattggatgctcccattggtgaagaatttcaaaaatcaacgataagtaatgtttattcgaaaatatttaatcgaaaatatgatgaaatggttttttatgttgaggaattgaataaagacattaagaatgttgttcaattggtgaaaaataaggataatggttacattgaacgtaaagattttacatttgcacaagtgtttagtaaaattgatgctgttggtactgatattcatccgaatattgaatttaaaaataccgaagagtattctaattatgttactatagttatcaaatattttgatcctgtatcacaagaaattagaggattatcacatattactgtggccaaagaagataagattgattcaattatagacccaatccgtgaattacttggatttaacaaaaatatcactttagaattgtatgaagaattatcacaatcaaaagttgaaaagattgattctaaattaacttttgaaaaacatgaattgaatactggtgatatcattactgttcaaattgtcaatccaggtgaaatcaataaaaatggtaaatttaaagatttgaaagactattataaatttttattaactagattgcatgttaatgtcagaccatttaaggcagaaattgatgaagaagattctgatttcatagctcatgaagacgatgaagatgaagatgaagaaaataaaggaggtgaaactaacaatggcactggttatggtggtaagggaaatggaaaagatactgaaaaagataataaagctacaaatgatgaaattcaattggctaaaaatttgagtaaaagttttgatttttggatttcgacaaattatagttatcaagatttagcaagagatattgctgttaaattaaattgtgatcctttatatttaaaaatatttatattaactgctcaaggtcaacgattcccattaaagacaagtcatcatttatctcaattattccccaagacggtatcagtcaatcaaattgttgaaattgaatatgaaatacttaatattccattaaaagattatgagaatttgaaagccattaaaatccattggttaacgacattattacaatatcaagtatttgaagttttagttcctaaacgtggaactataggtgatgttattactaaagttttacacaaggttaatgtatcggaatcggatttacctcatttatttgtttggtcaggacgaaatcataaatttcatgagatgcttaaatttgatagggcattaagtacaatttctgatgatgttgatttattttgtgggattttcccagctgaagttgaagtattatgtgatcatgatatgtataaaagatttactgataaagaaattgatgaaacaaaattggaagaatcaattcatgaagaatatttagaaagtattagatggagtaaaaaattaaatcttttaccagcatttcattttcataaaaataataattatcatcatggaattccatttatttttatagttttcccggctgaaacgttaaatgatacgaaagaacgattaaggaaaaaattaagattaggaaaacaagcatttgataaagttagacttgcattagctgataataataatagaatcaaatatttggaagatgattcattggtattgtttgatgaagttgccattaaactgtatagtttggctattgataatgttgatagaaatcctaaacgtcaagcattatttgaaaaagggatttccatcaaataa

SEQ ID NO: 361 - DNA, 465 bp, Candida albicans
agacaaggtagtatttccaatggtcattattatgccatgatcaaaccaaatgctaatgatgatacttggttaagattcgatgacgataaagtttggaaagttaataaaactcaagttttccaagagaattttggtgctactgatttgacacaagaacaatcacaacaaatgacaagagctgaacaacaagaacatatggtgagaagagtaacgtcggcatatatgttggtttattatcgtgaatctgaattagacaaaattttaccaagtgatgataacattgtcaattctgccattcctgaacatatccccaaacaaattcaatttgaaattgaggaacgtgaaaaattggaaaaggcaagacaagaagccttgtattatacaactgccaaattgataacttcatccacattcaatgccaatcttggatttgatcttgccttggatccaacgaataataaattt

SEQ ID NO: 362 - DNA, 753 bp, Candida albicans
ccggattccaaaaaacaattgactgaagatgcggttgatcttacgccacaacaagaacaacaaccccaattaatggaaatagatgttgaaaccaatcaaattataaatgaaaatggatttgaaaaccatggtgtagccagtcctgaagtgattgatatgacaggtgatgacgactatgatgttgacaaccacaacaataacaatcacaaccaccacaacaatatcaccattgaagatgatgacgataatgtggttgatgatggtgacgacgaggaagacgacgacgacgacgacgacgatgatgatgacgatgaaatacaaataattaattcagaacctaatagcaatgtcgttgctccaaaaaagtttactcgtaatttcccactagctaatgattttaacgctcttgcagccaaactaatgaaacccattgaagactatcccacaaaagaagaaacctattatgtttgggaaataaaggattgggcacaacttttaaaggaagaaaaagtccgatcaccaaaatttaaatgtgggggatttgaatggaatattttattatttcctcgtggtaactcacaaaataataatctatcaatatatatggaacctcatccaccagttgatgaaaatgataaaccattagatgaaaattggtatgtttgtgctcaatttggattggatatttggaatccagctcacccagatggtgcccttccatattcgccacgaggactatatccgacagatacc

SEQ ID NO: 363 - DNA, 600 bp, Candida albicans
ttgcggaccttccaggccgtggtgaacactgatccggtggggacgttagaattgacaaaatcatttggttgggactcgtcagatgcattcacccaacatgatgtacaagaattgaatcgtattttgatggataaattagaaactgctatgaaagggtcgaaaattgaaggtgcattaaacgatatatttgtggggaaaatgaaatcttatattaaatgtgtaaatgttccctatgagtcgtcacgggtggaacatttttgggacattcaattgaatgttaaaggtttccaaactctcaaacaatcatttcaaaattatattgaaattgaaatgttggaaggtgaaaataaataccaagcaggtgaagaacatgggtatcaagatgccaaaaagggggttgtatttgaatcattcccaccagtattgcatttacaattgaaacgtttcgaatatgattttatggttgatgatttagttaaaattgatgatttttatgaattccccgataaaattgatttgaaaccataccttgatgaagatttaccagaagatgtgaaaaaccaaaattggaattataaattgcatggtgtgttggtgcat

SEQ ID NO: 364 - DNA, 600 bp, Candida albicans
ataaaaagaaaatcaaatcaaataataacggcgacaacattactaatgatagcaataaagatgataccacatccactactgccacttccacttccacctccacctccgacccaatcttcaatagtaataaatttttctgttgaaaaatctattaatgattttttcagtaatgaagtaatcaaaaaactggaaaatgatagtaaatcaggttatttctgtgagaaatgtaatcgattcactcatgccaataaaatatcttccattgaaattgctcctgaaactttaaccattcatttcaaacgttttaaattcaacaacaattcttcatccaaagtcaaacagctgataaattatagtaaataccttgatttaagcaaatatatggtacaaggcacagctaaatatcgtttgacatcagttattgttcatgaaggaagatcaatttctagtggacattatgttgctcattgtttacaacctgatggatatacttggtgtacttatgatgatgaatacattaataaaattgaggaaagagtggcattaaatgatccttctgcttatgtgttggtatatactaaattaaccccaaaagtttag

SEQ ID NO: 365 - DNA, 708 bp, Candida albicans
tatgaagatgatcgtgggtctaataattctggtagaatatacaaaaattggagagaactcgctaacaagaaacctccagttggattattgaatcatggtgtcacttgttacatgaattcggcaattcaatcaattattcatataccggcaatgcaacattatttaaatgatgtgaatgataataaatattctcaacttaaaccaagatcagtgacccatgttttagctgaattatctaaaagaatgtggttagcatcaaatactaacaacaataaaaagggtaaaagtaatggtggaatcaaatatattaatccgaaaaaaatcattcaaagattggatgaaattaattgcatgatgagtgaatggcaacaagaagattctcatgaatattacatgtcattaatctctagactacaagaagattctacaccaaaggggaaaaaattgaatgaatcgattatttatgatatctttggtggattattgaatcagcgtattacgtgtcataaatgtcataatgtttcaatcaccaagcaagaattttatgatttatcattagggttaaataaaaagaaaatcaaatcaaataataacggcgacaacattactaatgatagcaataaagatgataccacatccactactgccacttccacttccacctccacctccgacccaatcttcaatagtaataaatttttctgttga

SEQ ID NO: 366 - DNA, 228 bp, Candida albicans
tacgttaaaggtccagcttacaaagctttgagtcattttggtaaattaaatgctccattagtcagatcttacattccaaatttggttttctggggagctgccgctggtggtgccgttgctacttttactgaaggtgttccattattccaaaagactttttatgaaaaaatcccatttttcggtcaacattggatttataacccagatccagaagatgttccagtataa

SEQ ID NO: 367 - DNA, 798 bp, Candida albicans
tcgatgtcacgaaataaagaaaaggctcaatcgagtttaaatagattttatcaatcacaatcatcagcaccaatcaattatcattatcatcaacgaccgaaaaacattcattcaatcactcaattatcacaagcagaaggttggcgacgatcaataattggagaaatttctaaacaattgacggaaatcaatgattttgaaatatcagatattaaagtccgagaattgaatgatcaattgaatgaattatttaatgagaaaagacgatgggaatatcatatacgagataaattacatggtaatgattatattcgacataatggtaatactaagaatgatttgataaatactggtattagagtgaataatctggataaagggaaatattatcgatattttggtagagctaaagatttaccggaagtgaagttgatgattgaagagaataagaaaaataggcaaaatcataaacgtgatgatattgatgacctggatcaaagcaaaagacgaagaaaagtagatcaatataagagtacggacaatctgatagatatgaattattatggattttatgatgaagaagaggatgaatatttagatgatagtgaggctcaactaggcgatcctttggtggtatatgaagagaagagaactaaagaattgaatgatgcagaaatacaacaacaggataccgaaaaccttgaacaaattcgaatgagtttcaatgatatacctacaaatgaagttgtgactaaatggttcttcaccacgcggctggaagcaaccgagcttgcgtca

SEQ ID NO: 368 - DNA, 942 bp, Candida albicans
actcggataccatttttcagggagaagggtgtaattgaattgaacaccacgggtatgacttggctacaactgtactgtcctcgattcgatactttagagaaattagcacatcttccccgcctatcaacatcattaaaattgaattttacggcagagtataatgcgtacatgacaaacttaatatcgaaccccttgtcatggatcacgaatgaaaagcatattgataccatccaaaaacttgcttgcttgcgtataagtgagaattgtggtcgaactgcacaaccagaaattatcagaaaaattgtgttaccaaatcttgaccaatggatgaagaccaaaacaggccatttgaaattacgcgagccttccctaaccaatgacaatttagggttgaaaacttggggatcagcattgattttgagtcaacgattattagttcttgatcatacgaaatacttgtataaaagcgtgttagaattaggatccggaactggtctagtggggatggttagttcattattagggtaccccactgtattgacagatttaccagaaattgtacctaatttacaactgaatgttgatttaaacaagctaaacaatgtaacagttctggaattagattggacaaatcccctgtcattcctccaaacatttccggatgctaaatatcaaacaatagtagtcagtgatcctgtttattcttccaagcatccttatttggtagtagacatgataaatttattttttgacaaatctgatcctatgacccgagttttagtacaaatacctttacgtcctaagtttgaaaatgaacgtcaagttctatgggatttaatggaggctaacctgtatcttgagactgagcacgaaatagaggaaggatttgatgattttggtgaaatgaaattctgttttaaggttttcaaaaaacaaaactga

SEQ ID NO: 369 - DNA, 1782 bp, Candida albicans
gatcaaacaactaacaatatatcagaatataaacatttatcaccagaaacaaattataccgtgggacgtgatgaaaatactgatataaaattttggtcacctaaagtatcaagagaattaattgaattaataactggacccaacatagacaatacccaaccaccatcatcgtcatcgtcttcttcttcaatgggtagtgataaaacattattaatcattagaatatgtagtcgagcgaaaacgattataaatgggaaaacatataaattattatcaaaagatagtaaaccagaagaaattgatttcactaatgaattcaaattgaaaattgaaactattccacaaattgataaacaaacgggacaaataataactcaagatactccattgttcattgaatggatcccctttaaattatatattagtgcaaatgagaaatatgatcaaaatcattacaaaacaataataagagatcatggtattgatattcaaattgttgatgatataatggatgccactcattattattatgatagtgataatggtaacaaccatatcaagctggaagaacaaaaaaatgaatttaaattggcaattattaagggtatcccaattttaaattcacaatggttacagaaggtattaggtcatgataatgaggatgggtataatagtgttaaggattggcttttggatatagattacaagaaatacttaccaaaaaatgatgatgattatttaccgaaaagtgatagattaaagccattaaataatgttaaattagtatcattggagaaaatgcattggttggaaacaataattatagattttaaagtgttaatacaacaacaagaagacgtattgaaatcgaaaataggtgataatcaattcattttaattgttccaactacaatggcaacaactttgaatagacataatttccaaactctaacagaagatcaattatggcaatcaattaaaaagggttcaatactggatctccctaaaaattcttttaatcaattgaaacgtacctcaacaactatgttagcatcagatgataaatcagttacaacacaaacgcctgaggtggcggcaccttcagggagaaagagaaggaaatatgaaaaagttgatagattacatttcttctccttaggtacgacaacaccaacaactacaactacaccagtaccatctacacgtgatccatcccctaaagtatcaatcttggacactgacaataaaagcacatcaccagaattaaatagtcagaaaattaataccagtggtgataatgattcaataactcaagaaataacacaattaagtgatcccattaaaaaaatttcaacgataaagcaaaatcaaaaagtgttgaattctcatacgcaaagtcgtaaaatcaaccaagaagatgcacttaatagtttgggtgattcgaatttatcatcatcaactgatcaattagcaaggaaatctaaaccagattccaattcacaaaagtctagttccaattttccatcaattaaaaatgaagaagaagaacgagaagacgaagaagaatttcctgcaatcggatcaaaacgtaagaataaagatgaaactactaatgatgatcaaaaaccatttaaaattccaaaatttacaccaaaagtatcattagtagatgcagttttaaaagttccagaattgaataaatcatcaaatttagatttggaatctgaattgaaattaatgaaaatttacaaaatttggcaattgtggaaattgttgatttag

SEQ ID NO: 370 - DNA, 1743 bp, Candida albicans
gctgcttcgagactgatgacgaatccggccgaaaatgaccatgagccaagaacgaaaaagtcaagattaaatggtcgaaacaatgtgtcacagcttgaagcgaattcgaattatgatttgttagctcaacaacgacagcattcacaaccaccatcgctactaccctcaccgtcccccaactctgaccattctcatcaatcacaacaattcatggatcaccgacgtcgaaagagacgccaactgccacaagaacaacagcaagaacaagaccagcaagagcaaccacaacaagcaccaccaccaccgtcacaacaacaacaacagacaagattacaagatgatcagaattcagaaaatgcacatagaaacaaccaggaacattacattcaacatgggaattcaaatgttagaaatgagactcaactacttcaagaacaacagaaacaactacaaaaatcaaaacaacaaccaacaggtacagatactgttcctagaaatcagtttagaccacaacaaggtctcagttttagtcacagtaattccccgattatgggctttgggatggataaacacaatctgcaattacaaacccaatatcaaaagagtcatcgccatggggtcaatcaaacgaattcaatttcaggagatatacaaaatcctagtcctgaacaagattttagaaatagtttgataaacaacaatggaaataataacaccgtcaattatagtcccaatcaactttataaagaacaaagacaattattgaatgatgattattcatcaacaataaccaaatctaacgattcaagaggttccagagcaatttccactaatgatggcaccgaaacagaagtcagtacaaaccaggcattattaactggtagaatgccagaagaagaaaccaaggccgccagtgaattaaataatatcatccatccaatcaccgcaacggatatggagaggtttatctatatgtttgctgatagatttttccatatacatcaacatgagtatccacaaacagtaaaagttttccaagaattcaaactgtcattttttaacgaaaggattatgaataatagaacaccaaagcaactacagcagcaggcaactatctctcaacattcgcaactgcaacaatcacaattacaacagccccaacaactatcgccttctatgcagccaacacaacaaatacaacaaccaatgatttaccatcacaatagtagtcgtcagcaacaacagcaacataatagaaatgcaatgtcttcgcaattaccagctcttgttgctgcaactactagtttggtcaataataatacaccaaatatgtcgcaaaagaatgctaattctaccatggtcttgaacacacattcaaatacacaccaaagacaacaacaacaacaacagcagcagcagcaacagcatcacgaacatcaacaaccaccaactttacctgctccattgcagaaaattgacaattcaaagaatcaacaattagtaatgtcgccatctccaatggatacattagtacaacttcaattacgtcaacaaggcacacaaagtagcttacaacagcaacaacagcaacagcagcaacaacaacaacaaatttcaaattttgatgattatttacggtcaatgaatgcacaaactttgttaaatgcccaatcaaattttacaagaaataatgggctaaatgaagtgaatctagatagaaatcaaaggatgtcaaaaccatga

SEQ ID NO: 371 - DNA, 1752 bp, Candida albicans
ctggtaatagtcatgtcggattctgaagattctgaagatctaaacgaatatactattgaggattactacaagatcgttagacctcttctagcggcaaacaatatcaatgcaaactacttggacaatcacaaactactacgaactttggtcgattttagtttatcgcactcattgtccttaaaaaatttacaaaaacgagagttggagtttcgaaatttaatcccgaaaaagataaactatgtcgacagtctaataattgaaaccaagtctgccagtggaactcaatatactgggtgttttcgaaaccggtgcatagagttttgtccccactttgccatcgctgcgtacttattcagccgtttccatatccctgatgaatatggagcatacgaatttacgtccacagagtcgataaaaaaggtatcgttggaacatgtcatgttgttgaaaggtaattccaagcaccaggcaatatcttatagtcagcaacacaagtcagcagtcaatgcgttgagtgtaagtggcttggactataaggatgtgaatttgggcaaacttttggccacacataagaacaacgaagcactagagagtatgggcagattgtccaagaattcaatcagggcactatctcgtccattaatgttggcattagctggctttgatagttttgaagattatgacatcatcagaaattcaattgagccaccacaacaattactagataagatatttccctttttaactgatatcatcgatgagtctactcgttcaaaagagttgttgcaaataaaagagttgtttttaatgttaagacggagtctctgtcaggatatggtgatcatcaagaaaatatacccctctaatccattatcaagaagtgaaatatttaattcccccgagtttttgaattttgctcaatcaattgacaatgaaaggttgaacacaatcattaataaatcctgctttatccccaatgaggataacattatttgtgatgacaatgaaggttctctgcgtgttggttccagtgacaacacaaactccaagtctgcctcgaaggaattgaaattgaagaccttgaacaagcaaatgaatttggttttacggcaacaacaggagattaatcaagcaatatacaaatttaccaaatctcaaacggaaatttttcaaaaacaaaacgagcttattcaaaaagtcaaccaatcattgaatggagtcttgattttactatcagctcaaaacaaaacatccatccctttggtccaacaagcagctcaagaaacccaaaactatctttcaaccgtgggacaatcgaatattgaacgaggaattaataacactttcgagttgttgaatgtcttaaattcaaattctggacactctcagccacaatcatcagttccaccatttacacaacaaccacaaccattaccaccttcattatcaaatttactacaccccgaaaccctgaatattcctcaggctccagtttcagaaccaccacgtgtcatacctacacaacaacaggcaatgcccttgcaacaacaactacaatatccacatccacaacagttttatatgcaaccatcacattcacctccaactcatcaatcggcaggtatgatgccaatggcaccatatggcacggcaccagcaatgggtccagtgccagtgccaggacaaccacaaccctcgtctagcacagacgcctcacaaaacccggaacgtcaacgtgtcttacatagatga

SEQ ID NO: 372 - DNA, 813 bp, Candida albicans
tattattcctactttagccgttcattattcaactcaagtcgttcctttaacaatatcaacatgaagatttccaacttaattccagcttatttgttaccattttccttattttgtcaagttttaggtgctcccactaatggtaaacgtggtaacgttgttgttgtcaaagtgaaaacaactgtgcaacaaacccaaactgatattcaaaccatcagtgaagcaacgggtacaacaacaaactatttgataaataccagtactgaaacctttaccaggtatactgctactgtcacttctaccgtttatggagttcctcatacttataccacagttgctactacaccagtttctgcagctgatgttattcctaatagcgaaaatgaagttaagtcctcccctacagaaagtcccgtggaacaagaaacttcaacttcttccacctctgtcgctactaccacaactcctgttgctaagaacccggtttcatcacaagaaacttctaccccaaccccagttccacctgaaacaacatcaacttctagctctttgctatcatcttcacaacaaactacaactttagctcaagtttcggaaactgctattaatgatactacagaaagtagtgggcctacaattactggttcggtgagctcacaaacaactgattcatggataattgaaaacatatccactgtcacttctgatggcacttgttttgtcaattatgattactactatgccactgaaactgatgatgcagaagaaaccactacattaacttcaacaatcactacaactgtcactctcaattga

SEQ ID NO: 373 - DNA, 369 bp, Candida albicans
ttcaccaaatactccaaccacttcagaagcagcaccaactacttcagcagcaccaaccacatcagaggctccagttactccaagtacttcagaagtagtaccaaatacaccaaccacatcagaagcaccaaatacaccaaccacatcagaggctccagttactccaagtacttcagaagtagtaccaaatacaccaaccacttcaaaagcaccaaatacaccaaccacctcagaagcaccagctacaccaaccacttcagaagcaccaaacactccaaccacctcagaggctccggttactccaaccacctcagaagtagtaccaaccacttcaactcaaggagatgctgtatcaacttcatcaactag

SEQ ID NO: 374 - DNA, 414 bp, Candida albicans
agcttgacacaccaacactctccatcagaagtgcttaacaagtgcaatcccgttccccaattattatccataatgtcatctggtatccaatcattattgaaaaccgaaaaagaagctgcagaaattgttaatgaagctagaaaatatagaaccacacgtttgaagtctgcaaaacaagatgctcaagctgaaattgataactataaaaagcaaaaggaagaagaattaaaaaattttgaaaaagaacacgaagggttaaatgaaaagatcgataaagaagctgatgctgaagttgaaaaggaattgaccagtatcaaatccacttttgaaaagaaaaagagtgcagttgttaaattgttagttgacgctactgtcaagccaacaccaactttacacataaatgcatctcaataa

SEQ ID NO: 375 - DNA, 231 bp, Candida albicans
  unsure (26): Identity of nucleotide sequences at the above locations are unknown.
aaccaaaacaacaggcagaacaattncacatgtccgaatttaggtagaaaagatattggggtaaaaatcgaatccatattcactcccagattctcaaaaatccactccagaacaattcaaaggataaggttactgactctcttgagcagtgctgctggtaaagctatttctgaaaacgacaaatcatttgtccaaaaagcttctgatgctatttttggtgactccaaataa

SEQ ID NO: 376 - DNA, 570 bp, Candida albicans
cttttgttaacctatacacagattgaatattacactttgttcttcaaacctcatctgtttcatcatttaatcatcgttgttgatagaaaaaaaaaaaaacacaaccaaactaaaaaaaagatagccatacattcatacctattcatcatgtctacatctacttcatctcagcaacaaccacaggacattataactcaagtttcaccacatcaacaagattcatttaatactactacaaccacacacacaactggtactgatgatcaatccgatgttggtggtggtggtgattataattctattattcatttaaatattcgaggtaaagaatttactattactcgagatgatttaatgagtttacctgaaagtatattattatgtttatttcccaatggagtatttcttgatgttaatggtaatgtaataaataatttaactgaaaaagatatggtttatgtgaattttgatcctcaaacatttcaatatattattaatactttttatcaagctcaacaagatttaattcaaatgttcaccagttcgaaaaatttaaattccgtgaactaa

SEQ ID NO: 377 - DNA, 1227 bp, Candida albicans
ttctggtgtttcaactgtttcagcaaaattcccgtaacttcggggttggaatggaatggtaatagcagtgcaagtaatgggtccaatataatacaacaacaacagcagcagcagcagcagcagcaaccaccaccgccacaacaacaacaaccacaacagatacaacctgatcgtcgaagaacttcatcatcagcattttttaatgttgcacctgcattgcatactatgacttcgaatcaaaatataccaaatacacatttgggtccaactgctgctggattaagagcaattttacaacaacctgaaaaccaaccccaactgcatgattcccaacttcaagctcattctcaactgcaactacagtctcaactacaaagtaagactcaacctcaacctccactgcaaccccaatctcaatcgcaacttcatattcaacaatcacaggcacaacagcatcatcaacaacaacaacaacaacaacaacaaccaaacacacaatctcaaattgcaccccaaacatcgaatactagttcaattacgaacgagtttcatgccccacctaatatatcacaacaatctattacttctaatcagaatacaacatcaacttccacatcaactccaactcaacaagccattacgagcccgcttgataaagggtctacttcatcaaaagatgttcctgatttatcattattggcaagagtcccacctccagcaaaccctgctgatcagaatccgccatgtaatactttatatgttggtaatttgccacccgatgccactgaatctgaacttcgaactttattttctccacaaaaagggtttagaagactttcatttagaaccaagaatcaatcttcttctaataatgggactggcagtggcggtggtagtggtggcggtggtggtcatagtcatggaccaatgtgttttgttgaatttgaagatgttgctcatgcaacaagagcgttggcagaattgtatggtagagcattaccaagaccaaatggtggtaatgggaaaggtggtattcgattatcattttctaagaatccattaggagtaagaggtccaggaaattctagaagaacatctactaaccctgcacctaatgggttatcacaatctcaacaacaacaactgctgcaactgcaactgcaactgcaacaacaaggaagtagtggtggtgggaattatggatactcaaattatcatcagaaatga

SEQ ID NO: 378 - DNA, 921 bp, Candida albicans
  unsure (27),(28): Identity of nucleotide sequences at the above locations are unknown.
aagttgggtctccttatccgcctggtnngacagataatcaaaggatgggacaatgtgtcctcaaagttgccaatatgcaatttagcaacgttggatgccatattgacgcacttgagcagattagtgagtattgttggtactcaagacaaagatttggcaggtggatttcaacgcaaattgagcaaggagtttggatctttggttttgagaccaaaaactgatggtttgaacagttccgaaaccagttacttgaacgatagattccaggtcatgttaatggatgacttattcgagaacaagcaaagtatatttaatgagttgagaagacaaagttccaccaggtcagccgtggccagtgtgtcgccaagtgtttctcgaaacagcagttttacacgcagtgaatcgatcaagtcaaacaagggacacaatgcagcagcgattgcaaagtcgaaatcgaggctggaatccaggttacaaagtgcggtgaagaatcaaactaaaacactggagccgcaacagaaaacagatgctgatgaattttatgatgcagaagcgtcgccaaccccttcaagactgggcactcagtcgtcatcactggaattgaaaagatcaacatctcccaagaagaagaaatggaccgttgtatccaaggtagagagtatagaagggaacgaaaaatcaaagaaaattatatccacgccagttacttaccgtccttcaaacgatattatttacgataaatcacccagcaaccagtcattgaatgatctttcatcaacaccaccacataaatttgcacctagtttgggcagaaaatcgtcagttaaagactgggccaagagttttgaaaatgggtcaactgaagatttgcaagaaccatcatctcgttcaagatcatcatccccaacaaaggcaaagtga

SEQ ID NO: 379 - DNA, 600 bp, Candida albicans
gtcatcatgttgatacaaccaaaccataaaagaaaaccggagtttaatgaacgatattatatctgtcgaaccattgaaaactattctacaaattttagtattattgttcaatataatagacaaatcagccataacttattatcaaatgcattatattcattaataaaaaagaacagttggtttgtccagaattttttccaaatagatcaaaggaatccagcaactgccaatggccataattttgaagtacgaattcttgagcacgttaaattcaatgatgtagttaagtttcatcaaattgacaaattcgatgaaataataatggagtccctcaacgaccatattttcagtatgaacaatgccactttacctctatggaaaatcaacgttttcgaagaaatgagacctaatggaaatcagtttataagtgtatcatttgatcattcaaactatgatggactttcaggagttcaattaacaaaagatttggctaaagaattgttaactgccaaagatgaattgtcttatgatgtcttatttgattatcaacgtgattttggacatttacctgcaaaaatttaccagcaatggataatttga

SEQ ID NO: 380 - DNA, 909 bp, Candida albicans
tccaactccccacgaattctcatgtcgccaccagtactttcagtgtttgacgaggcattggactcaacccccgacgtcatcaagggcctactccaaacaatgattgactttatacaggaaagagataaacagtcatctgcatcctctagtttagaagatattgttgacgacgcgtgccccggtcttgtccaacggtatatcgagaaaattttggtactaagcctttccgacaagggcaagtttgcgtacttgccattccaattcgtacaggttgctttggacttggggtttgccaacccgaaaatttgtatatccacggtaattgccttggaagcgtcgtctcagcccctcattcattgctcagcaattgctatgcaccaaaagttgtttgacaagcatgagtcgttagtagactcgagctaccaggagagtatacgcaaggcattcgatgcagaactcacatcccccatctttttcagctccatctacaccatcattcaccggtcaaagacttcgagatcaaaattcctaaccgctttggggagagtattggttttaggggatatccatttcttattgttctgtgttgagagaaccgctgcaatcactttcaagtacactgacgacgtcttggtggtgttgaaacacttgcaggacgaaatacgtactgtcgatgtggcagacctcgaccagccccaagcattatctgtttgtgcactaatcgagttgtatcgctactttactactgcttacaaaatatcagagcatcaaattaacaatcccgatatcgattcaaaacaaactataaaagtaaaagctaaccacagtctagacttggggtggatcaccgacagcatcggtggtgactgcttggatcgatgcttggagactatacgcgcattcatttag

SEQ ID NO: 381 - DNA, 1500 bp, Candida albicans
ttacttggtttttcggatttatcggtaaagttaattgatttgcccacaccgcatgtgaatgaacttaccaacaacaataaagttcactacaggggaattattattcataaattacccataatccatacagattatattaaaaaattatcccttttgttcaccaaaccaaccatgttcagtggtggactcgatggcaaaatcattgtttgggatttaaacgaattgaaaccaattcaattgattgagaataaagcaaatggagtactatcaccgtcaatttactcattatcaaataaccacagcaatattatcagtaccggggttcccaataacacaatcaatatatttgatcaacgtgccaataatccttttattcgtaatttgattggtcatcaagataatattcgatgtttacttatgaatgaccaatttatattgagtgggtcatctgacacgacaatcaagttatgggatttaagaacatttaaagtttacaagaatttcgatattcatgatgattcagtatggtcattatattcccagtcaactagtcatgattcatttaaaactttttattctggtgataagagtggtaatattattaaaactgatttatcaagagtttcaattttcaatactagaacctctaacgatgatgaatttgggtttagtaattatgaaaacaactatattgatgagaaattgggtatatcgactttgattgctaaaagtacatcacccatattgtcaatctgtcatgaaccagaacaggataccatatttgcaacaaatatggaatctatgactagatatattaatcctgatacttgtcaattatctcaatatcaatatctccgacaatgtttggattattcatataataccaacaatggcattggcgttggtaatgataacaatgatgaattgttgcttcatgacggtcaatccaatcctcctactgaagatttgaattcagatttttatgatttgatcagtcatttatccatggatactcatcctaacaataatattgatttacaaagtacactttctcatggcaacaacaaacaacaacaccataatcttttctcagataatacaagaccaatatcattagatgcaaaagccagtgacatttttactggtgatggttttggtgacgagcaagatgatgagaatatcctgtctagagaagattttgattctatgtttttaaatgtcaatggaggtttatcgagtgaattcataaatgcattcaaagatgaaactaatccattaatggtcaaattacaaactagcaataatgatgatcaaaacaataatcgcaataaaactattgatttgactccaatagaaattttattgaatcctataccaattgaacaaataactttgattccattcaatatttcaccaattgaaaaatatgatttagtgccgaaaagtattgttgccaaaaaaatgtttaataatcgacgtcaaatcaggggggtaaattag

SEQ ID NO: 382 - DNA, 783 bp, Candida albicans
atagagactacgagatcagtgcttagatttattattattattattctttgtatttattatgtatataaaacaacacatgaaattgttttttttctgtactccaaactaatcggctggcccttttttttttgcaacacacatgatctttattttggttgttgttttaatgatttaacaatgcctccgaagaaagggttaacccaggaagagaaattgtcagcactcttaaactggtttcaatcagatcatatgttttacactctaaaagaaatagaatcaaaagcaagcaaacaatgcaaaataccacccatgcaaatgaaagaactagtgttggccctagttgaagaaggattagtagagcaagatagatgtggaaccacaaacctatactggagtttcccatacttacaacacaaaaagcagcaagaaacccacgatcgtttgaaccggactattgctaatttagaaacggaaagagatagtttaatttgccgatgcaaagacgaaactggtgtacgtaatcaaacccacgagagggccagtaaaatccggttttgtgatcagtcactggaacggatagactcaatacaaagtcagttgcagtcgcttaaagattcggaatctgtggagaatttggtaacgagccttgccttcttcagtgattctattgacgatatcatttgttatttaagtcgccaaacagggcttacaatgacaactttgaagacagaatttgaacttcctttagaatttgaagaaatccgtccaggaaccacaaaatag

SEQ ID NO: 383 - DNA, 1143 bp, Candida albicans
tccggtagtgttgctagatctactgttatgagacatccaaaacaacaagaatttttgaaaaatgttggtgaacaaatttgtattgtcaaattacaggggacattatttttcggttcaattggtggagtagaaaaagagattagaaatatgtttgaacatgataaatttaaatctaatccaataaaatatttgataatagatatgaagggagttatttcattagatttttctgcggcagaaggattccgaagaattttaaatttggctaatgatttcaaaacccaatttataatttcatctgtaggtgaagatgatgatataattcaaggcttacgtgatgctgggatatttgataatggagccaatgcaccaatagaattatttagtagtttgaattatgccttggaatggtgtgaaaatagttttttgaaaacttatagcaaacttaagaaaagtgatccagttaaaaccagatcagtacctggatcttcaacattaactacaacacgtcaatcatttgcatctccttcatcatatggagctaaaattttcggtaaatatggagaatttggtacacctagaactaatcaagttttccaagctgctagtaaaaccgtttatgatgaacataaaactgaaagtaaatttgaatctcaaaaaaattcccttttccaaaaacaaccattatcattaattatgttatcattccaaggtttatccgataaagatgctgaattttggtcaaatattactccttattttgttaaagaaaaaattccagaaaattatcaattttatgataccaaaaatgatgaaccagcatttttcatagttgaatcaggtttgattcgttcaattattaaattcgaaagtgagggccgagaattacataatagtattttaccattagtggcatttggtgatttagatgatgcttcagaatatcgacaaatcatttatactactgtaaatgatactgttgtctggaaattgactcaagccaaattaaaagaaatgttggctaaacttggatctaaaggtgaagagttgtatcatgaattattacaagttgaagctaaattaattagaagtagatttgatactatgacagcaaaatttaataattgctggttgaaaaaataa

SEQ ID NO: 384 - DNA, 1281 bp, Candida albicans
atacctcaaattgttcaaaatccaggtgaagcattacagaaattatcatctagtttccctaaatcggtcaatttctactattcttatttatgtcttgaaggtttaactattagttcaggagttttacttcaaattgttgccttgattttgtctcacattttgggaagaattttggatggtacaccaagagctaaatggacaagatggaatactttaggtcaacctgcttattctactctttatccaggtttccaattgttgactgttattgctctttcttattcggttattgctcccttgattttaggattcactgctattgctttcattttgttttatttcgcctacatttatactatgatttttgttttgagaccaagcactgttgatgctagaggtactaattatgtcaaatcattattccaacttttcactggtcttttcttggctcaactttggattactgccattttcgtattttcaaagaactgggcttgtgttgccttggaaggtgttattgtggttgtcaccattgctgcaagattatggatgaaatggaagttcttaccattagttgatgctgttcctatttctgctattaaatatgctgctggcgatccaacatattcttacccaatacatgatcaaggtttgaaagaaatcaaagttgaaggcaaaaactattgggaaggtggtaatcaattgggattgggtcctgatccaaaagatcaagtattacctgatagaattcctggaaatggcccatcttcatatgcttacgatcaacaacaacaacaaaatcatcgtggatctgattcatccgctgttgatactaaagttggtcatggagaactgctcgataaaccaaagagtccatttactgattttaacaacaatcacgatgcagaaaaatctgctggatttaacccagttaataaggcaattgctgctccaactcaaggtgtttcatggttaacatcattcttccagccaaagaaagatacttttgatataatcaagagtgatatgcctagttcatatttcaattatattgaataccattctgattttattagacatgcttatgatgatcctgctgttactgctgaagaaccacatatttggattgctagagatccaatgggattatcagaaattgaaaaaaataaagctctcaaagaaggggttcaagtttctgatgaaaatgccacttttgatgataaaggtgctctcatctttactgttcctccaccagcttatgaagaaccaattagagtagct

SEQ ID NO: 385 - DNA, 807 bp, Candida albicans
ggcggcgcacatggacatggttcctgccagcggcgtggtgaaaacaaaaacaagttgggagaaagaacaaaattggctaacaaatacgaaggtactcttaataaagttttaactaaggctgttaaattgagaaataaatgtcttaaaaagagtaaaccagctcctgaaccacaagatgatattgataaatacttgaaagatggtaagaaaagaccaactcataaattgaagtttttaattggtaaaaaagttgacactttagattattcgccagaaaaattgggtgaattgaataaggaaatcactaaagaacaaactgaatatcaaacttatgatcaattacccgctgttttcattgaattcccaagtcaattggaaatgcaaaaggcttatcaagctattccttaccaacctgactttaaaggagttaaaaccgttattaatgctgccccagaagatattatttgggaaaacttgcaattgacttcaatgaaaagaagaattaaaagtattattgctaacactattttgactttattgattattttctggtgtatcccagtagctgttgttggtgccatttccaatattaatgtattgactgataaggttccatttttgaaattcattcttaaaatgcctgatgtcattatgggggtaattactggtttactcccagttgtggcattagcaattttgatgtcattggtgcctccattcattaaatggatgggtaaaatttctggaagtcttacaattcaacaaggtggaaaattattgtcaatcatggtattttgctttccaagt

SEQ ID NO: 386 - DNA, 1815 bp, Candida albicans
aaacagaaagagcaccgtcaaaatttagatgaggtaatgacccagtatttggacaagcataataacttggcaacgcttctactgacaactagtatgaacgatgaattgtacgtaatatatgataaatacataaaaccatctgaagatatattacgtgaatatgtgtttcttgatatactcaaagaagtcctgtcagtttttaatattgatgaaattaatttgtggctacgaacatatttgaaaccagcgttggatagtgcaggatacttttcacaatttgtcgataaagcaagagatcttattaggaaaatagctatcaactatttgcaaacaaatgacgagagtctaaactttgaaagaggaagaattggaagtatagtcatgcaccagatcatggagatttacctcaacaacaataaaaggctagaatatctaaacttggaaccgaatgatagccagtcatatcaagagagggtgcggtttattaaattcaactgcttaaatttgcttcaagagtatgggttgaagcatatatctaattacactaaattactagatcaacatttgaaggatccaactgaaagattagaaactttaaatttattcctgaaattagttgctacacaaagctcgcaggtctcgtatattattgaatcagatttgttttcagatctattgaaatgccttctatatgattttaatgatgcatcagtttttgcttcggccactgtgttggtgatgctaataccacaagttagtactaaacttggtcaacacttaccggacttatttgccatctatttgaggttagttaactggcatgagctaaacaaatatgtaacaaaccgttatgaattgtttatgaattacatgagtgaagatttcttgtcgtggaaaatcgataatacagggaaagaagcacacgcgactgaaatcatatttgactggcaatattatgggactttgttgtatgggctatttgtcttgaactttatcgaattttcagcagccccgttgaagtatttgcaacagcataaaccaaaattaatcactttggtgttgctcgagggaattgaagccaacatcgaacatgcaaccaaaatggaatcttttgccatcgcaaagagtaaagagtttttacaatctttattgttacatccaaagatgatcagtttagatacttctcaacaacgtgaacttgaagctcccgttgaatggattctacaacaaaacacagggtcgatttcttcggaagatatagctatttcatgtttgagtttaaacccacacattatggccgatgaagctttcaagagaaacaacatacctcatgatctttggttttcaaagcgtgactcagtcagtcagaatgaatcacatcatctactctcaaggaactcatcattggctggtccaatgtatatcaatgttaaggagagtcatacaaacaaacttctatcacaacaagccataaatggcagaaaaatgtctataatacctacaaacttgatgattgaagatgattccaacaatggagttaaattcaaagaagtcaagtttagcgacgacaacatttctgatgcagatatatcattcaatggtggactgtctgataatatcatgggcaactcctcattatcacttcgaaactttcaggagaatcacaaaacaacggaccctattccggagctactatctacacatgaaaaattatatgcaaaacaaggagacaatgattcgtcttataatgacgataagaagtctgtaaacaattttattaatgacaagggaaaatacgaactaagattgtcttga

SEQ ID NO: 387 - DNA, 1533 bp, Candida albicans
  unsure (1473): Identity of nucleotide sequences at the above locations are unknown.
tctgttcttcctttttttattttttggcttttagttaattccttcaatatcaaaatgacttattccgaaaaacaacccttgttagaatacagcaaaaagattgctgatgatcatgaagtttcagtcagatcattcaactttcccattttcgaaaacacattatccttattcaactccattaatcctttccaaaactgtttaactcctttgactcgtaaggtttcagatatactgcttaatgataccgatgatattgatgttgatagtgattataacttatctgatgatgaagacacaccattacctgatttaccatatgaatcggatgatttccctattcttttaccgagctcaaagttatcccaaagggaaaaattatatgaattaaggaagttaatgaaggagtataatatcgggacatatattattccatctgaagatgaacatcaatcggaatatacttcattatctgacaaacgcagagagtatataactggatttaccggaagtgcaggaattgctattgttactttgaccaacgcaaacactttaactggtgaagcaatattatcaacggatggaagatattttttacaggcagaaaagcaattaaatcccagattatggaagttgtttaaacaatgtgctactggttataaaccatggcacgaatggagtgttgaatctgcttccaagaatggatttagcaaagtgatttcctgtgacccaagagtggtcagtttatcaattggtgaatattttgacaaacaggctaaatttcataaatcattccaattcaaaccattattgctggtcaatcttgttgatgaaatatggggtgcagaaaagccgtctagaccattggatccaatctatgttttaccattgcgttacagtggagaacacaccaatgataaattaaccaaaataagacaagccatgaaagaaaagaatagcactcactatgtggtgtctgagttagatagtattgcttggttgtttaatttgagagcagataaagacattcccttcacaccagtgtttttcgcatatgccttagtaactttggattcgatagtattgtatgttaataacgacaaattgcccaacgacgatgcacaactcaatgaatatttgtcgagtatcgaaaatttgacaattaaagattacaatgagtttttcaaagatgtttccaagttaagtgaactcaaagataaggaatccgtcgttttgccaacaagatcagcaacgtcatatgctttatatgatactatttccaaatccgttaacaagtcactgttgtatcatgaatcaataattgcgaatttgaaaatttttaaaaacaaaactgaacttttcaatgccaaaattgctcaatacaaagattctttaagcattcattattttttcagcttgggtttagactatcagttggtccttaaaaaagaaaaaaattttccgaattacgatgcngcatgtaaaatatattcaattagacagaaatttacccaatttcacagggttatcttatga

SEQ ID NO: 388 - DNA, 1137 bp, Candida albicans
gtgtttgaaaccgttcaactgtcttccaaagatacgatgtctaccgatagcactgacagccctgctacaaataatatacatgacccaactattttccaaatcaacgggttactcaaaatcaagctttctcaattcaagtattttacttttacagttattggtatagcgttgttatggccatggaattgttttctctccgcgtcagcttattatggtgaaaggtttgtaaactctccttccttagtaaaggtttactcctcgactatgatgagtgtttccacaatcacctccacggcgtacaatttttacttgtcacaacgacaaacaaatgtcaattacaactttagagtgcaagctggattttgcattacaatatttgtgtttttattcatggctgtctcatgtgtgtctgattggataattgatatgaacgactcggcatttttcactactttgatgtttatggtgttgttgtcagccatggccacatgtctagcacaaaatggtaccatggctatcgtcaacgttttaggtggtatttatgccaatgcagtgatggtgggtcaagctgttgctggggttttacctgcatgtgctttgattatatcaatattattagttggtgacaaggtgtccgatcagcatcatcgtgttgaaaaaaactatggagtatttgtgtactacattactgcaagtttggtgtgtataatttccttattgctactatatttggtcacttaccacaagaacgaagttggctaccaaaggctcaatcaattagtagaagaagatgactctggcgcagttgacgagcaagaggtggtcgatccaatacacacacagaagaagtttgtaccctttactgtattatgggggaaactaaacctaattgtaatgactatatttttcacgtttggaataaccttgatatttcctgtctttgcatcggtggtggaatctgtacataccgattctcattcaagatttcttaataagaacatttatataccgttcatatacttggtttggaaccttggtgatttgctaagtacggttctttgtgggtatcccacactaaatatgttgatcaagattccaaaaactcaccttgtttacccgttatcgcggttggtattt

SEQ ID NO: 389 - DNA, 2001 bp, Candida albicans
tcatttctttatctttacaacaaattattattagaaatggcaaaaaaaggaaagaaagcagcccaggctggaggagatttttgggatgatgaggatatggcccaagatcaaccacaagctgaagaatttggcacacctgccgaaccagaatctcaagaagcatccgcagaggacgtcagtggggatttgctaagttctattcgtaaaaataaacagaagaaagctgaaaagcaagaaaacgaaaaagcaaatgtcaacaatggagatgctccaaaattgttatcgaagaaggaaaaggaaaagttgaagaaggaagctgaaaaacaaaagaagaaagagttagctcaaaagaagaaggcccagcaagcaacaaagaaggaacaaatcaaagaggctaataaacaaaatgctggtagtgccgtaactgcatcttctgcgtcagccactcctgaaccagaggaaaatgaatctctggctgcatctgaacaaaatgaagcacctaaggcaaaacctgcaaagaaaggtaaaaaggcgcctgctgggcttgctgctttgaagaaacaattggaattgaagaaacaattagaagaagaacagcgtaggttggaagaagaggaggaacaacgtagattggaagaggagagacttgcagctgaagaagaagccaaaaaagaagctgcccgtgccgctaagaaggaacgtgaaagattgaagaaagaacaattgaaagccgaaggtaaattattgaccaagaagcaaaaagaggaaaagaaattgcaagagcgtcgtcgtcaacaattattgcaggccgggaacgtttcagttgctgggttgagcaaaactgaagaaggtgatgcgccaaagccaaagaaagttgtctacactaagaaaaaatccacaaaaccaaagacttttatccaaaaaactgttccatctaaggctcctgtcaagaaagacgatggcgaagatgaagctttggtagacgattgggaaaagatggcattggatgacgatgctccagttgctgatgattgggaagctgcacttgctgatgaaggcgatgaagaagtaggggaagcggaagaagaagacgaagaagttggggaagacgaagatactattgttgaagatgaacaagaaaagaaagccaaggaagaggctgctagaaaggccaaagaagaatcagcaagaaaagccaaggaagaagcagcaagaaaagcacaagaagaagaaaaatctaaacaattggctgcacaaaagaaggccgcttctccatctgaaaaagatttgcgttctccaatttgttgtattttgggacatgtcgataccggtaaaaccaaattgttggacaaaatccgtcaaactaacgttcaaggaggtgaagctggtggtattacacaacaaattggtgcaacatacttcccagttgatgctattaaacaaaagaccgctgtcatggccaaatacgaaaagcaaacatttgatgttcctggtttgttgattattgatacccctgggcacgagtcctttaccaacttaagatctcgtggttcttcattatgtaacattgctattttggttattgatattatgcatggtttggaacaacaaactttagagtctatacgattgttgagagatagaaaggctccattcgttgttgctttaaacaagattgatcgtttatacgattggaaagaaataccaaataactcttttagagattcatttgctaagcaaaccaaatcagtgcaagctgaatttgaaaacagatatgaacaaatcaaattagctcttgcagaacaaggtttgaactcggaattgtatttccaaaacaaaaacatgtccaaatacgtttctattgttcctacctctgctgttactggtgaaggtgttcctgatttattatggttattgcttgaattgacacaaaagagaatgtctaagcaattgatggatccagtctcaaagttgctgtccactatgttggccgagacggct

SEQ ID NO: 390 - DNA, 888 bp, Candida albicans
tcttccatcccggctggtgcaagacgaatgtctaagcagttgatgtatttgtctaaagttgcagccactattttggaagtcaaggtagtcgaaggttttgggtacaccattgatgttgttttgtccaatggtattttaagagagggtgaccgtgtggtattgtgtggattaaatggtccgatagcgactaacatcagagcattattgacacctcctccatcacgtgaattgcgtatcaaatctgaatatgtccatcacaaagaagtcaaggccgctttgggggttaaaattgccgcaaatgatttggaaaaggctgttgctggttctcgtttacttgtggtgggagaagatgatgacgaggatgaattaatggacgaagttatggatgatttgactggatcgtcttactctgtccattcctcctgtctatgtgtggttgttctcccctcttcctcatgttccttggactcctcgcttgatttctcgacacacctgcatcttccctcctcgtctatcgggttgggtcccctcttccttagagatgttacgagatcttcctctctgactcgttctattttctcccctcggcattttctttcttactcccgctcttctccgctctcctatctatttcttactcctctcctcccactactcttctctttctactctctcctcaatcctcttcctcttcttcctctcctttcttcctcttccccctgttcttcgttccccttccccccctcactctcctcttcgcctcccttccctctctctttcctcctcctctctccctccttcgtctctctcttccttccctgctcatccctgcctctctctctctcttactccctgctcctcccttctcttctcttccctcccgctctt

SEQ ID NO: 391 - DNA, 1773 bp, Candida albicans
ctttatatgcgcctgaaaaaaaaaaactgtagtttgacatccgcacaagaaaaattttgcaccaatcatctcttcaaaattagtaaacatgtcaaaggaatcactaacaatatgatcaatctacagaggaacttgcctaaaattgtaagtttacttagtggaaggattattacacaatgccacaactattcaaaactatccacgcctacaagaaagccgaaaggagaagaaaaaatcagtaatcttctaaagcatttcaaaaggactaaacgaagaaatgatttaactgatcccactcatcctagtaagataacgtaccgtgaaattaatgattttatacaagaatactcccaaagtcataatttacaagttcagaccgagaatatacgtaactcgcttgatataattaaaaactttttgccccaccaaagaaatcacgatacaatactagataatgtcaaaatcagagccatgacttctctgggtgaagggttagctatagttcacaaatccatgtatgcccataactttacgtctgatcccgaagaaattttgaaccagtacacagtattaataatacccaaaacagctattggagacaatgctagagtactacttaaaatgcatcacgaattttatgcagaaggtgagcttattgaagtgcttaattccaaatctaaaggatccagaagaaacgataggcttatagtatgcgaaaaattcaatgaatgtaacggatgtcaattacaaatgttatcgtatgaggatcaattgaagtataaacaatcggtgatccaaagggcctataagtatttttatcctcagattttcaacctgttcaaagaaatggataattttggtattgttaatgaatcacctttacaatactcttatagaacaaaattaactccacactttgcggcatccaataaagttaaccaaaaactcggtttccagcacgttaacaaccgaggaagattggatataaccaattgtcccatagctacaccagaaataaatgatatattacaagaatcaagagacaactacatagggaaatcaacacctttgacacaactaacattgaggcaaagtcttcgtatcaatcaagacactggtgctttcaagtcagtggcactagaaggtcaaaaaaaagttatcacagaaaaagttgaggactttttatttcagtatgattctaactgctttttccaaaacaataatgcaattttacccagtgttttggattacatcagatatcatatcaatcaatctgataaaacaattgacaatttgattgacacatattgtggtgttgggttttttggaattgccttgtccaaatcattcaatgaaaacaccaagattttcggaatagaactagtggaacaagccattaaatatgccaaccataacgctaaattgaatggattggatcctgaaagagttcaatttgtttctggggatgcttcaaatatatttaacaatgagaactttaaaaaatctggaatttctggaaaaaacagtgttgtaatcgtcgacccttccagaaagggatccaatgaatcatttttacagcaattgttggattttgaaccggaaattgttgtctacgttagttgtaatgttttttcacaggctagggacttggctacatttgaaaatttgcagcagaataccaatgtcaaatacaaagttaaagatgtaatgggatttgactttttcccacaaactaaacacgttgaatccattgccatacttgaaaaagtgtaa

SEQ ID NO: 392 - DNA, 954 bp, Candida albicans
tattgtatatgttcagataaaactttagacgaactaataccagcatttcttagtgaacaattagaatttgctccattgacaattattgatgacgtgatcaatgcggtgaatgaaatcatgtacaagggaacaacagctattgaaacatatttaaaagaacaaaaacaattaatgaaaaatgggatatttaccaaagttactgaagatgaaatagaaattggtatggggaaattagaatcattattagaatcgactatagataagaattttgataaatttgaattatattgtttaagaaatattttcaatatacctaaagatctaataccatatatacagttaagccatcaacaaggaattgaatttaaaagtgataatgttgaacaaaaacgtgaatttgatcaacaaattaaaaatttacaattgaaaatcatgcaagaattacaacttcgaaaaatcttaaaattacaacttgtcaaagtccaaaaattaattaaagtattaatagccattgataatgatttcaagaaaatagattttgctagtggtggtggtggtaatgaagaatcaataagaattttgaaaaatcttcaacctattgatgaaacattatattttttaattagtcaaattaaaaatctaataaatcaaattgaacaattatcaaataaagttaataccaatttgaaaactcaaaaatttatacccaatttgcgtgataaattcattgatggtagaacatttagagttttacaacaaacggggatttggaaagatttggaaaaaaatgatatcaagattctggtgcagggaaatgacaataataataataataataataataataataataccttaacagatttacaaaatcaagacgacattgatatgataataccagaacaagacgatatagatgtggatgcaataaagaatataaatgctcaaatttaa

SEQ ID NO: 393 - DNA, 1023 bp, Candida albicans
acaatccttatagactacacatttccctcctccatgtcgtcaagaccaaagttattgtcttttgatgcatttgcaaagacagtagaagatgcaagaatcaaaacaacttcaggtgggatcattactttaatatgtattttaataacgttagttttaattcgaaatgaatacgttgattatactacaattataactcgtcctgaattagtcgtggatcgtgatatcaataaacaattggatatcaatttagatataagttttattaatcttccttgtgatttgatttccattgatttactcgatgttaccggggatttgagtttgaatattattgattccggtttgaaaaaaattagattattgaaaaataaacaaggtgatgtgattgttaatgaaattgaagatgatgaaccggcttttaataatgatattgaattatctgatttagctaaagggttacctgaaggatctgatgaaaatgcctattgtgggtcttgttacggagcattaccacaagataaaaaacaattttgttgtaatgattgtaatactgtccgtagagcttatgccgagaagcattggtcattttatgatggtgaaaatattgaacaatgtgaaaaggaaggttatgtcggtagattaagagaaagaattaacaacaatgaaggttgtcgtatcaagggaacaaccaagattaatcgtgtttcggggactatggattttgctcctggtgcttcatttactcgtgaaggaagacatttccatgatttgtccttatataccaaatacccagataaattcaatttcgatcacataatcaatcatttatcatttggcgaaatgcccgttgatggacaagctgatgaattatttgactcgatccacccattagatgatcatcaatttatgttgcacaaaaaagcccatcttgtttcatactacttgaaagttgttgccacaagattcgagagtttagattataagaatagcatagatattttcaacagccggtcaagatcatgt

SEQ ID NO: 394 - DNA, 642 bp, Candida albicans
  unsure (623): Identity of nucleotide sequences at the above locations are unknown.
gaaacaatccttatagactacacatttccctcctccatgtcgtcaagaccaaagttattgtcttttgatgcatttgcaaagacagtagaagatgcaagaatcaaaacaacttcaggtgggatcattactttaatatgtattttaataacgttagttttaattcgaaatgaatacgttgattatactacaattataactcgtcctgaattagtcgtggatcgtgatatcaataaacaattggatatcaatttagatataagttttattaatcttccttgtgatttgatttccattgatttactcgacgttactggggatttaagtttgaatattattgattccggtttgaaaaaaattagattattgaaaaataaacaaggtgatgtgattgttaatgaaattgaagatgatgaaccggcttttaataatgatattgaattatctgatttagctaaagggttacctgaaggatctgacgaaaatgcctattgtgggtcttgttacggagcattaccacaagataaaaaacaattttgttgtaatgattgtaatactgtccgtagagcttatgccgagaagcattggtcattttatgatggtgaaaatattgaacaatgtgaaanagaaagttatgtcggttga

SEQ ID NO: 395 - DNA, 240 bp, Candida albicans
gagggaaaagatgaagatcaccaacacactttacatgttagaggaggtattcctggtgttaatttcaatttcgatatctcgccattaaaaattattaaccgtcaacaatatgctaaaacctggtcaggatttgtgttgggtgtcattagttccattgctggtgttttgatggttggtacattgttggatcgatcagtttttgctgcccaacaagcaatcaaaggaaagaaagatatatag

SEQ ID NO: 396 - DNA, 1542 bp, Candida albicans
gaattaaaacgagctgatgtcatatggttagtttattctgatcattatacatatgaacgaatttcattacattggatgccattatttcgatccatgggagttaatttacccattatattatgtgccaataaatctgatttatttcctaaatctaaatccaatttaaagtcgactaattctgatgaatttgttcctctaattaatgaatttaaggaaattgaagctggagttcgatgtagtgccaaaaataattataatgtggtggaagcattttatttatgtcaacgagccgtgactcatcccatatcaccaatttttgacgctaaagaagggaatttgaaaccaggagctattaaacctttgaaaagaattttttggttaagtgataccgatcaagatggatatttgaattttgaagaattatcagaattacataagaaatgttttggtatagaagctagtaagtcagattatgaagaaattgtcaatttgatcgatcaaaaaattttaccaagttataatacaacaatagaaacacaaacaccgccacagcaacaacatttagcaacaagcgctggtactcccaatggcacaaccacaactacaagtaaaggtatatctgaagatggatttattttattgaataaaatctatgctgaatcaggaagacatgaaactgtatggtgtatattacgagcttatcattataccaattcattatcattaagtgataagtttttgtatcctcgattagatgttaatcctcattctagtgttgaattaagtcccacggggtataaattttttgttgatttatttattaaatttgataaagataatgatggtggattaaatgaagatgaattaaacactttatttcgatcaaccccagggatacctaaattatgggttgaatcgaatttcccatcatctattgtttgtaatgaagaaggttatgttacattacaaggatggttagcacaatggaatctaactacttttttaagttataaaaccacattagaatatttggcttatttaggatttgatgaagggaattccactaaagctcttaaagtgaccaaaccaaggaaaattagacagaaaaatggcaaaacttatcgaaatgccgtaaatgatagaaatgtatttaattgttttatagtgggggcccccaaagctgggaaaagttcattattagaactgtttttacatggttcatatagtgatatttattccccaactattcaacccagattagtggttaaagatatagaattacggggtgggaaacaatgttatttaatcctagaggaattaggggaattagaacctgcaatattggaaaataaatcacgtttggatcaatgtgatgtaatttgttatgcttatgattcttctgatcccgaaagtttccaatatcttgttgaattacgagaaaaacatggacatttattggatgaagtaccagcggtatttgttgcattaaaagctgatttcgccaaacaacaagtcttaaagacccgtagcagttattgtaga

SEQ ID NO: 397 - DNA, 657 bp, Candida albicans
agaatttttggcttagatacttatactgtcggagaatcctccaaagttatagttattttaactgacatttatggtcacaaatacaacaatgttttattagttgctgatgccatttctaaggaaggctataaagtcttgattcctgacattttgaagggtgatccaattgtttcttttgacgagttacaagcttggttacctaaacatacacctgaaatcaccgcaccaattgtcaatggcttcttgaaaaaagtcaaggaagagttaaagccaacattcttgggcagtattggttattgttacggtgcaaaatacgttatccagaatttatcctcttccggatttttggatgctggagcagttgcacatccatcgtttgtctctattgaagaagttaaagaaattaaacgtccactcattatttctgctgctgaaactgattcaattttcccacctgaattgagacaccaaactgaggacgaattggctaaattaaatggtgtcagatatcaagttgatttatttagtggtgttacacatggttttgctgttagaggtgacatcaataacccaattgtcaagtacgctaaagaaaaagctttgcttgatcaattgactttcttcgatagtgttcaagtcttgaaatctaatttgtaa

SEQ ID NO: 398 - DNA, 756 bp, Candida albicans
ttactggaattgaaagtgtctttattagatatggcttccaacccaccaagtgcttgttgtgctcaaactaatttccacgaaggtaccccattgggtacacaccaagaggtatttggagtcgatacttacattgttggagaatctagtaacatcttagttatcttaactgatatttttggtcataggtacaacaatgttttgttggttgcagacgctatttccaaatcaggatacaaagttttaattcctgatattttaaatggtgatccacttaaaccaggcgatgacttccaaccatggttacctaaacatacccctgaaattactgctcctatagttgataattttttaaaaagagtcaaagaagaattgaaaccaactttcttaggtggaattggttattgttttggtgcaaagtttgctgttcaaaatttgtctattaatgggtatttagatgctgcagctgttgcccatccttcatttgtttcgatggaagaagtgaaagcgataaagcgtccaatcattatttatgatgctgaaacagatcaagtgtttgctccagaattgagacatcaaactgaagatgaattggctaaattggaaggagttagataccaagttgatttattcagtgatgttacacatggattcgctgtaaggggtgacatcaaaaatccaattgtcagatatgccaaagaaaaggttttggccgatcaattggcatctttcaagagtgttcaagctttgggccattaa

SEQ ID NO: 399 - DNA, 1503 bp, Candida albicans
tctttgctggtaacagggatgatggcaatggttagaattccgccattagcagttgcttgggcacaaaattttagtggttcattgggtgttgtgagaattggttttgttcaagacattgcaaattgttacctccaagcaattggagggaccccaactgatattttaaaatcaaggtatctctcaatttcggttcaaaaatttgtaaagaaatttatcaaacgttcagccatggcaatagctgagcactcacccgagtttatgacacatttgacaaaacgaatcaatgtgctgcttgatacagaatctatcggtgctttggattccgatttgtatacgacaaatgaaaaatcaggcgaatcgtctgggaaaattttggtgttgagaggaattcaaagagttgcctacttatcaaatattgaaattacagacatgtttatgacaagcattcagtttcttttgttttttgttttcgttgtgttgatttgtctcatggcgtttaaggcaattattgagattttggtgcgaagcaaaattatcaaagaagggaaatttaaagagtaccgtcgacaatgggcatccattatcaaaggtactaattaccgtatattgatgcttgccttgccacaaattggattgttttgtatttgggagttcaccgtgagagattcagcggggattgttgttgtagcagtgtttatgttggccgttacagtggtattgttgcttcaagctgctgtcagagtttgtttgttgggtacgaaatctgtccgtgaatataaaaacccggcatatttgttgtttggtgacagaaagtttttgaacaggtttggatttctttatttccagtatcgtgctgacaagtactggtatatattcgtgtcaacaacatacatttttcttaaatcgttgattgttgcggtgctacagaatcatggtaaaccccagtcagttattgtatgggcaattgagctaattcacttggtggttttaatatggatccgtccctttatggataaaagaacaaacgtttttaatattatcattagtataatgaattttatcaacgcattgttttttatgtttttttccgatgtttttggacaacctagtgtggtttcctcaatgatggctgtggtttatttcatattgaatgcagtatttgctttattcttgttgttattcactgttatcacctgtgttcttgccttgttgcgtggtaatcccgactcacaatatcaaccaatgagggatgatcgagtatcgtttttgaatcgtcaggcatccaggtctgatgttattggtaagaataatccacgtaatggaaaagacctggaattggctgatctaggaaaaactgcaatgatgggtcatgaaaacagagcacgcgaaggagatactgcctatcaagactctaattcgtacgatgaggattccttgtattttagacggcgtgctgaaaatgagcaagaaggttattctaatacatatggaccacggaattaa

SEQ ID NO: 400 - DNA, 4209 bp, Candida albicans
gtgaaagacatgtcagacataatggatagagtagataattcgacaagaaagtttaaattgggtgataatattcactttgagatatcgtcatcggcaaatacacagggcaatagtcatcaaataccccgaaaacaactgcagctgacaaattccaaccaccaagaacaatctcaacaagttcgaaatcaactgaaccagtccaatactaataccacttcgaggaaaaaaagaaagaagcataagaaaaaaagcaagatttctacagtgcaagcccatttgaataatcctgaagacgactaccccacatcaagggttattaaacaagcgccaaatggagacgtgatagttgaaagtttggaagatgaagacgaaaatcaccaccatcatgaatacgaagaacatgaagatagttgtgaatatcatcctagcagtaaatccaatacccgaaaaaattcctctgtaaatgaaagcactcataataaaatttgggatagtgcgtccattgaagaacaacaacgattaaaggaattttgggaatcgttagatgaaagcaagaaattagacttggttaaaattgacaaggattccataatgagaatgttcaagaacgaaactaggcatcatttgcagcaacaactactgctgctggtgctgctgcaaccacaacaacagcaatcacaacaaaatgtatccacttcgagtaacaatggcagtagcagtggtattaataataattttaataacaacaatggcaacaacactaattcgtgtgcttgcaagtattgtggacgaagaaatagtattattgaagaagaattggaaagtatttacgacaaccattttgatgatataatcgatttcattcatgaagtgcgagatataaatgatttgaatgctttgccaggattattgtttggtggatttcatatgttagaagaagagcgaagactacaaaaacgacaacaaaaatataaagaaaaatggaatcattcacatcattctactagtgttctgccccaacctgaatcacaagataataaacaattgaacaaatctcaggatcaaaatgaaatgaaagcaatctccattgaagatgaaatggataaatttaaatctcatcttgcaaagatgtcgattctgaatagccagctgaatcctaatcagctatcagaaattcatttacaattgaaaagcgaagatggaaatttgacaggtactactgaatcccaattatttaataaattactagatccaaaattgtttgaagctttggagaatatggatttagataaaatgaaagaaatgtcgaaaatggatcccaaaaacttgaataatgtcaacattttggaaaaagcgacctcattaagagaaattgttcgtgatttgaataatgcagatcgctcaagcctacaaaaaggaatttcccatgtttcgaatatgggtaaatttttttcaaatcttgccacattaaataatgcacaaaacttgccggaaattgttgcctctggtggattggatgaccagttatctaaagggttatcttcatttgctgaagatctattgaagaatgatggcaactcattcattggaatgatggaagcactttctgagtctagaactgcccgagaagaactattaaaggaaacggtgatatcacaaaatccacaagaacaaaagctggtttccattggtcaaagtgatcaactgggcgacgtatgggttgatgatgatgatgaaaataacagagtggatgtagaaattcatgcatgtgataacccacatcatcatcaccatcaccaccaacactccaacaagcagcacgaccatcatcattgtcacaatcacagacatagacatagacgtcgttttgaagaattagatgatgagcatgatcaagaaaacgaagatgaagaattggaggatgatgaagaagattattatgatgaatatgacgacgacgaagaggaagatgaagaagaagatgaagacgatgatgacattgaggaagaaggtgcaagtgatactgaatctgaaatttcagaagaagagaaaatgcaagaaatccgtcgtttgttcttgatacaagtaatcaagctcttccaagaaagattgaaaaatgcatataaagaaaagttgtcgcaggatcgaacccaaaagttgattgaagaactagaggctgaggaaaatgctaaaaaggagcgtgaattgaaaaagttgaaacaaaaggaaaaggcaaaagagaagaaacgattacaacaattggccaaagaagaagagcgaaagagaaaggaggaagaattgaaggctaaagaagaagaacaaagattgcagaaagaaaaattgaatgctgaacagaaaaaacggaaagaagaggcgagattgatttctgacgaagaattgatttggattttcgaagatcagaagcgtccagaggaggagcatcggaagaaagttgaggcgcaacagaagcgtgaagctgaagccaaaaaattaaaagaagaacgtagacgaaaagccgaggaagagagaaaacaaaaagaagaagaaaagaaacagaaagaattattgaaaaagcaaaaggaagaagaaaaaagacagaaagagctattgaggaaacaaagggaagaagaaaaggagaaggaggcagctagattagaggaggaaaggaccaaattaatggtaaatgatgatgatgaacttgcaaggcaaattgaggtcgagaaatccaagttatctgcagctgttgctaataatccattattgaaccatttatatcaacctagtccaggatctgctcctaccacaccttctacagctaatttgccagccttgtcgccattgcagtcagcatctgcaaaactcatgtcacagcagtttgagcaacaacaccaacaacaggtgctgcaagaaaagttacctcaaaccagcaacattcaactgccaaaccaacagccacacccatctatatcatcctttcaattttcgtcagaatataatccgaacgctagtgtatttcacaacaattcttcgttattatctaatccttccattatgaattctcctcgaactacttccactaacttattgaacgggaactccccaattgtgccaaacgtgacaactaatatttctttgggtgcaaccaataccagtaacttatcaccttggtcaagtaagtcgagattgaattcattatccaattctacacaaccttttattggtggcaatcaatttactcaaactaatactgctagtttcaatggtgtaggaaatgctgtacagcagagtggtaatttcagcccatttaatgcattcagtgatcctttagtctccgatgctttcaaagcagcgggtccagcaggcatgaattctaatatctggttgaactcaagtaatgtgggtaataatagtggtaaccaactgggaatcagtgcaccaactacaacttcaactaacactagttctcgcaataattcaatttgggggaataccaatcctaataaggttaccgaaccatcattattgaacaacaacaataacaataacaatggattgatatcagttgagagtagtggcctttggaacagtaatggtggcaacaaccaacctgctcgttcttctagtgtcactggtataagcagtaacttgtctacaatcaatcctatcagttctatggacattgagttgattcaatctacaacgtttaactgctttcaaatactacagaatagtggtcagttagaatttggtgttgcaccattaatgaaattatttcaaaatgtgaaaacaattttgaataagccaagtttaacgatcaatcagtttttaaattgttgtactatcaactcaaatgtttacattttttcgctcaaatatgacgattttggtaatgttactcatgttgaagtggcatacaagaatgttcctagaacttctcctcctcctcctccaggaaacattgtccagaaccaacaccaagtttccctgccatcatttgctgctgcaaccgcgtcttcgtcgtcattagcaaccagtaatgttcctttgggattcattaatagtggtgggtcgcctaccggattatttaatgatatcaatatcaatcatggtggaacttcatttttacctccaattggtgagctgtctactaatgatgctggtagttccaacgtgggtaacagtggatttggtcgtagattatggaattga

SEQ ID NO: 401 - DNA, 837 bp, Candida albicans
ttgatgattgatgatgatggttgtctgtttaattttttttttttttttggtcttatttacacacacaccacacactttttaatcttccttctttcttggagactttttgttttggggaagattttctttacacaaacggcaccaattaaacaacaaaccgttaaaccacttttctttctttctttctttctttctttctttcccttatttatataccttatcactcacctagttatgggatttggtctttatttaattgttgctgggactttaatcactggagcagcaaattcattactcacaaaatatcaagataatcaatgtgttgataattgtcatgatcctaatcctgctaatcataaattatttgaacaaccaggaattcaaactatgcaaatgtttcttggtgaattaagtatgtatttagtatttgtgttttataaatggtacaactatgataataataataataataatcggtatgttcaactaaatggtgatgatgatgatgagagcgatccactgagtgttgccaaaccccatgaaacgtcgatatttgaaaattttaaattatcaattccagcaatttgtgatttaagttgtactactttattaaatattggattagtttatactccagtttcaatttatcaaatgtcaagaggttcagtagttttatttgtagctacattatccgtactttttcttaaacggaaaatcactaaattagaatggtcatcattatttttagttacattaggaattggtcttgttggattaagtggatcaagaattataacacgtgacccatttttcaaatattataaattccactaa

SEQ ID NO: 402 - DNA, 711 bp, Candida albicans
  unsure (658): Identity of nucleotide sequences at the above locations are unknown.
acaagattccagccaaatgggacagcaaggttgttggcttctgtgtcaagagatagatcgtgtcgaatttgtgatttgcgtaccatgaaagatatgttggttatcagagattccgaaacggatttatcatgtgttgcttggcatcctatccatgcctcaatggtcactactgctgcttacaatggatctataagtaatttcttgttggattcatacattcctgattcaaatgaatctgtacccaagagaagtaataacaatagtaatctttccaccaatactaacaacacaattgatgccgtacagaaaatcccttatgctcatgaaaaggctatacacgctgtagaataccatccattaggtcatttattatgtacagctggttccgataagacagccagattttggtctcgtgcaagacccaacgatccaatggcttggaaagatgctgtttatactgattgtaaagctggtgcttggtattattcagttaataattctgtcgatgcggtaatggaagatccaaatgctgtgagaaatgaagacgatgagattgctaataatgacgatccgttatccaattctggtcttcgtcatggtgttggagcttcagctctgggtggtgctactggttctgtaccagtgttgagatctaganatgaaacccccaacaacggttcatatgcgatacctggattacgtgggttttaa

SEQ ID NO: 403 - DNA, 915 bp, Candida albicans
gagttccctggatcattcaacctttggtggatttaccaacaaccccaaggaaacaaccccaaagagaaacaggaacccactgatgaatcaagtttgcagacattagttcttcatgacatatctatgaatgatacaaccaacgaccaaactgcaaatgaaattttatctaattttttcaaaagaaaaggtgaaactccattgaatgatatagaatatgaaggagtaatggcattaatttcaagatcaaaagcaggtacaccaataagtaaacgagtgatatcggaatcaatattagatcaacatcaacaaccacaacggaaaaaagctagaaatgaaaagatatcagaaatggcggttgctccatataaacaaagtaccttgattcatgatacttcaaacataagtatatctactccaggttataaaccaacatatcacactattcaaaatgatacttttgatagaagtaatcaatcgttcaataatactacttcaattataccttctattaaacgagtttatcaattttcaggattaccttcgccttattttactagacttagacctccttcaacaacgaaaaaatataaaaaactaagaaatttgcataatgaaaatagtaaacttgataacaacacaagtgctactactactactactactactaataataataataataataataatgatactacgaataatagtgtcaatgctacttttgttgataaaacacgagaatttaaaagtgatacagctaagactttattatctattttggatggaaatgaacaagagaaatcgacatttgattttaataatgattcaaacccacaatcatcatcatcatcagggtttaaattcattaatccatattctaaaaatgtcttcttcaccacaggtgaagatccgcgt

SEQ ID NO: 404 - DNA, 852 bp, Candida albicans
ttccaagcgctttctgccatccgggcgaagacgactaaatgggaggattttgaaatcaaggatagcaatttctacgctaaggatttgagtttagaattgaaagataataaagtgtataagttaaagagttcagttaacaaggaatccatcgttgagtttgaaatggaaagattgactgatggggttatatttggtgatgatggtatgtcattctacggcgaagatcctgaacaaccatggggttcaatgagacatgtattctggccaagatgtaaggtcaatggtaccataaccactgctgacaacaaggtgattgaaatcaacaatggattaacaatgtttgttatggcattacaaggaatgaaacctcaccatgctgccaaatcatggaactttatgaactttcaatcagccaatcactctgcagtgcaaatggaattcaccaccccaaaatcttatggcactacaaaagtcaatattggtattgttaccgataatgaaaaaattttgattgccagtatagataatcaagttgttcattcagataccaaatttgatgacgtcggtggttgggacgtgccacaaaaaattgaattcaattacattgatggcaaagataaagataaacaagttgctagtgtatctggtaatttgagccagttggttgaaagagtcgacgttatggctgaaattcctcagtttgttaaaaatattgttagtggtgtaactggagccagaccttatatctaccaatacgccaacgaatttacaatcgacattaataatggtgatggtgaaaaagtgaaagaagatggggtcggatttactgaagttacctttatttccgactaa

SEQ ID NO: 405 - DNA, 1122 bp, Candida albicans
ttagaatcatctttcaaaaaatctaaaagaacaaatgataatatgaattcgggaattcatacaccacatgagattcacccagttgtctcccaagtccatgttgatgacatgggcattgccagtatactatcaaataaaaatatcaccattaatgtcgatcacgttattgatagtgatgaagcaatgttattagccattggttatcgtcaagaattacgtagagaattcagtttatggtctatttttgccgttagtttctcagtgttgggattacttccttccattgctgcttgctttgactatcaacaattggttgttggtatgtctcccttaccttggcttattgccatgattttcattacttcggttgcttattcaatggcagaaatcgctagtgcatttccgtgttctgcaggtactccttatgcggtatcacaattggctcctaaaaaatacgcttcatttttaacttggttcacatgttggacaaattggtcctgtcaaattactgctgctcctagtgtgagttattcttgtgcctgtatgatgttggcactccattcattcactgacccttcatttgtggccagtaatgcacaaatatttggtttaaccaccggtattcaagttttatgtgcatttatggcatgtttccccactaaatgggttgccagattcagttcggctggtaccacttgtaatatagtatttttggtggttgttttcatcatgattcttggtgggaataaaagagaccaaatcaaagaaggaatctctaaattcaattcaaattcaactgcatgggggttagataatcaagcagaatggcctactggattatcatttttaattagttttatgggagttatttgggcaatgtcaggatacgattcacctttccatcttgctgaagaatgttctaatgctgctgtggctgcccctagagccattgtattaaccagtaccgttggtggattgattggttttatgtttatgattgccattgcttacacattagttgatcttaatcaaattagtgctgatcctgaaggtcttggacaaccttttgtcacttatttaactcaaatcatggataaaaacttggtcattggtgccactgcc

SEQ ID NO: 406 - DNA, 1647 bp, Candida albicans
atcctgataaatggaatggtcttaaatgatttttctggtcctgatccttctcattgtactcttctggttgatgaaccagtatatttaataaatgatgaagacaattattggcggctcattcgaaaattgacaaaacttgaaagattgaaaagaatgagattgaatggtcaggaattccaaattgatattgaatctgatgaagaagatgggaaaattggatttgttcctgctgaatgtctagaaactcacggtgaaagattagctcgtttaaattgttttaaaaatgaagaattggaaaaaaaatcaccaacaccatcatcacttcaagaatcaactgatagctttaaaaatcaacgtcaaactgctactaccaaaaaatctgttacatttgaaaatttgggtgatataatcgacgactattccgatgaagaaataaaaagtgatcatgaaaacatacgacagaatttggatctatataacaatctagaaccacctactcatttacaagaaattaaagaaccagaagttttaagtgatgtttatccagcagaaactcccttgataatttcaaagaataacaacaacaataaggatagtagtaataaaacagctacaccaacgtttcaaatgtcaaacacatttgatgctgtatttgttcaacctaaacagagaagtagtggtttatttgatgatgcttcaattggttcatattctccagacacccctgttaaagctaaatctccattaagagtagaagttcaagatgatgacagtgacgaaatgggaagaaataatagtttatatagtatgtcaagtttgcgtcgatcagtgattttagacagattaactcaaatgacaagtgacatacaagaacaactacaactagatggatacaatgaagacgaagacgaagacgaagaagaacaggaagaagatgccggagaagtagaagaagaactcgatgaggacaagcataaggaggacgatgagactgagaaagaaagtaccgatgttgaacaaggaagtagtagagacagtgaccacgaagtccatgggttttcttttgaggaatcaagtgaacagtttactagtgacgatgattatgatgacgacgatgatgataatgtggaacatcatagtccaagtaatgatggtaatgttgaaagtcaggactacgattaccaaaatgatgatcatactccacaactgattgatcagcacgattatagcaaacatcaacaacaaacaccaacaaactttcattcaatttcatcagccatttctccaaaactccagagactgttgagtacaaccctgagttctgtacaacatcgtacaccacctccagtcagtcaacttacttcgccaaattctcatcgttctccaccaccacaatcacatcaacaatatgcggtatcaccattaaattataatcgtttaccaagaagcaccaccagtattgatgatgaaactagtagtacagtagagaataatgatgataatataaccccattaactagcatgaattcattaacaccaattgaagaaagaagaaaattgaaaccagtacatgaaatgtttatgccaatcttgggtaaatttgatgaacttgctgaaaagttggcagaattggatgatatactttaa

SEQ ID NO: 407 - DNA, 702 bp, Candida albicans
tacaaaattaaattcaatgtcatctctttttctctttctatcgccaaacatacttggctaacaatgctggaaataaccaaactcactcaagaggaaatggatgtggtaatatacgattctagagtaggggatctagaaacattacaggaaatttttgatttagaaaaattgataactccaaagacattaactataatcaaagacgatatcactttaagtacaccattacatatggctgcagctaatggacatttacctgtggttaaatatttgatactgctcttagagaaagacgatgtcaaacagctccttgaagcaaagaatgagaatggaaacactgctttacattgggcatcctacaatgggcatttggaggtggttgaatacttggtagaggaagtaaatgcagacccatttatcaaaaacaattctggacatgattgtatttatgaagctgaactgggtggacaaactgaagttgagaattggtacttgaagaaatttactcctgaagatgccttcgatgtgcaagaaaacgaagctgaaggaacaactaaaattacctatcagccaggtaaggaaagtaaattggcagatgaccaggccagagatgctgtgtttaaatccaaattggacaatacaagcactgaaggtgacagtttagaacaaaagacccaagccttgaacatagatgagcaatag

SEQ ID NO: 408 - DNA, 1275 bp, Candida albicans
atctcaatcactacaacaaccatggcatctgaaaacgtaaaataccgtttgcaaagaatacaaactcttaacggtgaccaagaaattgttttaaaacaagtttgggcctactatttgaaattttttggctaccctgttgatatttctgattccgatttggcttacaaacaatgttttgtggcttccacctcgactgctgattttgatgaatctcaagccattccaactgctggtttatctaaaaccaataccagaggctcaatcaattcaacccaaagtaatgcttctaaaaagaaaagaggtctttttggatctaaaaaatccactgcttcggctttgaacaatggtggtactggtactgcccaaggttctccaccagctaattccaaaagaatgatacaaattcaaactcagtcctcttcagaaagatatgttccagtagatattgcaagtgatgaatattacgctatttatgcccatcaccacaaatccagttatgaatattctgacgattatgatccaagtttggataatgctgctggtgctggtggcttttctaacggtggtggtgtcaattacaataatggcaatggtggtgcttattatgacaatgatactgcttcagttaattctttggaaacttttgttactgctgagactactattactgattatgactacactccagctactatattcaagaatggtaataataacaaaataaatggtaattatggtggtagaattggtcatcctaacaagttccaacaacaacagcagcagcagcaacagcaacaacaacaatactatcaacaatccaatggtggaagtggtgttagtcgtcatcaagctacaatcaacactcctattcacgtaaatgctggtcaaacaccaatcaccgcccttagtcaatatggtgctaaagaccaacatcgtgcgattttgaaagtcccacgtactgatttgatagataaccttgtgttgagatttattagagccagaaaatgggatactgaaaaagccattgaaatgctttctaaatcattacattggagatctaatgatttccccgctgatgactgggctatggaagctgatggtccatcttatcttaatggaaccaacaaagggtttattaaaaatttcactactgaaaaatcttggattaaaggtagagataataataataatccaatctttatgttccaagctaagaagcatttaactgcagattctccattagaacaaaatcaaagatatgctgttgtcactatc

SEQ ID NO: 409 - DNA, 1830 bp, Candida albicans
cttaatatgtccgatgttaaaattgaaattgatcgttcacatactgatggagctttcaccaattatgatattattaaaggaaatgtcacattagtggttactaaagccattaccttaaattggattcaagtgaaattagaaggtgaatcaacgacgcaattactgatacctaaatttaataacaataagaagaagaaagaaaaggataaaatcattcaagatattcataaagtattatatgatacaacaatagttttcccaccagataatgttcgtcaagttagtcaagctaaagaatttactttagccccagggaattattcatatccttttgaatttaaaatccctttaactaattcttgtgttaaacgtggagggatcacaaacatgattcatattaataagaaaacttttgatattatgattaataatggtaatttcaatagtgattttgttaaacataaagctcaaaagtattataaagattatgtggcgggtgggcaacaacaacaacagcaacgaccagaaatgcctgccctgccaaatgaattaccttatcatgtaactacacaattaccaccatcattatcagggatggggaattttgctaatattaaatattatgtcaaagtgacatgtaaacgatcatcattttttaaaaccaatctacgagcttttgatccatttacatttttaccattagatcttgattctcaatatcgacccatagaagaacaattggaacaatataaagaagcatttgtaagaaaagaaattatatttatgaataaaattccatccattgttggtgtagaagtaccacagaaaacacaactagtatcacaggcatcacaggcatcacaaatacaacctaaaaagcaaggattcttacaaagatggtttagttctgatttaagttataatacacccaacaataatacttctggacatatgtcaaggaaaaatcaactgatgaaatatcctaagattacaccagttaatgttccattttcatttgaaattagatttcgacatcctgcatttttaactcctgggaaactgccaacttttaaattatatcttgtatcaaccgtgaatccattacaatattcattagataaatatggtgaaccagaagaatctaatggattaggagttgtttatttacaaaatattactgtttcattaatatctacaacatctatatcaattgtggaaaatgattctggtatgaatgaatttcatatggggaataatgtacaaacaataccaatttgtgataattcttattctaatttgaaatttgatttaatgaaatgtcgtaaaaataaaaattccctgataacaacaacaagaaattccaatgatgcttgtattaataataaaccagtgacaaaacaactttatgaattagaaatcccacaaaaatattttgctaattgtatattaccagagaatttaccaccaagttttaaaacatgtaatatttcccgttcttatgatttaataataactgctaaatttagtcctgaaaagataactatcaccactacttcatcatcatcaccaacaaattccgccagtagtaatatgaaagaagttgaattaagatgttcaaatattaaagtattaagtggattacattttgctggtgctccaataactcaacgacaagctagtgtgatactgtcattaactccaccaccagcaccagcactagcaccagcagcaggatcaaggtcagggtcagcacccgtggcagacacacaagattccttaggacaatcatctaaaagtgaatcgttcacaaatgaaggagatgagaattga

SEQ ID NO: 410 - DNA, 732 bp, Candida albicans
caattttatctatttatacttatttttgtaaacaactatatgggtgctgacggtggaaccattgccaaaaggcaagatttattatcatcattgacaaatagaaccaatggagatgcacaaagaagtgaagataaagaaggggatttaatcaaagtatgccatctttctagtctacctctttataataatgatcctatagttagtgattacaagggcaagttgtacatcgaagagaaactactacaatacttattggatattaaaacgaataaacacagtgttaaatcggaattttcccatatcaaactgctaaaagacatctgtccagtaacagtatcatggacgatcattaacaaagaaccattcattgaatgcccagtgaccaaagaagttcaaaaatcttacttgtacctacgatcatgtggctgtttgatttccaaaaaggcgttgaacgagttttcaaaaaccaaaacagagaagaaatgtccaaattgcaatgtcgatttctgtgatttcgatattgtaatgcttgatccattaaacttgaagaaaaatagtgatatcaatgaagaaaacatactgatcttaagacaaaagggcttgtcacattcaaaattaccattaaaaaagcctaaaaagaaaaagatccatgatgaagacgaatttattaggaagaggaaattacctgatgagattgccagtgctagaaaacgaaagtctacagtttcctga

SEQ ID NO: 411 - DNA, 225 bp, Candida albicans
atgtttaaaatgattggcagattagctcatatttcatttgatttagtattaatttccggatttttagcaggagttaaacgtactactggaataactcccaatttagatagtattgaaaataaagatgtacaatattatgctacaaaatatttaaatttaggtgaatcagtatttgataatactgctgcatttttaggtaattcccaatatttcaccaggaaatga

SEQ ID NO: 412 - DNA, 1098 bp, Candida albicans
ttacgcggtcttgctctcgtggtgaaaacagaagaagcaacgcctaattctaaaccaagtctatttggtgatgccttcaaagcttctgacaagactgagtcttctaccacatctaagccgtcattttcttttgggtttaacaacgctacaactacaccattttcattgggtggtggcgagaagaaagatactacaccttcaagtacacttttcaccttaggaaaaactgacaccactaaagatgatgctaaaccaacagagacaacttcattatttggtgacaaatccaaaagcggctctacaacgccattcacatttggacaaaaagatgataaggctgctggagattcaaaagaagaagacaaactggcttcaacaactaaaccacctagtacagggtttacctttggagcacctgctaaaactactgaaagcaatgatggatctaaaggagaatcaaataatgatgctgcttcaagtacaactgcaacaacaacatcgtcaactcccttcaagtttggtattactaataaagcaagcacagatgcagaagataaaaaaaccgaagaaccagccactaagaaatttaattttgcaactccatcaacagataaaccttcgactccattctcattcccaagtgccaatagtagcagtacatcaaaaccagcgttcagtttaggtggtattggaacaactgataacaaagagaagaaggacacatcgagttcaccgtctattacacaatccacaactgcccctcctcttacatcatccacattttctttcaatactaaaaaaccagacgcgccagctactactgccacaaccgatgctgatgctgctaagtctctgtccaattctggattcaaatttgcagcaggagtgaacccaccatcacaaactacaagcaataagccaccatcaatattcaactttggtgccgcatcacaaccatcagctacacctgtgtttgcaggatttggacaacctccacaaccagccaatacttctggcggagcgttcggtggtaagagttcgtttggtcaaggtacaaataatgcatttggtaatactggtggaatatttggtaattag

SEQ ID NO: 413 - DNA, 534 bp, Candida albicans
tgtataggatttgtaaatatatttttaacgcgcgcattgaacaaaaaaatttttttttttacaactctatccatctcatccctatctacagccatgcctagaagattcaataagaaaaccgccaccacattcaatgttgtacatagagctcatgatgatgcaaggttctatgacgatgaagcatcagaacacgttttggttccacaatctacaaagaaaaaagttgtcaccaccactgagttagaaaagaaactcgctaataccaatataagagacaacgaaggattggccgcacaatatggtatcacttacgacgactcaaagtatgattatatgcaacatttaaagccaatggggaacccagatggtgtttttgtgggtgccaagcaatcccagccaaaacagctgatagaagatttatttaaagaccagttaccctctaaagaaacaagaaaagttgccagagatttaaaccaaaacatacccgacgaattacaagggtttaatccaaatttagatccaagcattgcgtga

SEQ ID NO: 414 - DNA, 744 bp, Candida albicans
caacaattatcaaattattattattatagatacggagaattagttagattagatattcctccaccaagatccgacgatggtgaaaaatatgcattcgttgaatataaggatgcagaaagttgtgaacgtgctttggaattggatggtaaaactttgccatattcaatcaaagacggattggttgttcaagttgccagatccgacccataccgtgtgagacaacaattttctggtccaagaggaggttatcgtgatggaggttacggtggaagaggaggctaccgtgatggtggctatggaggaagaggtggttatcgcgacggtggttacggtggtagaggtggttatggaggaggaagaggtggtggttacggtggataccgtgatgggggaagaggtggatatcgtgatggtggaagaggcggttatggaggttaccgtgatgggggaagaggtggtggctatggtggctaccgtgatggaggaagaggaggaggttaccgtgacggtggataccgtgatggaggataccgcgatggtggtagaggtggttatggaggaggaagaggtggttatgaccgtgatcgtgaggaaggtagaggaggttatgatcgtgaagaagatagaggaggatatgaacgtgatgaaggtagagaaccaagagttgaagaaagaagatacagtagatctccatcaagatctcctcctagaagagatagatcaagatccccagaacgttattag

SEQ ID NO: 415 - DNA, 333 bp, Candida albicans
gccatccgcaaatacaccaccattatcatcattatcgtatctacaattatgtcactcccttatacccttgaactaaatatcccgtttgaaactttcaatcaagcagcaattgcaaagaatacgctatcaccagatccaatactcagatcagatgagttaacaattgattatgctacagattccaacaatctcaaagtgaaattttcaggagtgagtgatcgagttattcgtgtggctataagtaatatgatagataatattagaacaatcatagaatgtatggacgattttgatggtaaaaaaaaatcattgtttgatttacaagattattag

SEQ ID NO: 416 - DNA, 321 bp, Candida albicans
  unsure (95),(179): Identity of nucleotide sequences at the above locations are unknown.
aatttcaatcaattattaatttcaaatgcttacgctttcattatgtcttcagaccctgcaagaccagatctagatgtttccatagatctgatttnctctataagtcaccaattggatataggaaaccccgcttctagtacttcatcatcgaaccaaaatcccgaagtggcaaaggcatntagtgagatttgtttggcatgccgaactggggatattgaagtagtggactcgttattatctactccaaacctagacattaaccaggttgatgagtatgaatattcacctttgattttgagttcatggtgtggggcattatga

SEQ ID NO: 417 - DNA, 498 bp, Candida albicans
aagcaacaaaaaggatttgaaatcagtcaatgttcagaaatttgtgaatcatgtactagtaaattccctaaacatttaaaatttgaaggtgaaagtgaaggtacatcactttggaatactactaaaccttatggaatgcatattattatagctacgggtaaaaaagattggtctcatgatgccattaatgaagatggtaaaaaaaaggatactttaaaatataaaattggtaaatgggctgaaaataatacaaattcaccattggggactataaaagttaatgtatcatcaatgagttcagatgaattatatattaatgaaaattataaattagaaaaacaaggtgatttattaattctaccttattttttaaatatcaaggggatcactattgatgaagttgatacctatttaaatgaattagaatcattattaatcaattctactaataataatgattctactattattattgatgaaatcattaccaaattacct

SEQ ID NO: 418 - DNA, 819 bp, Candida albicans
  unsure (47): Identity of nucleotide sequences at the above locations are unknown.
ttatcccggtccccacacaataatgtggatcctgtcagcctcgtggntgaagaaaatagtggtgatcaatttattatgaatactggaagtttcaaattacctgatcaagatgaatttcaattcactatgaataataatagtgataatggtttttcttcttctacctcatcttcagatttagaaagtgtacctgatttaactgatgataatattgatgaattaaccccggaaacaactcctattaaaccagtaggtaatttttatttcaatacattatttgataatgaagaaaacactgatggctattattataaattgaattctcaaatcaagataagaaatgaacttcaacaacaacagcaacaacaacagcaacaaagattaacatcttcttcaccatcgatctttgaaattccggaaattgtttataaaataatcagttatgttgatgaacaaaatacaattttgccacaagaatcaactccaattagaagaaatccattatcttataagcatgcattattaatccatggtgataaaaaatccgctcaatctgcccttcaaaaaaccaccaatcaacaaagtcaacaaaatcaacaaccttcaagtgtcatttcatcatcaccattatataattgtttattggtgaataaattattttataaaatcactagtgaaatcatatcaacaaaattttattcccataatgaacaacaattgaaaaaattcattgaaaataaatcccaccaacaacaaaattcatcatctcctattatcattcaaccaaaaacatttattttacataaattatttcacact

SEQ ID NO: 419 - DNA, 1110 bp, Candida albicans
acacgtatacacaacagcaaaaacattgaatatttttacatcataatgaaatttagttctactacattattggctgtgttatcatcacttactgccactgtcagtgccggatgttcattcgaaggcggaaactactactgttctgaaaccaaaaaagttatctacaaaggtatcgggttttctggtagttatatggacgttaccaatatggatgaaaacactggtaaatgtactcaacaattatattccttcagtggtaacttgtctccattagacgaagaattatcagttcatttcagaggacctttgacattgttacaatttggtgtttactacccaagcagtagtggtaattcaaagagacagattgacgaccaagactgtaatgtcaaacatgttcaccataaacacaagagagctactgaagttgttcaagtcacacaaacagttttcgttgatggaaatggtaacactgttacttcccaagctctccaaacttctactgtcgaatccagtcctgctgtgtcatctgctgctgctgccaacgataatgccaactctggctctggctctggctctagcgctggctctggttccggttatggatcagtatctgcccttgatggtgaaggtaaagcttacagatccgatatctcaactaaatctgctccaaccagtacttctgctcaaccatcttcatcagaaaccgcctctgtcgatggtgcttggaccagagacagttattatactccaggatccaccgataactgtgtgttcttaaactatcatggtggttctggttctggtgtttggtccgctaaattcggtaactctttatcttatgccaatgctgataactctggtggttcttcgacccctgttcccttggaagaaaccactatcaaatctggtgaagaatacattatcttctctggttctaaatgtggtagtagttccgattgtggttactatagaaaaggtactgttgcttatcacggtttcaaaggagctagcaagatttttgtttttgaatttgaaatgccaagtgatactaatggtaatggtcagaaccaagtcttcaccacggacgtgccggatccaactaatcca

SEQ ID NO: 420 - DNA, 342 bp, Candida albicans
cctccggaaataatgctgatcggcagcctggtagtgaagatcttgagcagtggttcaaataaaatgatctcccacttgcacgatggtcaaggttcttctcaaaacagtaacaatggtggtggtggttctcaagattatttcgaaagaccaacttctggtacattcaagggtgttgttattttcgaaggtgatgaaatccatattcttcaagttgatgatgaaactgaattcggttcatcattagatgaagaaactgttaacgcttggttgaaagaagctggttctgttgccactattggttactatatttgtgataccccctttttcagcacctttttttaa

SEQ ID NO: 421 - DNA, 717 bp, Candida albicans
catgatattatgtcaagattttggcatttcaaaaagttctatttcaccctgtgctactcaatgcaaagaatgcggggaaagattttcaagaatgaacctctagttccaatggatgtcacgtcagaacacgaacaagtgcaatcaattagtaaagaagaatcacgttcattactgtcaaacgatctaaacttaagtgcagatctggaattgcaattggaatccgaaccagagatagagtcggaacaactaaaaaatcatgaagatgtgtatgaaatcatcaggctgatggttctagcagcagatacaacattgcctagattaagcaataacctgctaacaggaatttataatcactggaaattgaatcccaacgatgacttgccactttataatcccaccaaatatacaccatatgaatttcactcccagtataatcaggatcggtcctatataatcacaccaagattatcggtgacaaagttattagtgtctagttggtgtgagctacgcagcttttatcaagtttattctgggtcagttcggctaccatccactaaagccatgacacaaggtaccaagcttcactcaaaattagaagcagaggtccatccggaaatagataccacggaaatagaacagtttcttatttctaatgcaatgagtttaagggagttgcaaaccactgtcccagccgaaggaagagacggtggttattga

SEQ ID NO: 422 - DNA, 1230 bp, Candida albicans
gggagttgcaaaccactgtcccagccgaaggaagagacggtggttattgatttgggagaggttgagcaattagctgttgattgggcggaaatgttaattgaaagattgttttcattgattatgggagctgaagcaagagaaattctattgcacggttatttgaatttgaaaaatcgactgtttgtgaccaataaggatgaaattcgtgaatcttctagtgtgttggtgagtggtatagttgactatatcaaacttcaaaacgttacaaatccaagtgatggaactttattcgatgatattcatggatttgttgatagtgcgtttgatcaagttgacaatgttccccttgtggatctttcacagtttttgcctgaggctaaacagatacttcaaaattatgacttcaggttgacattcactgatgtgaaaacgagatcagcacgacaaattccaagacaagagtcggttcttgaagccgcaaaattccaaacattttattatagacatttttttcatttgcttagtcgtgatagcagattcacttatttcagtttgattgagaatgcagagcgcagaggacatgacgttgacaagccgttgagcatacttacaactatcagtttgttgcggaaacattatcatattttcttcaaagatttcgtgaaacttgccaacggagaaccaataggattttcaccttttgacgattcagctaaatcaattccttatgattttgtttcaatgtttcaatccagcaatgaattttctttggctaatccaaatcataaccactttttggagcaaatactggagattgatggaattgaatatgatctgattctttcgcctttgttgaaagtgtggaaaactccgcctactcttagatacctagctgcgagggcaagtcaattatttaatgttttcaatgaaaatataggtgatataacttcagttgagtatcgatacaacaagacatctgaattgttactggaaaaggtatatgattataatttttccgaatttcaagctgaggtagaaagtgccagcaaattttggaatggtgagagagaggtaatcccaactgaagatctactgcgttgttcgtattgtgagtttcaatccaaatgtatggtggccggtggtaagactacagaagccgtagaaaagaaaacaataggacccaaaattagacaatttttaaatgaatgtgagtcatcttcaaaaggatag

SEQ ID NO: 423 - DNA, 540 bp, Candida albicans
actaaaccaacatcaatcaaccaatacacaccaatcatgggaaccaacaacaaaactgtcactaataagtcaaacaagagaatccaagggaaacgacatatcaaacatagtcccaacttgactccctttaatgaaacacaaaatgcttcgaattttttaatcaaatcatcaactccttatatatcagctatcaaacaaattaccaaaaaattgaataaattctccaaatcaaagaatagtcacacgataaataaatttcaaaatgaacaatacaagacgatcaaatatatagccgtcaaaggtatgggtaaaacaattgaaaaagtggcgagtattggtactcatttccaaaaggattataaagttgatgtgttgacagggtctactacagtgttagatgagtttgcaccaattgaatcaaaccaagagcctgataatgagaacaagagtgatgatgatgacgacgacgacgacgaaactatgtttaagaaacgtactgtgagttctatagagattagaatatggataaaacgagattaa

SEQ ID NO: 424 - DNA, 447 bp, Candida albicans
tcgttgagagtcgtaccatccagtactaataaagaatcttccgtgaacaccacaaagtttggccaaccagctgaacatgctcctgctttgcaagatagtttaagatcacaagagggcccattgaatatagcatcaaagataaacaatcgtcatccattagaatctcaagtgaccaactgggaaaaaactcaagaagaaaacagaatggaaacttatagacgtatatttggtgctggtgctccaatcaaaagagctatggagttggaaattgtagaatcctcgtcattcagaccaagtttattaggaggtgttgattcaatgcataaagatatcttgttaaacaaagattcaagtgtcgattgggaagatgtttaccctggaggatttgcaaatggtgacaatgtgaaagatttccactctgaaatggaaaaacaaatgggaatttag

SEQ ID NO: 425 - DNA, 1296 bp, Candida albicans
attagtcaaattatcataatggggatattaggctggggtttcagatcaaacattaagattcatcagtcaggcgatgaaggttctgctacgttatcgttgaaagacaaaggcaccatcaagttcagtcaattcatcaaacaagatttacctattttggatgaatctcaaaagttgtggttgaacccattgctattcaatgggactttgcaaacattgtattatacttctatggatagttctaacaaatttttaatttactatgggagagagcttttcacctattcagatggtggtatttgttctttggattgggttattccaaaaccagaagatgagcaaaagtttgagactattcgaaaggaaacattacccgaagggttccctagattacaaccccgttgcagatacttcacgaatgaagaattggcagagttgcaccaagaagattctactagtgaaaaaccaattgttgttataattcatggtttaggtggtggaagtcatgaatccttgattcgtgattttgccgaaactattgaaaaaaagaccagtggttggggggttgtggttataaattctcgtgggtgtggtacaaccaaattgactagtgggaagttgttcaatgctggatcaacaaacgatatcagagaagtgttgcaagattttaagaaaagatggccaaatagaccaatttatcttgttggattctcttttggtggggcattaacagccaatttcttaggtgaagagggtgaaaaggagaattcggaaagcttggtgaaagctgcttgtactgttggttgtccttgggattttgttgatggtgcttatcacttgcaaaaatcgtggactggtaaatatttattgagtcctgctttggccaaattcttagctaaaattgttaccaataattataaagagttggaaacttatgcccctgacattgtcaacaaggaaacattgaaggttatcaaaaactgtaaaacattgtgggagttcgatgacaatgtaacttgcaaaaccaccccatacaaagatgccttcgagtattatcaagagttgtctccagttaagaaactttcacaaataaaaacaccattgttagctctcaattcaaccgatgatcctgcagttggagtcaaattgcctatactgcaaatgaaagccaatccttatttttgcttagttgaaacagatttaggtggtcatttgggatatgtccaactgaatggtgaattttggtgtgttgaactagttgaacaatttttccaaaaatttgaagaattggtcaaatag

SEQ ID NO: 426 - DNA, 2109 bp, Candida albicans
tcatttttcatatttattaaggcaaaactttttaaagaaatgggagattttccaaatctagaacctgacaagagaattgatcaaaattcacattccgatactaacagtgtgaatgatcaagctagttcaacaaatgattctgtgttgtcaaccagtccttctcgtttagtttatattccaggagagtcctcgttaactcgtgatggacctttaccgctagatggagaagaaggttcaagttcacaacgtgggttcataactcgcagcaaccgtcaacaagtcgatacatcgttgcaacaagtgcagtacaacaacaacaaaatagcattagacagttctatcaatcagaccattgatttaatttctgaattacaagatgaaaacaaagagagacctatattttatcctacagaaatcgaagatgatgccagtgttgtcttaaactcggcaaaagcacatttggcattagttcgtaaaaatagcacattaaagtcaataagtaaatccaaaattgaaaccgacgaaaaagaactaccagaattcaagattttgaaaatcagtttaaagtcgggacacggcgacaatagcaacaccatggcaaatttggataaaaagtcgattgccaatttgttagaaaaaaaattgttacaacaagttaaatatttattaaatttgaaggatagaattgatgacacgacatcaaaagtctttgttactggtgatttaaatgccgggaaatctacattttgtaacgctttattgagaagaaagattctacccgaagatcaacagccctgtactgcggtattttgtgaagttatagatgcgtcgaaggaaaataatagcatagaagaagtacacgcagttccaataggtaaagagtacaatattcgagatgagtctacattcgaagtctatccattagaaagtttagaggatttggtttatgattgcgatcgattcagtttattgaaaatctatgttttggaccatcgtagttttcaagaaagtttattacacaatggagttatagatataaaattgattgatgctcctggattaaacatggacctgtatcaaaccactcaagttttctcacgtcaagaggaaattgacttggtggtatttgttgttagtgcagaaaaccatttcacattgtcggcaaaagaatttattgctgctgctgcgaatgaaaaaaggtacgtgtttattgttgtcaatagatttgatcatatcaaggataaagaaaagtgtaaaagaagaattttggatcaaatcaagagcttatctccggatacttataagaatgccaaagaatttgttcattttgtgagttcgagtgaggtgttgaacgaaaatggaggtggcgatgacggtgatcctgatgacgatgacaacaataacaacgacaataatgaccatcctgattttgaccaattggaggcatctttgagaaagtttctcttggaaaaaagatccatttccaaattattgcctgttaaggattatttacttaatatcttactagacttacaaacattatctaaaatcaatgaaaaaatctattatgatgaaaaggttgataaacttcaagaattgaataatcgagtggccccaaagtataacgacattatgaccaaatctgtgagaattggtgatacgatcaatggattgattgaatctacctgtactgaggtatacaatgaaactaataaggaaattgtcactactgtaaacaatttgggtgataaaccaatagtgaaatatcctggactccaatacttgtttgaatatgccaaagagactcaattagcaatgatcgatatagttttagaatcggttgcacgtagtgaagaagtggccaagaaggttacttcaaatagggtagatgagattatcaaatacggacaacagactttaaatgaagagtttttgaatgacaaggtgtttaattcagatttgatgttcactagaagaagagataccattgggaaatcaattgatgatacttttgaaattaatgatttctttgatccttcaattgaatcgtttttagtatttgttgggttacttcttcacacacggccgctcgaaggaaccacgtacggc

SEQ ID NO: 427 - DNA, 969 bp, Candida albicans
atttctctctctatcttaacaatgaaggtgtctaaatttttattcaccttaactttattatcttccagttgtctagccatcattgaaaatattgatggttcaatagaagatactgattcattactcacaaaaaccgttgacaaatcaagtcataaactaggtgttcaaccactagaagatgaagataatcatccaacaccaaaacatgctaaacaaccattagatccatataaaaacggtggtaaacttggtcatgagtcatcgtcatcatcatcatcatctaatcaagatcaagaactcccagatacttcatataacgcgtttattatgtcaatttccatgattattgtttctgaaattggtgataaaacatttttaattgctgcattaatggccatgagaaattcccgaattgtggtattttcagcagcattttcttcgttggtcgtaatgacagtattatcaggaattgttggtcatgcattacctacattaatttcacaaagattaacacaatttttagcatcagcattgtttattatatttggagtgaaattattaagagaaggattagctatgagtaaagatgttggtgttgatgaagaaatggcagaagttgaagaagaaattgccatgagtaaattaaatactcaaatgaatgatattgaaggtggtggtgtatctaataccgagggagtaactaactcttctatttcaaataataatactccagtttatgctgaaattggtaatcaaattcaaaatttggcaacatttgtatttacaccagtttggattcaagtatttgtcatgacatttttaggtgaatggggtgatagatcacaaattgctactattgctatggctgctgggtccgaatattggtttgttatttttggtgctattattggtcacggactttgtactgctgctgcttgtattggtggtaaatatctagctaaaaaaatt

SEQ ID NO: 428 - DNA, 732 bp, Candida albicans
  unsure (298): Identity of nucleotide sequences at the above locations are unknown.
ataccacatatcatgagtcaaacaccattccaccctaattcaccatcagttccaacaacaacatcattaccttcgacagattttagtcaaattccttatgatgtattagaatcaattagaaatcgattaaatcaaattcgtcattcattaactaaattagctgatcaaataaataatcatattcgacatcgtcaaaaaataaaattaccttcatatctgtattttcaaaatcaatttcaagtattaattactcaattaatgtcaataactaatcaattatataataatgaagatcttntacgtaatactaatgtttatccaacaccaattttcccaacttcggctcatgaaaatatgttgacaacattattaaggaaaaaagttgctcctgaagttgatgaatggataaatggagctaaattaataatggaaaatgaaaccaaaaataagttggataatcaacaagttgaaattgatatattaaaaatcgatcaatgggtacaatggtgtcttgccaaaattcaagatttacgtgatgaatttcaattttatggatttcatacagtagaagaattagatcatatggaaactcctcaagggaaacaagaaattaaagagaaaaaggataaagaatttgaacgggaacaaattgaattgaaaataactgctggtggtcaaaaaagtttacatccaaatcaagtattgaaatttatgtgtcaaggacagatatga

SEQ ID NO: 429 - DNA, 381 bp, Candida albicans
gacggagttttctggatggttttcactgctatcttaggatggacaaattctgctactattggtagtgttgttagttataaaggttattggattgttatcatattggtattctggtctttgatttatgaacaaaagaacggatttttacctttgattcctatttcctgtcaattgataataattcaaaatagaaagaacttgtaccaacctttatatgctcttgagattggtgtacacgaggaagtcagagagagtatggactcgttgaattcagaaaccccttttcaaaggatgatagtcccagtcttgtactttttaataaacgtacaatatctctactcaatgtatatactgcaagataaccggcttatagttttgtga

SEQ ID NO: 430 - DNA, 300 bp, Candida albicans
  unsure (11),(14): Identity of nucleotide sequences at the above locations are unknown.
agccatagtanctncctgccgtgtcgcttgaagacagtgttggccaggacgctggggatattggtaggatctatattgtatcgttatggtaatactttgtcgttgaagatgtttttaatcacatcaacgtgtttcttatatttagttgcagctggtttgttctccaaaggagtttggaatttcgaattacagagatttattgataaatgtggtggattatatgtgagtgagactggtcacggtccatggtcatatgatatcgcaatatctgtttggcatgtcaattgctgcaatggataa

SEQ ID NO: 431 - DNA, 1560 bp, Candida albicans
cctctgttgacgatatattcaataatgattaaatttgaagattatttttccattcaaatatttttcattatattacgtgaaactttagaaacggcaattattatatctgttttattatcattcatcaatcaacgatctcataaacaagaagaggaatcaactttatctaccaataataataataataatgataataatgataataatgagattgagaatgagaatgagaatgcggttcatccaatatctatatctcaaagtagaaaagctgatatgaatcgaaaattaaaatttcaagtttggataggagctatattaggattaatcatttgttttataattgggataatttttgttttaattttttattttgttggacaagattattggtcatatactgaaagagtatgggaaggattattttcaattttatcgagtataataatcactattatggggattggattattaagaattaataaagtgatgaaattaaaatggtggataaaattaggtgatgcctataactataatggacaacaagacgagagggaggatgatgaagagatttctgctttgactgataatgatattttatttgatgggaataacaatggtgaggaagaagatattatgaattatgggggaacgagatcaagttctgaatcaaatgaaataatcacccataacaataataatgactctaattttagttttagttctagttctagttctaattctaattctaattttaattctaattctaatccgggaattttgaataatgataatgaggaaagtatacctttaacggcatcttctaatttttttactccattcaaaaataaacatcaatcaactgcaaaaaattcgaaacagcttcaccgccagtcatttagtaagaaatattttttagcaatattaccattagtcaccacattaagagaaggattagaagcagtggtattcattggtggtagtgctatgagttcatcacctcattctattccattatcggtaatttgtgggatttctatgggttcaataattggttattttttatatcaaggaggtaataaattatcattacaatattttttgattttttcaacatgttttctttatattgtcagtgctggattaatgagtcgaggtatttggtttttggaattagaacaatatgttagacaatgtaatggattagatgtgagtgaaactggtagtggacctggttcttatgatattgtcaaaagtgtttggcatgttaattgttgtaatggattaactgatggttggtggatggtttttaatgctatttttggttggacaaattctgcaacttatggtagtgttttcagttatatgatttattggacaatggttattatttggttgaaaattaaattatatgaagaacgtcatggtatattaccattggttccattaaaatggcaattgaaaagaattcaaaaaagaattagattatatgaattaagaaaaaatcatgaacaagaacatcaagggcagcaacaagaagaagggcaacaagaagcaagttga

SEQ ID NO: 432 - DNA, 1890 bp, Candida albicans
cgagccgtgggcaatacgcaaccaagaaaaatgcctaagtcgccacgtctttcaacgtcaacttcttcgggtccatcagctgtacctaatctattaggatctcctcgtccatctcctccgcaattgcaacatcagccatccagcgcatctacatcgtcaacaacctcgacagcaacaacaggggggtctatatcggcaactgcgcctggctctacccaacattaccttcatcaccatccttctcgtaaaacatcaattgtggaaatattgagctctccaccgccattgccaacagacccaaatgatccaattcatcaacttagtttgtcaagacacgcctcaacaagctcaaataaatcttcatcacaatcaatcgctcctggttcgacagcaatcaccaatcatgcattctcgttggttgattggagcgaaattccattgacggagttgacggaatcaaacaagttgatcagcattcatagttctcactcggtgcaatcggcattcgaaacgttgctcaagaacaatttgaccagtgttccggtatccatttcgaaatctgacccgcatgatttaactaattgcttaacttttgattacagtgatttgaacacttatcttttattaatcatgaataaaatcaactattcggaattgaatgtcgatgatattggtgatcctaatatatcgcctcaagaaagacatgaattcgttactcaaactattagcaaagctaagaggggagaagaagtcccagttgaatttatcatcaagttgcacccaaagaacccattcatcaaattcaatgaaaccgatactttgttctcagtgatggaaacattaggtaatggtgttcacagaattgctatcaccaacgaagaaggtaacaaaataaccggtatattatcgcaaagaagattgattaaatacatgtgggaaaatgctagaagattcccttcattggacttttatttgacatcaactttgcaggacttgaagattgggtcttccaacccaataacaatttacgaggatcaaatgttgatagaagctttacacaagatgttcaacgaaagagtttcatcgctagcagttattgatcgatcaagaacattgattggaaacatctcgattgttgatgttaaaaatgttaccagctccaaaaattcccatttgttgttcaagtctgttttgaattttattagctataatttgtcacaaaagggaattgaagaaggacaagatcaattcccaatattccatgtcaataatcaaacgtcattaggaagagtcattgcaaaattagttgccactcaatctcatagattatggattgttgacagctcacgtcaagccagttccatgagcagtgccagtgcttctgcccccaatagtgggatgaacaatggcgtaaccgttggctatccagcaccagtagactcatcaataacagataaagctgaagaagttgaagctagtagtatgtcatcaccacaattaaatgctgctgctgctgctgctgctgccgtcgccactggtgcaccaaccactgccacctcagctcaaccagatttttcttacactagtggtactggaaaattagttggtgttgtcacattaacagatattttaggcttatttgctacttccaagggtagaagaactgaccctcaggctgctagaaatcaaagaagaagaagctcaacatctactaccagatcatctatcgatagtgctttaagtgctgaaggtatacttccatccggaagcgctattattggtagcagtaacgcagccaacaccggccgcagaggtagtgttgaagtttctagtgatgttttccggaaatcatacaccaaggcacaagaaaatgcattttcaaaggaatag

SEQ ID NO: 433 - DNA, 1374 bp, Candida albicans
tttatcccctcttatgtaaggttttattgtacacttctttatatttttttttgccagattacacattcttcaaactttgagtcaattacaattctagccttacaagtaaaaagaaaaaactggaacatcagtacaaccttaaaagcagaaaaaaaaaacttgcacacccaaattatattttccagtgtttcccattttcttgtgtcaaatactactcgaagtaaaaacgcaacaaccacacttgagatgtcagaaacagaccattcagaaactagtgaatccaccattgagccatttcaatttgaaaaagttatggaaaacttggaatctggagctcaagacgcattacaatccaaagatttcttatcttatagtacactattggatatttatttaaacgacccaacaaaatattccaatgaagagaaagagcaattactaggtcatatattgactatactttccgaaaacaaacagttgacatacgaaataggttgggatttgccacaattattgatcttgtacgttgattccgattatgaattcaatgggcctatcagagactcccctggggtgtataaaattttgaaaatttttgaaaatttggcgattaatggtaatcataaagaattatttttgaaaagttgtgaattattaaacgatttggaattatctcaagatgaagacattgaattattaaaacgtgaaaacttctttgaaatcaaattatattgtgtatttgaattaattgatgcctgtttgaagaaaattcatactttgtatccatcgagatttttggccatgacagttagctcgtttaataatcttatgttcaaattaactaaacagcatggtagtttaggtaattaccattttgtcatgaaaagagtttatagtttctgcagaaactatattagcccaccattacccaccaatgctaaggaaatgcctcaagaggagttggacaagattgttaaagatgaagaatatttacaaagaagattattaactgggtttctaactcaagtgatctatttggccaatataaatggaactgaaggttactcaattgagcatttcagttggttacaacaacaatccaaatcaaaaatcaaatttgtatttgaaagagatggtgcattctgtgatcgatttgtggaattggcatcttcattcgatattgatttgttgaaatgcttccaggggtttatcaccgattcccacaaattgttaattggcattgactacaaaaataagaacaaatctgaagatgaaataattgaacttctttttgaaagagttgttgtagattaccagaagaacgttttaaccagtatcgtcgacagtgatgccaaaccattaaggattcgataa

SEQ ID NO: 434 - DNA, 501 bp, Candida albicans
agcaccatgtcaagaataattcactctgaagatgacgatgacgatgatgtaggtagtcaatcatcatcgtcgttatcatcaccatccaaatccttacaacaagacccaatcccaaccaaaataccattatcaacgtcaattatactagaaaaaaaattaccattagaacaacatcagaaattatcaaatctaacagaaggatccactgctggcggtcatgtatcaaacaattccctcgataataaaattatgattcgattcgttcctatcggttcaacaccgtcgattcaaccacgagtgtttaagatctcagcaacacaaacggtttctacactaaacaggtttttgtgtaaaaaattaaagttcaaaggtgtattaaatttgtatattcaaaatagttttatgccattgcctgacgagcagataggctcgttatatggattgttcaaaactaataatgagttgattattagttattgtaatacgattgcatttggttga

SEQ ID NO: 435 - DNA, 849 bp, Candida albicans
actttccatatgtcagaaaaccaacaattctctgtttctgactcaacagaaaacaaactaaactatcgtcatgctgcgtttgatgaagaaaataatggtcttttaccattagccaacaaaaacctaaaaccgatacataccttgacctcctccaccaccaccccgaatcaccatcagaatgctaaaaaatcatcccatttagcacctcaagatagaaaagcatttattatattagtattattatatgttttacaaggtgtacctgttggtcttgcatttggatcaattccctttatattgaaatctaaattgacttattctcaagtggggattttttcattagcagcatatccttattcattaaaattgatttggtctccatttgtagatagtatatatctgaaaaaatggggtcgaagaagatcatggattataccgattcaaaccatttctgggataatgttgattttattagggacacaaataaatgatttaatggaaaatccaaaaaattatttaactttaataacaatggtgtttttcatattgattttatgttgtgctactcaagatattgctgttgatggatgggcattaacttgtttatcaccagaaagtttatcatatgcttcaacggcacaaactattggaatcaatactgggtatttttcaagttttacaatttttttagcattaagttctcctgattttgctaataaatatttacgatctactcctttggatgtcgggttattttcattgggtggttatttgaaattttgggggtggatgtatttgattgtcactggtattattgtggctcaacaggcgaaagcaggactaatgtcc

SEQ ID NO: 436 - DNA, 909 bp, Candida albicans
aaagaaaataagagttgggccactcgtcaaagatttttacttgaaacaatgtcgcaaacaaacgacaaaccagcattgcatttggtaccatcattttatggagtttatatattgaaatccattccgaaaccccgcagtacgtacattggatcgacccctgaccccaaacgaagattacgacagcataatggtgatttgaaagttggtggggcataccgtaccaagaaagatggatctaggccctggaacatggtggttctagtgtatggcttcccatcacgtatagcagctttgcagtttgcacattccctacaacatgtttatcaaactagacatatagacaatgatgctagaatcactagtagttcacgccaatcttccatacatctgaaacttgccaatatacgattgttgacaacatcgtttgacaagatgtctttgaaaattgccatatttgatgaggaagtttaccgaatgtggatagagaataaacacaagatcgaatgtagtgttccatgcacgctattcaaatttgaagagttctgtgattccataaaagaaattgacatcgaagacgcaaagaatgtgttacttagcaaacagttggagtgtatggaatgcagggtatccattgactactttcaagacaatacaccaaacatttcatctcgacaagaattatcgaattacctatcgaaaggaaactatccactaattggaatttgtggggaccatgcttttcatctaagttgtatggcaagacagcacggccctagtatggtcccaaagtttgttacgtgcactacatgtgggcagaaactagactggtcagacattataaaagtttctacaagactacgtcattatgtggttcaagattcccttcatttagcaattacacaattatag

SEQ ID NO: 437 - DNA, 1038 bp, Candida albicans
  unsure (154),(252): Identity of nucleotide sequences at the above locations are unknown.
cataacaagaggggtacatcaatgtcgaaacagaacatagacaagagtactgaacacctggcaggggaaaatgcattatctgaaaagaatcatactatagaaagcaataaaaataatattgatagtgaagaggatgacgaagaggacgaggatnatgatcccgaaaagaaaaacgaagccgaaaatgaaggtggcgtctccagcgatgaggaagaagacaatgatcaatataaagatggaaaaacatccaanatacccgactattctacaattgagtcaagtacatcacaagttaaaactagatctcaaagacttcatgaaaaactactgaatcagtctagatttattggaaattttgaagttgattcgaaaacaggacttgtcaaggatcagtcgaatatcgatgttaattcaatatttgaaaatttgaaaaatgggagtcctagtatagacaatctggaagaactaaatattgacagtgaaaaaaccgcaaatagtcaacagcaacagaaacagcagtcgaacatagaggaaaatgaactacagggcccgaaacaaatcaaaattcaaatcaattatacatttgctggaaagctaataacagagacaaaatatgttgatgaaaactcacaagaagccaaggcgtatttaaactcgacaagtaacatttcttctaacaattcgaacgaggatatcccatatagacgatctcaagtcaaggttattaggactgaccccgtaactaatgaaacgaaggagctacgtatcaaacttaaacgaccatctttgattgataggtttttatctataaatggtaatagcaaaaaaatgaagttgtctactctagaaaaatcacggttagattgggccagttttgttgataagaggaatattaatgaggaattgaaaatacataataaggctggttacttggataaacaggattttataaacagaatgaattccaagcgggacgatttatacttgcaagctaaagagaaagaaaaaatacgaaaacaacaattattacagaagtga

SEQ ID NO: 438 - DNA, 1200 bp, Candida albicans
ggagcgcggttcctttcagccacgtggctgaatatggaggtcgatttgtttacgccatgtctaatatttaccaaacttgcaccaaacttgtcatttagcaaattactcgaaatcattattataccgattttttatgctgtgtccacaggagtatctgattggagttcccgaattgttagcaaggctttgagcttgaatagccctgagacagattttgtcactgccatggctgtttttggtaattcaaactcgttgcctgtgagtttagttttaacattgagttacacccttcccgacttgttatgggacgatgtggaggacgacaacaccgataaagttgctggtagagggatattgtatttattgatttttcaacaattgggacaaatattgcgttggtcctgggggttcaatacattgttaagaaaacgttcacaattggagttgaacacataccacactaaacatggcaaaattgttttgcacgaaaattgtcgtttgattgatggtgaagatgagcagtttttgtacatggattcaaatcaacaacaagaagaacaacagacggaaacgacaagggaaatttcattgtcagaagatgaagacaacatcaacagcaaaccacttactgcatatatttgccaacttcccggagtcaagcagtttttgtcatttatgaacccacctctttacgctatgttggtagcaattatagttgcctcgataccatatttgaagaatttgattttcgaccgtgaacaaaactccatcgtttacaacacattcactaaggcaatcactactttagggggtgtttccattcccttaattttaattgttttgggatcaaacttgtatccctcaaacgacattccaccaccatcaaaacactacaacagaatactatttgggtcgttgttatcccgaatgatcttgcccagtgcggtgttattgccaataatagccttgtgtgtcaagtacatcaaggcatcaatattggatgacccaattttcttaattgttgcgttcatattgacggttagtcctccagccatacagttgtcgcaaatcactcagctcaacaatgtttaccagaaagaaatgagtggggttctattttgggggtatgttgtgttggtagtaccaactacgatcgcgattgttgtttgttccttgaaggttttggagtgggcaaagtaa

SEQ ID NO: 439 - DNA, 1341 bp, Candida albicans
atgggatatagtctatctgctttagtttctaccaatccatcggcgctttcttattttgacatatcatttttaaccttcgaagcagtactagaagttgttataatatgttgtgctgggttcgttgccgctaaaaccggtctattaaccactcaaggacagaaaactttatcgtccttaaatgttgatttgtttactccatgtttaatatttaccaaacttgcaccaaacttgtcgtttagcaaattagtcgaaatcattattataccgattttttatgctgtgtccacaggagtatcttattggagttcccgaatagttagtaaggcattgagcttgaatagccctgagacagattttgtcactgccatggccgtctttggtaattcaaactcgttgccagtgagtttagttttaacattgagttacacccttcccgacttgttatgggacgatgtggaggacgacaacaccgataaagttgctggtagagggatattgtatttattgattttccagcaattgggacaaatattgcgttggtcctgggggttcaatacattgttaagaaaacgttcacaattggagttgaacacataccacaccaaacatggcaaaattgttttgcacgaaaattgtcgtttgattgatggtgaagatgagcagtttttgtacatggattcaaatcaacaacaagaagaactacagacagaaacgacaagggaaatttcattgtcagaagacgaagacaacatctacagcaaaccacttactgcatatatttgccaacttcccggagtcaagcagtttttgtcatttatgaacccacccctttacgctatgttggtagcaattatagttgcatcgataccatatttgaagaatttgattttcgacagtgaacaaaactccatcgtttacaacacattcactaaggcaatcactactttagggggtgtttccattcccttaattttaattgttttgggatcaaacttgtatccctcaaacgacattccaccaccatcaaaacactacaacagaatactatttgggtcgttgttatcccgaatgatcttgcccagtgcggtgttattgccaataatagccttgtgtgtcaagtacatcaaggcatcaatattggatgacccaattttcttaattgttgcgttcatattgacggttagtcctccagccatacagttgtcgcaaatcactcagctcaacaatgtttaccagaaagaaatgagcggagttctattttgggggtatgttgttttggttgtgccaactacgatcgcgattgttgtttgttccttgaaggttttggagtgggcaaagtaa

SEQ ID NO: 440 - DNA, 261 bp, Candida albicans
ttttccaaagaaatgttggagttgtggttggactatgaacaaattataaatttggaagccagatatgtcaaggatattgacaagtatgaaatgattcaaactgcttgggaatacgaattacaatttgggttgaaacacaatttagatcagttttacacagcaagagaagcaatcaaaactcgtgaaattggagatttgtgtgatgcattattagaaaagagaaataaattaattaaagagttgaaagcacaagagtcctaa

SEQ ID NO: 441 - DNA, 1080 bp, Candida albicans
aaattcctgttgcaaatcaacctcatctcctatacatctatcatggaaacactaccacacagtaaaagaatagaaattgtgaaaactaccctcccaccatgttgtttacgaatccatcctcaggatacctcaaaaatattcattggaacttataaattagaagatgatggatctcgacatggctcattagattactatagctttcttgacaacaaattatcattaatatccagtactgctactttaggagcaatactagatattaaatttaatccatctgatccacaaatgttggtctctgcccattcaaatggtcatttgttaatatggaagtttgacaataatacattggaattatctcacgacgcaaacgtccatgaagatacattgataacgtcaatttttttcaaccctaataaagacagcaatggttctgtgattttgcttactttcactaatggttacctgggtctatttgatttggagaaattagagattgattactttgatacttgtcatgaattagaatgttggactggttcatttggtgaaattggtcaattatctaatgtcgtatacactggtggtgatgattcccaattgattgctcatgacttacgaactaaacaacaaatatggaccttgcgtcgaggtcatgatgctgggattgtgtcaattttatcacccaatgataactggaacaaaaccagtccgaataccttatggactggttcatatgatgataatttaagggtttgggatttgcgagtaattgataaatcaaatccaagcttgatttctgggtacatacctaaaattatttcccaagaaaacttgggtggtggggtatggagattgattccaagtcctgttgataatagattgctcagttgttgtatgtatgatggtgccagaataatcgatgctaacctggatagttttacagttactcgttattttaaacaagatcatcagagtatgtgttatgggggcgattggtcatccgatgggaagttcattgcaacgtgttcgttttacgataatgttgtgcaagtgtggtcacctgatcaatgtgtataa

SEQ ID NO: 442 - DNA, 1323 bp, Candida albicans
atgtcgaggaacgtttcattgcctagcaccactgaatcaactaaaaacaaacgagtggtatcatcacaattacgattagctcaacttgaaagtactgaggcaaataatataacatcatcgtcgtctcccgccaaatcagaatcagaactgcccaaatcaaagatccctaaaaccaaagcaatcaatagaaatagcggtggagaaagaaaacacaaatcgtttaatgatttcaatttagattttagcaacacatttaacttgacaggtgaagaaacaccttcgtatataccacgagtggctacccgacaacgagaaagttcaaaagactttacaaaaacacaaatttcaaaagaagaattgaaaaaagctggcgagttgacgtctatttttctagatacacggaaactactaaatgctgaatacaatgttattgatcagaaaaccgacatatcaggcaagacaggtgatgggagcattgcatcaaaaataaagatttcgcgtgggaccctaatcagagcagagaaagtcaaaaccacccttgcagtcaagtatttatacatccaaagaatttacgagtgggccgagaatcatcaagataataatgagcatctaggagttgagggggtttacaatccactacaaattctaagaaatcgaaaattgagaaataaatacaatgaacatgcacaggcaataatatccatgcaaaccattcccttggcatgtaacgtgtttagtaaacataatgcacatcacaaacatgaaaacagtgctatacctggtcacagaaagacacattggaaaatgatgtgggccattgatttgaatgagtttgtgggagattctcgctggcgagtgaactattggcatgaactcagagatgcaaaggggaatttgtggttcccaaaccatgctcagacgcctgaatattctgaaaaagataaaagcaaattatttgtgttaaggaatcataagcatcatggaaagcatggtgaaattgaagcctcacacaagacaacagaaaacgaagaagaccaggacgaagaagaagaatcaggtattgatattgccattgaatccagaaatcacaatggggtaccttccaatgaaggctcgagttcagatagtgattttcataaatttcgtattacacgttcgaaatcacctcataaaagaaagattagaaacaaaatgaaaaagttttatattggtggacctgggtctactggtaatgggaatacaggcgattcttccagctcatctaatgtggcaaatgagattgttccgacagatacaacaaggagtgggacagtatttttcacc

SEQ ID NO: 443 - DNA, 327 bp, Candida albicans
ctgttctacagtcccgaaacactaatgttatacgcaccagaaggaattgtagtatgggatgcacaacattcatttatattagttgttccacgaaacgaagatagtaaagaatggaatgaagaaaaatcacgattcagtcctagtgaaatggtaggtggattgaaagttattcccaaaaagcatacaatgtttgggtttgatatcattgacccacgtaacgaaaatgactgttacgggtttactatagtgggatcaagatttgagattagatcagttgaaagatcaggcaagaaatttaaaaatcattcagttgatgatattctataa

SEQ ID NO: 444 - DNA, 825 bp, Candida albicans
caacaaccaagtacatttcgtgaagttacaattcctataataattttgaatacacattttaaggataccttctcatcttcaagtaattttcatacattcgattcacaccctttaatcatgtcacaaccacatagtcaacaacagaaagatataactgatccaaaacaactaataaccatatataaaaaacaaggtaaatttgataatcaaagacgactcttattagataatttcaaacaatcagaaacttacaataatttaatattaaaattaaaattattaattgagaataaagtgaaacaagatcctaatatattaatgaaaaacaaggggaaaatggcagcattaatacaaggagaaatgacgacaaataatgataataatgaattattaaatatagttgataaagatattcaagataaaattattgatagttttgaatttcataatttagttaaaaatgatttaattgatattaaacaagaacttttaggtataagtgatgaagaaattgctaaaattaaagatcaagaaaagttgaaattagaaagattaagaatggaagctaaaatgaaggatttgaaacgaattcaacaacaacaacaactactaaaccaagaaaaacaacatcaagttgagaagaactataagaataattttaaaattaaaaatcttgcttcttcatcatcaaatcatcgtgttaataaaccaccaagatttaattttagagattcaaataataatataactgatacatatgataaacaaacatcacaacctaccaaagagaagaaaaaggataaaatatcattcatgatgtattag

SEQ ID NO: 445 - DNA, 723 bp, Candida albicans
gatcaatccacaatcaacaaactcaaccacttaacgaaaaatcttacagaaaagaaagtatacaaaccattatccaatttttttaatgccctatttataccaagtttttgctcccccttagtcgtcatgtcagatagatcagttaacaaaactgatacatcaacaaatttaggcagtagtctcaccaaaacagtatcaccaccacttccacaaccaccaacatcaatagctcaaactgattcagcaaaattattagatactgatcctaaaatccaaaaaattttgaatagtgattatactattgatgttttattaaatcggttaaaagaaagtttgaataccggggaagaatttagtaaatttattaaaaagaaagctcaaattgaagacgatcattataatcaattaaaaaaatttgctggtcatgtacgtaccaatatgaaaaataattctcgaaatttgaaaaatgattcattacaatttcaaatggataaaattattcaatttgatgaatcattatatggagtaggcaattcttatgttgttgccttaaatacaatgtatgatgaattaacatctttaattgggacaattggtagaacaagaaaattgattaaagatgaacataaacgtaaagaaaaagattgtattgatgccataataactgccgaaaaagccaaaaccaaatataatcatttatgtgaagatttagatcgcttgaaa

SEQ ID NO: 446 - DNA, 510 bp, Candida albicans
acttggggggggatttatcgaattagtagtaatcaaagtcaagtcaacaaattaaaagaaagtttagatgcaaatttcacaaattatttaaccattggtaaagatattgatccatccaatgtttatgaaagtgaagtattttgtgttgccagtttattgaaattatatttcagtagtttacgtgaacgtttatttactagtgctgcaagcaaatcatttattgaaacggttaaatcaactgatgaacatttcattgctaaaaaattacatcaattagtatttggattacccgatggtgcttatttcactttaagatcattaatgtttcatcttaataaagtggcacaacatgaatctgaaaatagaatgaatgctaaatcattagcaattatttggggtccagtattatttaatgatagttcaactagtgctcaagatttaagttataaaactaaagtagtagaagaattaatggctatcgccacagatatttttgaacttgatgaataa

SEQ ID NO: 447 - DNA, 939 bp, Candida albicans
aaaatcattttagttggaaaaataaattcgtggaaacaacaagaagatgaattgagtagaaaagttgatactgctgatcaagaatataaactgaaagttgctacatgtaaaaaattaaaagatgaaattttggtgattcatcgtcctaataatactaaaaaattgaaaaatttaatattggaaatggatattgctttaaatttacaattacaaaagtatgcaacttggaatgaaaatttgattatgaattctggagtattaataagtcctttacaatccagtaaagcatcaatgaaatcaatggctagtgatattgataatgaaaaagatttgtatcaatatttgttaagaaatggtactacgggggataacaaatcattaataccagtagattatcatgttcatcattcattagttaaaactaaagatattgggaaaccatttttaaatacaaccaatactccagctaatttgaaaagtgcagcagcaacaaatagatggaacaacaataatgggtctacagcttcaaatattgatggacattcgaaaacatcaagtatttctcatggcgcaggttcttctatgttgggtacatcaacatcagcatctgggtcttctactgttgcccctggtaaaagcaatgatacttttaatggccattctagttctgctacctatgcctcaccaccatcagttactgaaagttccgccccagttctgtatctgtcattagatccagctgttagtcaaacatcatcaccatcactccatataaagggacctaaaccattatcaacattccaacatccaacttttggagcatctattgaagatgttatacaatttgctggtgttgataatgtccctttgattgtacataaatgtattgaagttattgaatcttatggattaaacttggggggggatttatcgaattag

SEQ ID NO: 448 - DNA, 735 bp, Candida albicans
acaatgccggcaaaatcacaacaaggttgggaaataaatttcaatcagtcgtctgaaccaccagattcccaaatcaattatgatgatgcaattcaatattggtccaatactcctgcatctgtcgatggagtgcttggaggatatggtgaacaaacttcagtgcccaaagcagacattgttgggtcttctacatttttgcgtaaactaggtaccagaatgacatgccctgaaggtgtacctaagacgactattgatatgggggctggcattgggagaattacacgtgatttactttggaaagtcagtgactcagttgatttgttggaacctgtcaaaccttttgtggcacagatgcataatgagttaactgaggtgaaaaaaagaggtaaattggggaagatatatgatattggtatgcaagattggcaacctgaacaatcgtattggttaatctggtgccaatggtgtgttggacaattgcctgacgacgtattggttgaattttggagtaggtgccgttcagcattgattgaaaatggtactatgattgtcaaggaaaacattgctccctttgaagatatatttgatgaaaccgatagttctgttacacgtacagatgccaaattcagagaattgtttgaacgtgctgggttcaagttgatagctagcgatatacagaaaggtttacctaaagaactatatcccgttagaatgtactgcttgaaaagcaaataa

SEQ ID NO: 449 - DNA, 969 bp, Candida albicans
cgaactttcataatacaacaaagaaccccttcgctaatgtggttttctaaaactaactttcccgttgaagggaaaacagcattaattgtgggtgcatcccagggaataggagttaacttagccgaaagattatatgagaaaaactgttcaacaatattagttgcacgaacagaatcaaagctacaacaccaaattcaaaacatcaaagaaaaataccccgagtcttctgccaagatatcatatgcagttgcagatgtgtcaaattacgacgaatgcactagattatggcaaacaatccatcctgctgatccagatatactcttttgttgtgctggttcgtcaatacccaaattgtttcaagatttaactaaagtagacattgaactggggatagacatcaattacaagacagttataaatgtagtccacacaggattcaaacatgctttatctaataacacagataatttggagccacacaatttcaaaaagagaagcgtcgtattgttcagctcagtcgtcagctttttcccctttataggctactcgcaatatgcccccatgaagtctgcaattgaatcattatccattattttacgccaagagttgtcaccatacaactatcgtgtcacatgtgttttccctgggaatttccaaagcgaaggatttgaagaagaacaaaagaccaaacctgatatcaccaagaaaattgagggtcccagcaatcctatccctggagatgaatgtgctaggttgataatagatcaattagacaaaggatatgattcgataactacggattttatcgggtggtttttgggctgttctgttttaggcatttcttcaccacgacaatgggggtttttccagatattggtgagtttcattgtgctgctcattgctccaattgcaaattggttcattaacagagatataaaaaactcgttcaagaagacaaaaaaggaataa

SEQ ID NO: 450 - DNA, 1356 bp, Candida albicans
ccaatcgcggttccttccagccccgtggtgaagatctctaaaacttggtttactaatcaaattaatttcatcacattattattgattattataataacaacaacaacaaagttaataaaaatgtttacttgtaatacatgtaacttgcagtttcctgctgctgaagatcaaagaagtcatatgaaatcagaatggcatcgttataatttgaaaagaagagtggctcaattaccaccaattacagaagatttattcaatagtaaagtatctacattgacaaacacggaagagacaaaacagaaacaattaacaaagaaagaacaaagaaggaaagaaaaggaagcaattttagaacaaaaaagacaaatattagaacaagctaaaaaggcaatgttagcaaaaatgcaagaaaatggtggtgaattgccgtcacttaaagaagaattttcaaataccgacagtaataaagaacagcagcagcaacaaaaagatgaagacgataaagatggtgataaactagaagaggaagaagagattactccggaacaacatgaggaaaagatgttagctcaaaaacttgcaaacaaattggagattcctccaacaacatgtttatttgctcatcctaaatataaccataattttgataccattgatgaaaatatcgaacacatgttcaaacaacatggattatatatacctgaacggaaatatcttattgataaacaaggtcttttagaatatttgggggaaaaaattgggtttggattttgtattgtatgtaattatcaaggaagaactgctgaagctgcaagagaacatatgcaacaaaagagacatatgagaattccatatgaaactgaagatgaaaaattagaaatttctaaattttatgatttctcttcaacttatgataataatgtggttgtcgtggatggtgatggtgaagaagaagatggtgattgggaagatttaagtggagaagaagaagatgatgaggacgacgatgaagaactcccaccagttgagagagatgctatatatcaacatggaaatgaattgcacttaccttcgggtgctgtggtggggcatcgttcgatggctagatattatagacaaaacttggccccagatagagaattatctgaaggtcaaggtacagttatagctgctgaaactagacatatgttgacattgaaagatagagaagaattagccaccaaaaagagaacttggaagaaagaaaagaaaatggaagaccttaatgatagaagagctgctaagtttattaataaccaacctcatttcagagatccattttcttccacctaccgcggctggaaaatccagcgctac

SEQ ID NO: 451 - DNA, 420 bp, Candida albicans
atgtctaccatgttagcaagaatatttaaacaatcttccactttatgccctttaagagtaggtacatcatctattcgattctttagtccgccatcaaaattcgattttcaacctggtccaccaagattgcccaaagaacaacaagaagaattcgagaaattacaaagcatagctaattcacaaattgctattgaagagtataatgatcaaattgcccaacaacaagcagaaggctccacacaagaaccaaaggccccaatagtgaattctgagattggatcattttccagtttgaaacttgttcctgattttgaaggtgaggttaaccctaagactggtgaaagaggtggaccaaagcaagaacccttgaagcacacgaaagatgaatggagttttaatgggagagttattgatttctga

SEQ ID NO: 452 - DNA, 1053 bp, Candida albicans
ccggaaacattgcagtttttacgtgacaataacgtgattagtagattgttacgcgaggtatactttaaaaagaccccaatttcagtattaaacaagattgaacgtttaattaccgtgttaaatggtattgaagaaatcaatttacttgaactgtgtctccccattttgaagaaaattcgagaccagggaaatactgtattattgtcacgttatttggatttggtgaatttgttattacggtatttaccagaattttcacctcatttgtacagttttaccaaacaagaatttttgaaataccaggatgatcctttattcttgattttattgattcaattttatgtgaaattggttagattgaaagctccagttgatttgagtctcccattgagtgatatattatcattatatgataagtttgacttgttggttaagaatgaagtagttgaacttgtggcacaattatcattcactcaatcatatactgatatacttttcaagagtcaaatttttaaaactcataatttacttgaagtatttgagaaaactgaaaattccgatattcgattacttagcaaagctaatcctcaagttatttatgaattgaataattcaatttatcctgatgtattggctcatttaaatttatttactaataatttatatttccccattttgttaaatttcatgagttcaacgacaatattttatcaattgaaattacatttaaataatgaaaaattatcacaattaccaatggataaattgtttaaattattattggaaatgtcgactcataatcatagtaaagaacatttatttaataatttgcctactattatgtctacgaatttattagaaactgaagatcttagaaataacgaattatggaatttaaaattggaaattttacaaaacttgttaaatgatgattcggtaccaggatttgaattttggcatcaagaattgacgagaaattacgaattgatgacatttggtagagtttttcgtaatgctgctccaagagttgatattattgatgaaactgcctag

SEQ ID NO: 453 - DNA, 1290 bp, Candida albicans
tatctaataagtctttgtctgttttgtcagtctagtatttctcatcaaatgtcagataatatacatcgctcatttaccacatcagttgagcaagcagtatcttctacgataagtgaacaaaaagcactttttgtttatctagtcacttcaacttatacggaaaacacggacacctttttacccaagtttattgatgaccaaacaaccgcaataataaaatcaaacttcattttgttgaagttaacccaaaataccgttgaatttggatatttcagtcagctattcaaagatttgatagttcctagtttttatattgtgaatgaggggaagatcgaggcagtgatttccaacgacacgacaaaggaggagtttatcaaaataattggaaaattaacaaagaaagtgaaatccagtgataatgtgtctacacgtgagaacataagtaatgaaaataacgttgtcattgaaaatctggctcgcaacaattctcagtccagttcagatcatgataaatcggtacggaaatatcaggagaaggtggccagaatgaggcaggaaaggattgaagaaaagaaaagattgagggctttattagaggcagatcaaaaggaaagaaaacttaaagagcaagaaaatgcaaacgtagaatcaaaactatctgtccactctccatcaagtagaaaaacttcgacatcctcaactaattcatgtgttttatccattaaactatttgacggaagtacaatgaaatgtgaattcaaatcccaggacacgttaattgatgtaagaaaatggttagattctgaggttgaaatcattccacctgcgaaaagtatgccgtcttttgctactacagcttatccatatccaacaggatacgctttccatcgtcctgcattacctcgtgttacttatctggaagagcaagaatccaacactttggccaacttggatttaacacctagatcagctttaattttgaaacctacgtataatgaggtggactcagacaaaccagacaatgacgtcggaaaaacaggtattttccgtagcttgttaaatgttttattcagtttaggtactacaatttattcagttttctcctatggcattaatgctccacataaccaagaacatcgtgatagttctcctcgatacgatcaccgtgatgctgataatttgcagtctagtgaagatgaccaatcaattaacattcatcgacctccaattgctggtcatccaggactgttgatgtttgagagcacatctgcttcatccttgttgttgaat

SEQ ID NO: 454 - DNA, 183 bp, Candida albicans
agaaggggatcaattcctctgattcgatttttagaaaaatgttttaatgctccagcagcacaaataccttgtggtcaactgagtgataatgctcatttaaaagatgaaaaattacgaattattaatttgtttaaattaagagcaatcttgactgatacttttaaagaattaggcatgtcgtga

SEQ ID NO: 455 - DNA, 285 bp, Candida albicans
gaattgtacttattccagaatttacggaaattaaaccattctttaaatgatactataaatgaaaatgtcgccaaccgatcgtcttcatactcttcttcatcgtcttcaaaggatactactaccaatagtattacggggaataaattatcagtggaaattgtccatcaagctgaaccatggttaggtgatcatgaaaataaagtttattcaatattgtttaaaaatttgaaaaatcattggaatcaagaacctttatttattagagaaggggatcaattcctctga

SEQ ID NO: 456 - DNA, 1038 bp, Candida albicans
aaattaaatgatgatgagaacagaacagaacaagaacaagaacaagaacaagaacaagaacaagaacaagaattattgaatggggaattacataaaaaactttctaatgatgatatgttaattatgttacaaaaatatgttgcctttaaaaccattagtaaaaatcctcaattatatttagaagaaagtcgtcattgtgctcaatttttatgtaaattattcaataattttggtgcttatcaaacaaaattattacccataagtaatggtaaccccattgtattttctgaattcaaagccaatagcaccacaaatggtactggcaatgccaggagacctagattattatggtatgctcattatgatgttgttgatgccacgaaaaatgaagcaaaagattggaaaactgatccatttatattaactgctaaagaaggtaatctttatgctcgaggtgtatcggataataaaggtccaacattagcagcaatatattctgtagcagaattatatcatcgtcaacaattgaattgtgatgttgtatttataattgaaggtgaagaagaatgtggttcaattgggtttcaaaaagtcattaatgataataaacaattaattagtggtggcagtggtggcagtggtggtaacggaactacaggaattgattggatcatgttatcgaattcttattggttagatgatttaactccatgtttaaattatggattacgtggagttattaatgcttcaatcacaattaaatccgataaacctgatcgtcattcaggtgttgatggtggtgttagtcgtgaaccaaccatggacatgatgcatttattaagcactttggttgaccccataactcggaaaatccaattacctggattttataatgatattttaccattaacatcatcagaaaaaaaattatatgatactattgctcaatatctggggattaaagtatatactttgatgactaaatggcgtgaaccatccttaacaattcataaaattcaagtgtcggaacctaattaa

SEQ ID NO: 457 - DNA, 1857 bp, Candida albicans
cttgtcctttatcagtttacaagagagatgacactgccaaataacacttcatctaattttaatattcatgaaagtgaatatctatcacaagatagaaaaccattaccacttagtagtacaccatcaaccgagaatataattttgacaccacgaactcataccccaattcgtctaaattctccacacataaatatggctgaattagcgatacataacaatcaaaaacaacaacaacaacaacaacaacaacaacaacaacaacaacaacaacaaagactgaaacaaagttccccactatttttttctgatactaaagtttcagggccaggaacagtagcaacaatggcatcaattacaacaccacactgccagcaccaccagccacagttttctactttttcacaaattccaaacacatcatctaaaccaacttctcaactaccacctgcatcagcactatcatcatcaccgttggaaatgcccattacaacaacaccaagttattacaaccctcaagatttaaatgataacgataaccatagcatcaataatgataataatcttcctcgattagttcataaatggtcacatactcattcaattttgtgttgtttagcatctcccaagaatcgattattattttgtggtactcaagatgggaaaatattagtttatgatatgaatacttatacattaactcatattattggaaatgagaacaacaacaccaatactgaagatcatcatccacatcatcaactggcttcaatattgaccatatgtttaaataaagatgaaagtaaattatttgttgctgggtctgattcattagtgaaaatttataatttacaaaagaaccccaatggtagtgatgatgacaaaaaatatcaatgtactcatgtaatttattcattagttgatattggtgatattttttcaattcattggtgtgattcaacttcaacaatttatattggggctcaaaatgcttcaatattatggtgtcatatttcatttgataatgaagatttagtaaccaatggagataataaaaagcaaccgtctaacggtataaatcataaacataaacataaacaatcaagtcaacaccagaacaacaccaaccaccatcaacaaactcatcgtaatatcaataatggttgtaatgatactaaaaatatattggatattgaacgattaccacatttccgatatgataaattttttgattcaaaaggtcctggtggttcacaaaacacattacaaacaactcataatttattaaaacgaagatattctaaaaccactaatgaatcaaaacatcattcttcaataaaattaattgaatgcaaaagtgacgatattattagatttgctcataatggttatgtttattgtctagatgttataactaatgccaccattagtgattcatctgaatcaaattttttaatatctggaggtggtgatggaataattaatatttggtcatttaatcacaatcccacaataggagttaaattaattaaagttgcatcattagaaaatgatgaatcgatattatctatgaaaatccaagattctttactttatgttggattaagtgattgttcaatcaatgtatgggatttattaaccttacaattaattcgatcatttcaatttggtgataataattttgatgaaattttaagtttggatatttatgataattgtatatataaaggttcatcatcaacgggattaattaaattatcaattttaaatcatcaatttatatcagataaaattttaatgagtctggaaattgaagatggggtaattaatgctgtgaaaatattccccctggatgaatga

SEQ ID NO: 458 - DNA, 969 bp, Candida albicans
gttaatttagttagtgatttaaaaccaacatttatggaattattacttttattacaattgactaagaacacctatatttcccgattttgtgcagaagcattatcatttcttatacgtaaactgaatcccgaatctttaaatgaaattgttcaattttcattatttgatcaaatcgatataatattatataatgacgcctattgtgaatccttaacgattttatatagtgaagccatgaaaaatacaaagggtactttccattctaaagccaatgtgattttctccaaacttatggaaaatacattatataaggtcgacgctaaggcacaaccaaaacttattagtatcatatccgatatcatactcgatattttgaatcatggaacagtggaatcatgtgacaagttttatgcgatggtgactaaatatttaaacagtttacttcaaaaaaatgacccatcagaagtcgaattattaactacatgtcaaatattatccacattagcatttgccgaatcaggtaagaagattactaattgggatattgttcttgaaactgttgatttattagtcgaaaaattaaacagcatcaacatcaccaccaccaccaccaccaccaaacaggaattacttgaatcatatatttatttattggttattgtgtttagaaatgctgatattcaatcattaactattagacacaagaaatattttgattcaatttataatacgccaggatttttaacattcactgaagctagtttatcaattgccaaatctaaagttatcaattttggaatcacaaaacttgtgcaaaactatatcaataactgttcctccaatgatagtgaaaaattgacatatttcttggagaagaatgatattagttcaaaattacaaattcctcaatcattagtcactcggattgccaatgaagtaaatcaagatattgaatcacaatcattttaa

SEQ ID NO: 459 - DNA, 1788 bp, Candida albicans
  unsure (1),(68): Identity of nucleotide sequences at the above locations are unknown.
nagaataatttccccaatgatttagataaaaatttaattgttaattatttctttggattactttttantaaattccaaccatcatggacagcagtttatgaaagtttaccacttatttccagtacttgcacaccagaaatttggcaagtagcatataaattacttacattggattacacaaatgacgaaaatcatgaagaagatgaagatttagtaaatttcccgtttgaaagcacattgattgattggcaaccacgtaattcacgtttattaaataattttgaactgtttgaaaattcatatttggcaccttatagaaacatatccgaggcaattgataatagtttagaaagaaatgcccattttgataatatggttagatctcatgttttaagtgctttgaaaacagtaccatcagtggctgaaaagaatgctggcaaattaatccccattataacccatcaacaaccaacaacagatgaagacgatgggttacaattttggtcacgtaaagatcgtaatgaattacttgaattatttgctaaattcaaaaatttacggaaaatacctgaaggtgaagaattatatgattatttacttgattatttattaactagtaaatatgtcaaagttcaacaattagctctcgatgttttatttacatggaataatccatccataaacaaatatcgagataatttgaaaaatttattagatgatgctatattcagtgatgaaatttccaatttcataatgactaattcatcatcttcttcttcttcttcatcaaccaccagtattattgaaccacaagataaaccaatagttatgaaatttgttattagaattttatttggtagagttcaaggatcacctaaaagtaatagtaaacaaggtaaaaaatttgccgttatatcggtattaccaagtttaactaattcagaaattatatcatttattgaattaggagctaataaaataggttatgaagggtttttcagtggtcaaattccaaaagcaagtttaggacttgatcaatcagaattgaaaaaaattagtggatttattaatttattactggaagtttatcatactttgggagctaattatagcgaatcattacagaccaccatcaaaccattagtgttttctcttgtttcagcacaaaatagaatcgaatcaacaagtttggtggattcaatcataactgaaaaaatggcgaaaaatattagactgaatggtatgagatgtttaactgaattatttaaaattattggtgatgggtttgattggaatgattatatatctttgatatatgataatttattaaatccaagaatggatacatttgctgatgaaaatttacaacaaccttcagctatgcttaaattaatatcattttggattggtcaatctaatacattaccatttttatacattgatgaatttgctgctacaagagccatattatccttattaagtaaatcatcagaagctaaagaagcagtgactataacagtattagattttactattaacgcattggaacgtaaagataatgaaattgatgaaaaatatttcacattattagcgtttgtggttgattcattgttacaatatttgcctcaaaccattgaaatgatttacaataaagatgttggatcccgagccataaaagttttattgttgttgatctcgggtaaatatattgaagatcatgataccaaatcaagtttaattaaatccctcactattgcccttgaaaaaaataataatcaaattgattag

SEQ ID NO: 460 - DNA, 3699 bp, Candida albicans
  unsure (100): Identity of nucleotide sequences at the above locations are unknown.
tttgatgaaaatgattgtgaatttcatgaaatccaaccattatatgaaattttttcaaaattgttaaaaatttttgccgcaagaaacgttagagacactntagtcgttgttattaatactgtggggaataaattcaaacaaatcgaaccaatagcaccaattattgctgggctaaatgcttatagtgatagaatgagtgaatatgattttgaaaaacgtcttgaagcatatagattggtgaatgaagagttgtatacagagttaaccccaattcaatggttacctcttttatattgtgcattattttttatcaacgatcgtgatgaattggttataagagttaatgccggttatatattgaaaagatttgttgattgttattcctctaaagaagaaccaaaagaatatattcgtcttcttaaggatattgtgttacctaatttaaaaattggtattagaaaagataatgaagatgttcaaactgaatatattttggtgttggaacacattattgaacattcaaagtattatactgatttagatgatatgagagttttagttggcaatactagaaatgctgctactgatgatgatgacgatgaagatggagaagataattttttccaaagtattaatcatattcaattacatcgtcgacaaaaagtcatcagaaaattacgtgactataaagatgatttgaaagataatagtatttcccattatattttacccataattgaaggttatgtcaccaccaaagaggataaacttagaaatattgggttagaagcattagaaaccattggagttttacttaaatcagttacttggaatcaatataaagccattgtgaaacgatatattgccaatttaaacaaagctcaagatacattaaaacagcgggtcaatttaatcgttgctgtttcatctgctttagctcaatcagtcaaagaaaacaatactaatttacccgatcaacaagaacttgatcaatttgtattatatgagatttctccaccattattgaaaatcttacaagtgcgtgatgatgaaactattgtggctcgtgctcccttggcagaagcattaaccaatttcatgttatgtatcactaaagaaaagattgatggtgaattaccgtcaattttaactagtacatgtcaagtgatgagatcaagatcggaagaattaagagatgccgtaaggaaaactttaggtaaaattgctgtatctttaggaccaaattatttgagttttatattcaaagaattgaaaactgcattatcaagaggttcacaaattcatgttttgagtttcaccgtacattatttattaacttgtgtggccaccatattaaaacattctgatcttgatgattgtattgagatcattattggaattgtcatggaagatatatttggtgctgctggtcaagaaaaagatgctgaaggttatactagtaagatgaaagaagttaaattcaaaaaaagttttgatacagcagaaatcgttgcctctaatgtatcattaaatcaatttggtaccattattgaaccaattaaaatgttattacaagaaatgatttctcataaaactcaagttaaacttgatgaattacttcgaagattatcattgggattgaatcataatcaagaagcttctaatattgaaatattacatctttgttacgaaatttacatgatgtctaaagaaaatgatgatgatgataacgaaaccaatgggaaacccaaagttagtgccaaagaacaacatttccttactactttggatagaaaagtgaaaaaacgtgttgataaatccctttataaacaaaccatgcaaagactttcatttgaattgttaagaacagcaatttctcgtcatgataatttaatgtccgtaaccaatttacaagggtttatccccttattggaagaaggagtcaaatcagaaaatgaaaccgtgataacggcatcattgaaaattttaaatataataattcgtttaccattccctgatcaaggaatttttaaagcttgtgcaagaagaacattaatattaattaaagattcaccttcaacaaatctggatatatgtcaagcagcattaaaatttttagctactactattagacataatccggaagtaaccatgaaagaatcagccattagttatgttttgacgagaattcaacctgatttagaagaaccaaataaacaagggttggcttttaattttttgaaagcagttgtatcccaacatatcatgatcccagaaatttatgatttaatggataatgttgccaaattaatgactgtaaaccattcgaaagaaattagagatatgtcaagaagtgtttatttccaatttttaatggaatatgaccaaggtaaaggaagattagaaaaacaattcaaatatttggttagtaatttgacttatccaactgaggaaggtcgtcaatcaataatggaattgattcatttaattgttgttaaagctggtaaagatttattaaataaattggcatcatcattttacgtggcattagccaatgttttagtatctgatgtttcttcaagatgtcgtgaaatggctagttcattgatcacaaccatattgaaaaaattggatgatacaagtagtatggagaaatattgtcttgcgtggataaaacaatcaaccaatagtcttttgaaaagatgtggtcttaatatttataaattgattataatggctcgtggatttggtaaaaataaggaattagacaagattgccttggataatatattgaatataattgaagcctccagaaacagcaaagatgatgacgaggaggaaagaagtatgcctagtactagtactagtggtggtggtggtgacgttgaatgggaacttgtttatgcttgtctttctacgttcagtagcattgcatctatctttaaagatcgaatatttgaatatcgcaaaatttggaatggaattattaatattttattatttcctcattcttggattagattaatcacttgtcgattagtcactattcttctttccaataatgttgttagtgaatcccggaaatatgatttagaaacaatagcgactaaattgattcatcaattacgagcaccatcgataactgaagatttaggtacccaaatcaccaaaaatttagtattaattgccatgaaatgggaaaaagaatcttatgaatgggatgagaaatttgctaatgatcaattattatcgaaaatttgtggtataattaaactggaacatgtacattcaattgtttcaaagaaatcatgtattaaattaactgccatgtttattcaatttactaatgaaactagaattatcaagatttctgaaatgataatatcggcattatataattatactgatccgacatatgctacaccagatgatgaattgactaatttaagtttagaagctttagaattggttcaagaaaaaatcggtactactgaatatactaaattatattccaatgttaaagttaatgttaatattaaaagacaagaaagaaaagctaaaagagctcaaatggcagtgtcggctccagaaatagctgctaaaagaaaattaaagaaacatgaaagggttagagagaaaagaaaacatgaaaaagatattaatggttattataaaccaaagacaaaaaaaatgatttaa

SEQ ID NO: 461 - DNA, 1089 bp, Candida albicans
agcaaaaaaaaaaaaaacatacatacaaacatacaattattattagtacaccataaaccaatagaactttctaatattatgaatgaagagctactatcgaaagacccattaaataaaataatatccaaactgaaaggtgattcaaccattcgttatataacttttaatgtcaatggagtgaaaacaatattcaattatcatccttggaatcaattgaaaaataataaagattttaataccttatttaatttattacaagcagatattatcactttacaagaattaaaattaacagaaacatcacttcaacaacaaatgagtcaacttgttcatttatctgattataaatcatttattagtattcctgtgactaaaaaaggatatagtggtgttggattatttattagaaatcctaaatcaaatgaaaataagaaacatcgcaaacatttgacagtcataaaggcagaagaaggtataactggatggttaccatcctcttcttcttcttcttcttcttctgcaaataaaataccgtatagagaatctgccaataatattggtggatatacagacattgaaaaattacctggattgcatttagatagtgaaggaagatgtgtttgtgttgaacttgccgataatacagtaatttttgcagtttattgtcctgctaattcacaatgtacttatgaaggagaattatttagattaacatttatcaaacttttattacaacgatgttataatttagttaaattatatcccaaaaaaaaaattgttattatgggagatataaatattgctatagatatgatagatcatgccgaaactattgaattaggaattaaagaaaatttactaaaaccatcgtttagaggtcataattttgaagttttgaattatgaaaattgtgtttcatttagaactgctactgaagcaagaaaattattaaataaatatgtcataagatcaatatggcaagatttgaaaaatgaaaaaaaccccaaccaaaaagaaagagagaaagaagaaccatttttatatgatactacaagtcttcaccacgggctggaagatacgcgattgcgt

SEQ ID NO: 462 - DNA, 996 bp, Candida albicans
aaacggaaagataattacggaaattcacaagatccaactataggtactgaaattaaacttatcaatgattataatccgattgaagcatcaaaagaaccattgttttccccaatggtaccgtttttatctgaagttagtaatcccaaaaccaccgctcttttgaaaaaaccacctaaaaaatacgtaaagagcagcaacttgatgataatgccagtcaagtttacatttgtcaataaaaaaagtgattatattaatcatatagccaaccttaaacctttagtatcatcaaccaatcttgaattgttttcatctttagattctagaattgctaatgagatttatgaaattggtccgaaaatattaccgcaaccattttctcaagaatttttaaatcttgctaatcataaatttcttcctttatcgatattaacgaaaaaacttgaatttcaattatcaaaaggtcaagtgacaaattataatattaaacaaagtcaccctgccaaatgtcccaatcgtcctaatagtcaaggtggattaggtctatttagagtagtaccactgaaaaaacgaccaacaacaaaattaaattattcacctactaacaagaataataaacatccagataacaacacgaataacgataataacaataataaacctgaattagatgtgaaaaatgatagatattattcacgattaaatatttatgaattatcgaaaattcttgatttacatcgatattcaattggattaacaaaattaattgaattaaatgtacttgaaatgtttggaaattattgtgattttcaattaggttatcaaacttggataagagatactgataaagaaaaaagacgagctttaattcaacaattatattcttatacttcaactttttatccagaaattgatagttttaaattggaagtgattattcgaagcggacctcttcacctcggaactgacaggacccgcgcaaatattaaggcctcacca

SEQ ID NO: 463 - DNA, 807 bp, Candida albicans
ttcaagtttagatatccaaatattattcaacgaacaatgtcttcaacttcaacttcaacatcaactccaagttttcctgagccaactgaagccagaaaacaagaattaatcactaattataacaacactttacaacaagttcaatcccttaatccaaaagtcaatttggtggctgtttctaaattgaaaccttcctcagatataatggctctatattcaataggagtacgtcattttggtgaaaattatgttcaagaattaattgccaaatcacaagaactccccaatgatatcaaatggcatttcattggtgggttacaatcaggtaaagctaaagatttaagtaaacatgttgcaaatttatatgctgtggaaaccattgattcattaaagaaatgtaaacaattggataatactagggttaaagttgaaggtgatgatataaatgtttttttacaaattaatacctcgggagaagaacaaaaatctggattccaaaatttacaagatattgaatctaccgtggaatttttattatcatcagattgtaaaaaattgaaatttttgggattaatgactattggatcatttaatgaatctatttctaatgaaaatgataaagaaaatcaagattttaaaaaattggttgaaatgaaacaaattttggattctaaatataatttaaatcttgaattgagtatggggatgagtaatgattttcaacaagctattaaacaaggaagtacaagtgttagagtaggaactacaatatttggttcaagacctccaagacaacaacaaaaataa

SEQ ID NO: 464 - DNA, 483 bp, Candida albicans
tttgttggtaatggtgatgtatattctcacgaagattggtatgagcacgttaatactgacggaattgattctgtaatggtggctagaggtgccttgatcaaaccatggatctttgaagaagttgaagcacagcagtacttagacaagtcatcaagtgaaagattagacattttaggaaaatttgccaaatatgcaattgaacattggggttctgatgagtacggtgttggattatcaagaagattcatgtgtgaatttttaagttttacacatagatatatcccagttggtatcatggaaagattaccacctaaattgaacgagagaccaccgaaatgggttggtagaaacgacttggaaaccttacttgcctctactgattacaaagattggattaagatcactgaaatgtttttagggaaagcaacagatgattttcaattcactcctaaacataaaagtaacgcctatgaaaataaatga

SEQ ID NO: 465 - DNA, 1425 bp, Candida albicans
tcacatgcagaagtaccaagaattcgtaacaccttgactggttctttcaaaccaacttcaagttttggtcagtcgttgatgcaacagcaggagacccgacaccagtcactgtcatcaaacttggcatctccagtcgaagaaaagaaacaagttcaaagcttgtctactggtgaaagagcagtttctcctcaacctcagcaacaacagaaatctgtcaattatgaagcgttaagaagtgttcctccacctcctccaccaccatcgcaaacacagccttcactccaaaaaagggatagtgctcctgtgcctggtgctgtttcttcaccaaatccttatacaccttcatcgcaacaaccatctggtgaaaggtctttgtcgcaacgagccccaagcagtagtaatgatgatttgttggcagaccctgctatttctgggcaattatcgcaagccacctctgatattgctaatgtttcaaatcaaataaaatcactcactagtcaaaccactaacttacacgaaaagaaaacgagagctgaaaaagaacttcaaagaattttaattactaaatccgagatcgaaaacaagttgaaacaattgagggcttcttatgacaatgaagtgatacaagtggaacaagttgaggcaaacttagcaaccgctaaagaagaaactgaagcattgagatcagaagcatctattgctgaagcaaaagttaactccttgtcgggtgagttacatgaaaaacaagtcgctatggaaagtttgcagaaagaaaatagtactttgaaagaaaaattgggcagtttgaatgcagagatagttgagcttgaaaagcaagctgcttccaaaagtcaggaaacccatgctttgtctaatcaagttgctgtaaagaaatcacaagttcaagttgccatagtcaagagtgaagaattgaagagtaagattgccgaaattgaagcttcgcataagcaattgcaattggacttggataatgctgaaagagaaagattggactcggaaaaccgtgccaaggagttgcatgcaaagtctgtcgagttggaacaaaataaaccaacaaaaccaagtgccggtataactgctactattggtgctgctgccgttggtgctgccgccgttgttggtggtggcgtggcaagtgtagttcatcacctttctgctggaagtactgaatcaagcgactctggatcaagaaatgaccccgttgaacgttctgttaaggaagaaactgagtctgataatgacgtagaagaaactaatgctaggttccctcaattacaagtcagtgaacctgctgataatgccacaaatacaacctcctcaaatatcacagatcgcgctactgatgatgaggaaacccctataacttctgtcttcacccacaggggctggaaggaaccgcgattg

SEQ ID NO: 466 - DNA, 1335 bp, Candida albicans
tatatactaacaagtcaaaaaatagctacccctacttttaaggtgggtcttacaccagaagagaaaaagttatacacacaattattcaaatcattggatcccgaaaataccggtgttgttactggtgagaaagcaagaaccacctttgagaaatctgggttgccaccttctattttgggtgaaatctggcaaatatctgatctgaacaatttggggtttttgaatcaatttggattttgctatgcaatgagattaattgggtatacacagtcaggacaacacccagtgccagggttagcagatgttcctggtccgttgccaaagtttgtgaatttgagtttaccacagcaaaacattttacagctacagtcgacaaacagttcgtttatgtcgtcacaaccaaatgcttctattccacaatcggctgcttctcaagattcttttgctgctgtttctcctaacgactatcaaaagttttctcaattgttcatcaagaccgttgggtctgctcaaggtgatttggatgggtcaagagcaaaagatattttcttgaaagccaagttgccaactacaactttgggacaaatttggagtttagttgatagatacaatactgggaaattgaatgtcggtggatttgtgattgcaatgtatttgatccaaggattgttaagtggacatattaaacaattgcctccatttttgcctgaatcaatttggaagtcagtcgagcaaccacaacagcaactgcatccagcaattgctgctcagaacactctgcaatctcgtcaagtgtctcacagttctattaactctcagctgactgcaattagacatccaactaccagggacgtatcatctactggtgaatggattgttactcctgcaatgaaacaacaatatgaatctattttcaataatcttgataaggaaaagaagggtcgcttaaacccagaccaagtcgcatcatttttaatgacatcgaagttgaaccagcaagatttggcattgatttgggatttggccgatattcagaactcgggatttttttcaaaattggagttctctgttgcgttattcttagttaacaggaaaattgctggtaagcccttgccaaatgttgttccagatgaattacttgtttcattaaaacaagaaacagtaacttcgcactcttcaactgttggttcgagtagtttggagttccaaccccaacatcaacaacaacagcgccaagtttcagacattcagaataattcagttcctgttcaatcacaatctattgctaaatcgaaatcctctataaacgatttggttgaatatttttgggagttc

SEQ ID NO: 467 - DNA, 435 bp, Candida albicans
gatgaagagtttgcccaagagaatgacgagtttggtgggttatctgaagatttcaccaactccaatgcaccagactttagtcgtccagaagaatctagtactgctcccttagaaggaaatgatgagtgggagcaattatttgcgggatttggaaattcgcaacctcaacaagaggagcaatctctgggtgatataccggcgtcaggctcggctcgggtatcggagccgcctagttctgtgtcggctccattgacacgcgacccgccaagatatgagtctcctccgactgcacaacctaccagaacatcttcaaatgagtacgctatacaagaattggtggggatgggtttcgatgaaaacacagcaatcgaagctttgaagaaagaagactggaacttggaagctgctacaaactatttattggacactgcttaa

SEQ ID NO: 468 - DNA, 726 bp, Candida albicans
ttattcatcatgggattgaaatgtacaaattattttgagaattcaaaatatgaatcccccaatattcaaattataacatgtaaaggttgttcatctcatttatgtctttctgatttaattttatccgataatttcaatggagctagtggtcctgcttatttagttgaagatttaattaatattgaattcaatttacaatcagaagaaactcctatgaaaactggtgtttataaaattaataaagttaaatgtcatcaatgtaaaaatcaattgggatggtattataaaaaatcttattcatttgctgaaacttataaagaagggaaatttgttattgaacggaaatttattaattttactgataatttaaccacaacacaattattaacggaaagagcattacaaaataaatttaaacgaagatatagtaataatagtactaatagtagtaccagtaatactagtaatagttcaacaatttcaaataattcaatatcagatttggaaattgatgaaagtggtagtcctcaacatgaatcatttttaactaaagaaaaattcaaattgttaaatagaagaagatcaagtggtactaatgggaatataaatgctacgttattaaatcatttaagaataccttatcattcgataagaaatgaaggcagaaatggagcagaagaagtagaagatgatgacgatgctgatgaagatcttaacagccgggtc

SEQ ID NO: 469 - DNA, 1050 bp, Candida albicans
caagaggtatatataatggattttagaaatttatcaactacaccgaatcaaatggacactgtaatgcaacgtcgtccttctctatcatcattatcgtcagcctcgggctattcttcttccaattatggtgggaatcctacacccaatcccaacaattccaataccaataacaatagtagtggcaatagtaataacaacactcatggcaataacactcccaaattatcaactcaaagattgacaaataataggaatttacaatccttgtggataaaccaaccatctattgctccttctaatgttgttccttgggtggaacagcaacaacaacaaacccttgatctgttggaaaataatactaaaacagactccagtaatgatgcttctgctactaataataataatgttaatgccaatgccaatgttaatgccaatgttaatgccaatgccaatatccatgcccaaacccatgtcaacacaaatgttaatgcaaacacaacagcaactagtattaatgcttccacgatttcaaatactacaccaagtattaatgacactaatgataatgccaaaaaaattaatgtttccatgattagtaataacaataacaataacagtaacaataataacaacaacactaacaatagtagtacaggaaattctaacattgtaaacatgcttccttctgtttctaatgcaacgacaatgaataacagtaacagtatcaatagtaccacaaacaatactacaattaatgaagctgatgatgacgagttaattcctactgcgattgtgattaaaaatattccatttgccattaaaaaggaacaattgttagatgtgatgacaaaattaaacttgccattaccatatgcctttaattatcattttgataatggtgtgtttcgtggattaacatttgccaatttcacatctacagatgagacatcagcagtagtaaaccaattgaatggaagagaaataggtggaagaaaattacgtgttgaatacaaaaaaatgcttcccgcccaaaaaagaaaaattttctaa

SEQ ID NO: 470 - DNA, 525 bp, Candida albicans
ttatcttggataatgacaagtcaatcaaatttaagtttaatagcagtaggtgttgtgtcgtttgtaacaggatataatgttcaccaaatgttaaaacatacatcgccgaaaagatttcaattgaagcgtacatcagcaaccactacgaccaaaagttataacagtgaagataatagtgaggacgaagaagaagaagaagaagatgagggattagatattaattcacttgcattgaatgagattccaggagaagtaagtatgacacttgtagtaagacaagatttgaaaatgggtaaaggtaaagcagcagctcaatgttctcatgctacattggcattatataaaaaaattactaatcctcaattagaatcatataatccagaattggtgaatcgatgggaattggggaatggtcaagccgaaatgactttacaagttccaaatcaagaagagatggatttattatatgcaaaagccattagtttgggtatcaatttcttcaccacgggcctggaaggaccgcaa

SEQ ID NO: 471 - DNA, 402 bp, Candida albicans
cattttcgtgggtgttattctttaatagaaaagagacaagccgaggcagccagaattgctcagaggttcaaggatagagtaccagtcatctgtgaaaaggttgagaattccgatatccccgaaattgataaacgtaaatatttagtgccagtggatttgactgttggtcaatttgtttacgttattagaaaaagaatcaagttaccaagcgaaaaagccattttcatctttgtcaatgacatattacccccaaccgctgcattaatcagtacaatctacgaagaacacaaggacgaagatggtttcttatacgttttatactctggagagaatacttttggcgagaaactagcaattgacatttcatcattagatttcagtgatatccctgattatgtttaa

SEQ ID NO: 472 - DNA, 1026 bp, Candida albicans
acgggagatagcaaccgagaaagaaaaagtctgtctccaacagtattgataccacttctcccccccccccccctccctacttcaccaactattcacaatactcacaaatctaacggtacatcaaacatgttatcatcatcaagtaaacctaaatttgctttcaatttaacgataaatgatttgactaatgttcctgaaattaatggatcttgttatattgaattacaaataagagatgggacaagaagatcattccatacttccaatatcaataacggtagcagtggtagcaataatagtaattctaatggtaaaaattctcaaaaatcaagtaccaacactagtaacaccaatggtattaaatccacacccatgactaccagtcgaacttttttaaataaatttgatgaatttgcttcatctttaggatctagtggatctaaggggaattcatcatcttcatcttcatcatctgcagtttcagggaatatatcagctagtacgtcgaggaaaaaattgcataatttcaaatgtaattttaattataaattaagttgtaatttgaaatttaatattaagaaaaagggaaatataattgctaataaatatttattattaaaaatattttatgtcaataatgattctgggatagtaggtggtggtaaatccaataattcaacttccacgtatcaccatcatcatcatacacaaattacagaattgggtaaagttgatattaatttatcagaatatttaaattttgatgaaccaatcactactaaatatttacttaatgattctaaagtgaattcaatacttggtgttactattggacttaatgaattatctccaacatttgatttccatactcaattacaaattcaagatagtaatagtagtattagtggtgggtccactagtatatccaataataccaattcaatgttatctcgaccaacaagtaccacaacatcatctagaagaaataatttcaatgtcccacaatttgaaccgaaacagtattaa

SEQ ID NO: 473 - DNA, 603 bp, Candida albicans
gtttcatttacaccaagcaaaatgatgaaaagtatattgggaagtggcttgattaataatatagccaagagttcattgaataaatcagtattaagaccatcgtacacacctattcgtttcaactcaaataatgcaaacttggaccaattgaaaagcatattcaatcaattaaacgaaaaatcaactactaccaatgattcacaaactaaatcaactttaaatatcgacgacttgttaagcaattcaattcttgaaacaagagaaagacctcaatcaaattcatttggtgtatatgacaagtttggatttgaacaaacaagacaaccaacacctcgtgaagttgctaagaatatccgtgaatttggtgtgaatgcaggtagaaccgttgatgttagttataataatatatcaagatcatttgctcaagtcaaaagagtagtcaatgataataaaataaggtatttgcaaagaattcaaagcagatttatccgtcctgccaaatacagaaaacaattgaaaagagaatggtggagaagaagattctctcaagggttcaaggaattattgcatgacgtcaacgatgcaagaagaagaggctattag

SEQ ID NO: 474 - DNA, 525 bp, Candida albicans
acattttggtcgtgtcaactctcaaaatgcgactatcaaaaaaattttgggtgtggttctttacacacgaacaaaaaatcgatatccatacaaacgtcgaagggttgttacctccacactttggaaatgttcagatcattagtcagaaaaacaacacccttgcttgcatttggggtaggaatagcagcgtttcccaaagattggagaaaaggtcaatttggagataaaaagttgttggtgatcaatgattcagttctagagcaaattaggtccactgataggtataaacagttggtcaacgaccctaatctcaaacattacaattccagccacgctttcccagatcaacatcataaaaattacgtgaataccgggcttttgtttggacccgatttaatggaaatagatccaatagtatttcttgatgaaaagaatggggagttgaccagtttttatcacttgggggataagctaattagtcaagatggtcaaattcataatgggattgtctccacaattttggat

SEQ ID NO: 475 - DNA, 1983 bp, Candida albicans
ttaaagctttttttgatacacccattcaatcaactaatcataatgatgccacaggtactaccaaaaaaaagatcggaaaaatcagatgaaagaagaataagtaccagtagtagtacaaatagttccaataatcataatcacactcctaatagaccaacacccacctccaataggattatggcaaatagaaaggtactgaaccgaattatgtcagcaagacacgtcagcaggtctatagcagaagatgcagacactagcaattcatttgacgatggaattggcttcaatgagaataagcataccatcatgtctaattttgaagaatggattaaaatggcaacagataataaaatcacggtcaagaattcttggaattttgatttgattgattattttcacgatttgaatgtgataaaagatggcgagagtataaatttccaaagggcatcggctactttagatgggtgtgtaaaaatatattcgaatagagttgaatcagctgccaccgaaacaggtaagttgttaagtggattaagtaaaaaagatgatgggcatcatggtaaccaagaagccggcaatggtgatgatgatgaaaatggagagaacggtgacgatgatagagatggcaatgacgaagattctagaaagaaaaggaagtttaatcgtattgttgagtcgacactagttgagtttgatgctataaaagtgaaaaaactagagcaagaattggctattgatccattatttaaaaaggcactagctgagtttgatgaaggtggcgccaaaagtctattgttgaatacgttaaacatagatgtatctggaagagtggtatttgatgcaacatcaaaccctattcaagagactgaagatgccaatcaaatagaaactgattcccaacaagtacaggaactacaaacatcagatacgaaacagtcagacatatcatcattaaagctgtttttgttcaaggataatgagaattttgacgacctaactctttgtccttcattagtcgagttccaatctgcattagcagatgtcaataaagctaaaagtatccttaatgactttaactcaaagattactaatgcagcacaagaaccacttgctttcaaagaatctgaagagaataatgactttgatcttggggactttaacgactttggtggtaatgacgacttcaatgatgatataaatactcatgataacagtagccacaacgatccttataataacattgataatacaatcatgaaagccttgtttaatgataaaacagacagcagcatttattcgcgaacacaaagcacagcaattatggaccaggacttgatggcatattttgatgaccgaatgaaatcaaattggcgtggtcctgataattggaaagttgctgcatttaaaaaggctaataatattgaccaaaagcagtctgattcctcagttaaacaagaatcatcagctcagacgtcgacagcaagaagaaaacctgagaatatcattatagattttttcaatgatgacgatgatgttgatgaagatattctttttgaaccaccaaagagtttaaactcgatactgaagaaaggtaattttaaactgtctgactatatactacctgatgacataaaatataactcagcaagactaaccaatttgtttacaaaacctcaaattgctataatgtattacggaaataagagattactaggaatcgatggacagctactcaccgatcaaaactatcttgcagaacaatatgggcgacgcgaagaagatgacagagatagacttgctaactcatttcatcaagctgaatgtgaagatttcgacaatgattttggtgataaccatgattttgggggagtagatttcaatgatgcattagaagccgatgtgccagaagtagccacttctgaaactcagagtgtcatgggtaagagacgtccagagtatgtcaacttcttcagagtggcttaa

SEQ ID NO: 476 - DNA, 1443 bp, Candida albicans
aaattcgagagagagaaaaaaaaaaatggttcgacttttattgtaaaacctttctttaaccacaccactgttatgctggaagaagagagtcaaaagacaattgggattgttggagcgggtctagttggttgcttggccgctttagcttttgccaaaaaaggatacgatgtcacattatttgaataccggccagatcctcgtacagttgattcgtctaaacgaaacttgagatcgatcaatttagccgttagtagtagagggattagagctttacagtatgttgatccagccatggcagatagaattttagagcatgtgatacccatgaaaggaagaatgatacatgatattaccgggacgaaacaggaatcgcaggtctatggcttaaacggcgagagtatcaattcgattgaccgttcgtttttgaacaattgcttgttagatgagttggacaagtcgaatgtcaagatattgtttaagcacaagttggtgaaattggataccctgaatgcgtgcagaatgacatttattgatggccacaatgatgccaagacctctacttttgattttgttgttgggtgtgatggggcccattcgcagtttagataccatttacaaaagacaatgagaatggactattcgcaaaaatatattgacatgcagtatttggagttgtatatcccgccaagtgaggacgctaacaacaagttttcaattgatgccaaccatttacatatctggcccagacacaactttatgctaattgccttggcaaataaggatgggtcgtttacctcgacttttttcagtccttggtcagtcatagagggtatatcttcgagccaagagtttgtggagttttttagacacaacttccctgatgctgtgggattaataggagaagatgctttgtcgagtgcattcaaatccaatccaagagggtcattgatgcaggttagctgttatccgtacagcaatggcaagggtattattttgggggatgctgcgcattctatggttccattttatgggcaaggtatgaattgtgggtttgaggatgttagaattttaatggaattaattgacaccaacaatggagacattgaagaagcgtttaagcagtactctgccgccagaaagaacgatttggacgctatatgcaagttggctctagacaactactacgagatgtcatcaaaagtagtagacattgggtatttgataaagaagaaattggactatacattgggtaagatatttaagaacaagtggttacctttgtatacgatgatttcgtttagagatgatattccttatgcaaaggcaattgagatagagaagagacagaatcgtattatgaataatgtggggctcggtgttttagggacagctgcagtttatgggttggtcaagttggggcaatattggaatcgcagacaataa

SEQ ID NO: 477 - DNA, 762 bp, Candida albicans
aagatgtggttatcaagcgtaattaaatttaatgtattggagagaataatttatgtttccaagaatttatcacgagaatatgattatgatagtgaagacccctattgtattcatccagtttctaaagaaaataaagtacgtgaacgtgttgtgtcgttatatgaattgaaaacgaaggcaaaacaatcttctggtggacatcttgaagcttataaacaagaagttatgaaatgtccggaaaataaccttttattttcttgttatgaggttgaaaatgataataataacggcaacggcaacaagaacgttaaacaaaagaataaagatcaaccaatgattgctacacctttagatatcaatgtttctttaccatttttaactactatgtctgatagtttaattatgacatcagccatagaagaagaaggttcagatctgcctcatacatcaagaagagggtcggcagtcagtatgactgataataatactaccccaagtatcaacaataaccctttatttccatttttgggagcagtggaaactaatggtgctagtataaatgaaattggtgatcatacattattccctgattctaattttcgacatattgaaattaaacatcgattacaagttacatttaggatttctaaaccggatctggataataaaatgcatcattatgaagtggttattgatacccccatcgttttacttagttcaaaatgtcaagaagattctcctcctccttatagttctgtatag

SEQ ID NO: 478 - DNA, 213 bp, Candida albicans
aaacatataaatgaagttggtgatcatacattattccctgattctaattttcgacatattgaaattaaacatcgattacaagttacatttaggatttctaaaccggatctggataataaaatgcatcattatgaagtggttattgatacccccatcgttttacttagttcaaaatgtcaagaagattctcctcctccttatagttctgtatag

SEQ ID NO: 479 - DNA, 1719 bp, Candida albicans
ttttttttttcccttatacttttacaaggaacaactacacaccaaacactctccagagacagtgtaataacaccaatgacagggacaattactcgtgcattgaattgggataatgtatacgagcagcagtttattgctgttacacccatgggtgatgaagttttattgtatcaaaccaaccatgaagacccaggcattgagtccaactccatgctaaaattgtatagtcgttcaggattcgaaaatatccagtgttcgtcatattctgatataaacaaaggtatagttggtgtggggtctatcaatggtaatatatctatatttgacatatattcaccaaactcgtcgattttgagtttgcgtccgaaacagaatcgaccttgtaattcagtgtcttttggaaaccaaaacttggttgtagcaggatttgataaaggaagacaagacaattcattgcagatatggaacattgagacatattcttcatctggtaacaatggtagtagcttgaaaagaccattagccacatatctaccgaatgaagcaattctttcaaccgtgttttatccggaccaaaattcaaacattatttgtgggtcctacaaatttctaagagaaatagatttgagattggatcaaccagtatttcaaatggcaacaaagtgcactttaggattacaaattgattattttcagaaccatttattccaatcgtttagtgaagacggatcactagctatctgggatcgaagaaaattgacttctactaaacatagatcgacgggaacaaacaacgttattacagaaactccaatactacaattcactaaattattgagtgatgcatcctcgagaaaagtccagcatccatgtgtgaggtattctacagtgagaaggggtgaatttgcctctgtatttaatggggatttgattagacgatggcaaaccgatatagtaccagaaagtaatgacatgtgtgattcttttaaggccaaggactcttctacgcttcaaagattaaagcaacaggctgtacaattgtataatccccgagaagagtcagtatttatgtctttggtgcttgataccaagactgattatgagaaagtggtttcatttgattattcccccgatattgcctcgcatacatcaacaaattttgtttgcatgcgacagtctggtaccgtgtttcgaatgcctgttgttgagtcaattgaagctttggattttaatccaataaacgagttctcgatagctggtcctgaaggtactgtaacaaattttttgaataaacagtttttggagactgaccaatcgactaactcccaggttcctggtcctcgtgacaggaatggttcatcattcatgaaacttggtgatttgacattgaatgataatttgaaaaatcgccacacggaaaccgcaacaacgtccacggtggatgatgaaagtcttgctcaactgaatattcctgaggacaagagatactcttatgataatgtatttgaggaagatattcctttgaataagttttgggattcatctgacattgtagggaatgacatctgtgttaccattagaaaacgggcacagatggggtatagtgttgattgtgacaaaaatattctattttggagaaactacatttggctgatactactttgttttaaaagaaaccttggaaattggttggccctaccaaaaaaatctttggattaa

SEQ ID NO: 480 - DNA, 1338 bp, Candida albicans
cgacaggtgaggttgttgtttgcaagtttggcaaaaacaacagaaacgctgggttatcggccaactaaagattacagtgattgtgcggtacaacatgcaaacaaaaatgccaaacttttagatattagtggaagagtcctgggctcattaaatgcgtcatcaacatttttaccaacaagtttgttgcaaatcgagccaccagaacctatttcggtgatcaagatgagtaatgtcggttttggggctattggttacaaatcgggaagattggttgtctgtgatattacaaggggtcctgctgtgatactcaatcttgaaaatataaaagaacaccttgtgtcagtacaaggaaactgctacccaacgtctattgaattttccattcaagaatatggcaatgacggctactcatccatagttttgttggtaggaacaaattgtggcggtaatctcgtgacatttagaattactccaatggggaatggtggctttgaggttgtttttgcagacaaaacagcacatttgaattacagaactactgatgccagtggagctgaagggtcgtgtatttcccaaataattccgataaactcagtgaccggtgagtctgcagttgcaaatatgagcacattcaacaaactcagtcagggaattgttattccagcatatgttattgccacctctgacagagaaattcgtgttctcaagctaccaaagcaaaagttatcacacaaagttgttgaggatttctgtttgaaatgcagtgttgtgaactatcacaataaaggtattgtattggccattttagtgaaatctgggtttgtcaaattatgttcgttgccatctttgtctgatatagctaatgtcaaattgcccaaggaggtttatgctcaagttaaagaatcacttgaatcaggaatggcaactcagtcagatttattacgttcaggtgaattatttgttaggtactctaaaacagaatcagtttatatcacgacaaatgaaaaaactcgccacaaagatgacacaaatacggatcgattgtttaacgaaaatgccattattccaccacgtccaactgcaagtacattactgtgggcaaaaggtcaaatcagttatgtttcagttgatgatttagccatgttggttgcgggaccaaaccgtaagcctccaaagaacacagagtcacaattggcatataatataagccctgaagctaatccacagagcaattacggaggatataacccgcaaaaaggcagagattctgacaaaggtaaaagttcgactccatatgaccaaccatcttaccgccgggctggagaatcaacgcttgcg

SEQ ID NO: 481 - DNA, 588 bp, Candida albicans
gcccatgacgatgagatcgaaaacccggatgtcgtccaagtagacttggcccgcgctgttgggcgtgtcgctaatgtggaagtcactgacatgtctgtcagcgggtctacaggcgaatactcagttggattgaagagcggcgaggttgtggtttttagatggggtagtaatggaaattttggccatgaggagcctccaggcacaaatgcaggagccggaaagttaactcgaatcacgcaccgagccgatcccgggctgaaacaaggcatgcttccgctcattcttctgaatatgcaacaggggcccgtgactgctgtgaagcatagccatgtgggtttcgttgctgccggttttcaaaacggcagctttgtcatcatggacttgcgcgggccagcagtcatccatactgcccaggtatccgattttgcgaagaccagcaaacgtggaagctttctcaagcaccgcgctactgaaagcacagctccggagtggcccacaagcattgagtttggtgtgttgaccctggagggtgaaggtaagatctatcctcttgagctatgggtgcaggctgatactgatcgtttatag

SEQ ID NO: 482 - DNA, 555 bp, Candida albicans
attgaagccatgccaacgaatcaaccaactaaatttgaagtacctgttgatctattaacccctgaaagctgtatatcatcatctcgaataagagcatttttaaaaagatccagaaatcttactgatgatactattcggccacatctaaatgaaattgaaaaatcaaagtgttcacagtattttgaagaggagatagtgccacaatggagagtacgtggcgagatcattgattattgttctaaatattcacaagagttacgagatcacacaagccaagggaaaactgttactgcgacaaagttgtcgtatgacttgcccaatgctgaagaaatgactgataaatttgatttgaggactgacccctatgcatataaaacttatcaaagaagaatagatgagcaatatgcacaatgcgatgcattagacaactggactcaaaatgaaaaaacggtcgaacaaattatcagacaacagaccgttgaggttttgaatgacaaatgtttttatcaagactggatgcaagcttttaaaagagcctccaatccaaagaaatag

SEQ ID NO: 483 - DNA, 393 bp, Candida albicans
acgcaagtgcggtccttccatgcccgtggtgaaaagcatcattattggaatgtgggatttttgaaatattggactcctaataatatcccaaattttattcttgtattaccagtgttaatattcaatatttattcattgggttatatgtatcaagaattacccaaaaatagaaaattattaccattgatcgttataaatggattaatagttgttgggggtacatttttttggaatattcaaatattaaatcgtatcacaagtttttctccattgatttattggacattggcttataatttaaagaaaccttgggctaaatatgccattggttattgcatagtatggaattttgttcaaactggattatttgcagcatttttacctccagcatga

SEQ ID NO: 484 - DNA, 729 bp, Candida albicans
tttctcatttatttgcttagatatataagtctccaaggaaaaagaaggaaagataacatggtacacattggctttcaaaaacgagaaagcttgatgattacaggggtagatttaatacgtcgtgacgagtttagtgcttcatattgggataatgccggaggagctagatgggcattttttgccatattcgtcatcttaataataatagtattattggggacattacgtgtgaacaagaaaagagctcgtcaggggcttcaaccagtttatggtactaggtggatgactccgccttcttatggacaatcacaacatcaatatgaccaacctgatcatcgaagagatcctgatttgcctagtgcttatgttccaacatatacagccacggcaaatgaatatgatatgggttattatgatgccaatggggtgttccatgctaaccccaatgctaaatcaccaataccccaaccaccaaaagtacatcaacgatcagaaagtaccacagttactgatgaaaattcacataatacaccaggtggtgctcctatagcatctaatttgcctcatgatttgacaggcaataatcagcatgttgatgataatgacagtattggtgatttctatagaccacctcaaggtccgccaccaaataaaagccttacgtctacatcacctgaaaaataccaatacaaatgcaaataccgagacaaaccaaaatcatacttctaa

SEQ ID NO: 485 - DNA, 603 bp, Candida albicans
tcacggactaattatgctatggaattacgaggattaggtaatcatcgagaagcatcatatcaattacagattgctgctaatgaaccgtataattacccacgagccatgtttttatatgctatggcacttaaatttggtcaaggggtcaaacaaaattatcgtcattcaataaaatggttaaccaaatgtatattattgagttcactgcatattaccctggctaatatttcagtagttcttgaaaaattgaatgccttgacaatagaagatttaattaaattaattatgaagaatttgaccaatacggtggataaagatcctcataaaaatggacaagatccattaatattatatcctattttcaaagctttaacgaaaaatcaaattgctaaagtgattaatatatcgaaaattaaaggggatgtagtagctgcaagttatcatgaattgggtaattatttaattaatggatggggggttactaataaagatgaaaccaatgggattaattgtctttcaaaagctggatcaatgggatatattgattcaatggttcaattgggcgaaatttctgtgtcttcaaacgccgaagagcatcaaagc

SEQ ID NO: 486 - DNA, 564 bp, Candida albicans
tgtgcaaccctcaattgcttcttaatttttcatccctttcttttaaatcgatacatacaaatatatatacaattgcatttatttccaacatcaatgattcaatatattaaaggtgatttgttcacacacgcaattccagctggtaaaaaagtaattctagcccatgcctgtaatacccatggatcatggggaggaggtatagcagctgtattccgaaagaagttccccaaatcaaacaacgagtacagtcaatattgtcataagaactctaatctattgggtacatctttcattattgagtcggaccagccaaatatacttattgcgtgtcttttcacaagtgattttaatcaaacaccagaacaaattgtccattttaccaaacaatcaattgcagacttggcaagaaaggtatctgactataaagaagtggagaaatgtgatggtaaagttgctataaatatgcccaagatcaatgctgggatattcggtgttccatgggaagataccgagctggccctacaagaatttgataatttgcatttcaatgtttatgtaatttga

SEQ ID NO: 487 - DNA, 801 bp, Candida albicans
  unsure (56),(139),(269): Identity of nucleotide sequences at the above locations are unknown.
aaaatgaaaattttatgttcaccaaccaacttgtgcaccaccgtacacactaacantaacacgcagcaaagatcccttaggaaaaaaaatacgagaatttttttcaccaaatcttatcttatttctttcaaatctaatnttaaatacattgaattaatagattataatatggcaccaaaaaagaaaggagtcgttgaaaaaccagttttattgggtagaccaggtaataacttaaattccggtattgttgggttagccaatgttggtanatccacttttttccaagcaattaccagatgtcctttaggtaaccctgccaattatcctttcgccactattgatccagaagaagccagagtcattgtcccatctccaagattcgataaattgtgtgaattatataaaccaaaaagtgaagttccagcctttttaactgtttatgatattgctggtttaactaaaggtgctcatgccggtgaaggtttaggtaacaatttcttggccaatatcagagctgttgattctattttccaaatggtcagatgtttcgatgatgctgatatcattcatattaatgatgaagttaacccaatagctgatttagatatcatcaaggacgaattgagattgaaagatattgaatttgccaacacttatttggaaggtgttgaaaaaattgctaaaagaggtggtcaatctttagaagttaaacaaaagaaagaagaagctgaatttgttaaaaaagttattcaaatgttagaagacggtaaaagaatcttcaccacggaatggaaggagccg

SEQ ID NO: 488 - DNA, 1227 bp, Candida albicans
acattgttgtcaagatctgcacaattaggtatttgttattcaatgtcgtctacattatcaagtaaagtagaaccattgaagaactggttgaataaaaactcattttggcgagaggacttgatcataaaggaatcaccttatggaggaattggggtgttcagtcaaggtccgatcgatatcgaagaagacccattattgttacgtataccgaaagccaacttgttagctcctaagaactcttatatttataatcttttagttgattatgaacctgaaaatcccgatatcatactatcggaagggatgtttggattagttcttacagtgatatatgagcttcagtgtcatgattcttcaccatggtttgaatatttacaaacgattgattttaataattcccaaatacccgtatgtttatgggacacagttgataaagataattcaaaaaatacccaattggatctattgaatttccttgaccctcaagaattgattgatttttatgtagaggccattagatttgctcataagaatctggatacattgccaataccgtcaatattaaatatagataacccagacttgagtccaaaactattgagtgagaaacataacgataaattaattgaatttggtaaagttattcaaagtgtgatttctagagcattcctgattgataattattaccagttggcattagttcctgcagcagatttattcaatcatttatcaccaaaaactaaagatgggaaagtaattgatcgcgaaaatatccactttgtttgtgatggaacagtttgtgaagtatgcggagaacaagaatgtgatcatgaagaggagggggaggtcgttgatgacgatgacgacgacgtcgacaatatcgaacaagagccacggaaaagcagtgatgattctgaaagtatcacatcaattagtatggactatatatatgaaatggagcaagacgaattgagtgacgctgatacagatgttgatccagaagaagcatccacattatccatggaagaagagattgcagttaatggagcggaccacgatttagctaatgaattatcagatagctcaaaatgttgtgatgttgttttgatccgcgagccacaagaacaacatgagtttgaaatttttaattcgtacggtaatgaactttctaacgcccagttattacaaaaatatggatttatagatatggacgacaacccccaatga

SEQ ID NO: 489 - DNA, 594 bp, Candida albicans
tcgaattatttatttgtctctctcgagtacattttttttacacccctgtcaatcctctttataaattcaatcatgtcattaacaatcaccaaggataatattttccctaaaggatatcgtggaagattaactgaaggagtgacatacgatgaaagaaataacaccttattatgggtcgatataattcaaggtgaagttcatcgagtatttgtagataataccaacatcaataccaacagtagttcttcttctcatgaaactttgaaatgggattcatcaaatgaatcaattggtgctatttgtttaaccaatgatcctaataaacttatcatttgtagtaaatatggtcttgcttatggagatttctcgagttccaccattgaatattttttcaaatatcctcataccactaatcctgatgaaaaattacgattaagatcaaatgatgggattattgatccatgggggaatttatggattggcgtaatgaatgatttccctattggtgctaaagaaggtattcaacccgaaggtaaattatatcgaactgggtcttcacctcgggactggacggatccgcccttgatgctagca

SEQ ID NO: 490 - DNA, 585 bp, Candida albicans
atcttttcaaatatttatccagacgaacataacattactcctactccccaacgagaacgtggcaggcaacatgagacgttatcctcgttaattgattcattcttgcatcgtagtgatcgtgagtcaaccacatttatgttatctgcatctaacgaagaagccatagcatcagcattgcgacaattgagtgaatcagaaggatcaacacttgctcaatcactcatggatctgcttggtgaacaaaagacatcgaagggggtcactgacgaatacttggatactttggaacgtattccagtaaaacaaattactgataaagacgcatcttgtccaatttgtacaaatcgattcaaagatgataagcatccattgattgtcagattgccttgtggtcatggagtcaatcatatttttgatttggaatgtgttgggccgtggttgcaaatgaattccacttgtccaatgtgtcgaaccaatatcttagaggtacaagctaatagaaggaaaataatagatgaagaaataaaaaaggcccaagaagaagattccgaggaagaagaacaaggttgggatatatatggataa

SEQ ID NO: 491 - DNA, 927 bp, Candida albicans
ctcttcttcctctacatgagtacagatatattttcaatatgcgctaaatgcttgggcgatgagtcacgaatcaagatgatcaaacaggtcaatggagatgagtgtcgccagtgtacccggccgtatacaatttatcgatgggggaatagaaaacaaggaaacaaaaccataatatgcatcacatgtgctagagccagacactgctgtcaatcctgcttgctagacattacttatggcattcctacagacctaagagatactgctttggagatggctggtcttgaaccattaacaaaatctgccaacccgacaaaccgtgaagtgaaagccattatggccgataaattggagactaaattcaaagagcaacaagaaagatccaatgatatattgtcgaaactagctgagaaactaaataagcccgaggagaagaaaacagaggttgctatagatgtggccaagctagcaaagaaacttccgtttgggaatctgcttgatgttcagaagtatccggatatgacaacgttttttgtatttgggtttctgtcggatttcccgcaggccattttttcgagatatgcggaacagtatgggaaagtagagtcggttgtttttagcagtgtaagtgggtgtgggtttatacggtttgaaaaggtgagttcagcagtggggtttgccaagtcgatcgctgaaaatggattgaataaaaataaaagtattgctggactattaattttagagaacacgccgatgagagtttgttttgggaaacaaaagccattaccccgaactgcagcagaccaaagaaagttgaatactgtagtcacaaaagtgatgaaacagttggcaagtaagagcaaggttggggtggtggtgaaaactaaacctaacgtatataaagctttactggaagactatgaagagtag

SEQ ID NO: 492 - DNA, 828 bp, Candida albicans
gaccaaccaatgctggaagaagaagttcacgacacgtcatcagaagcaagtgaggttttcaccaaccagccaaatgcatttgttcgtggtgttaggtctatttttggatacaggaagacttcgctaacgttgtttgttatattgaccattgtggttacggccggattatctttttatgataatagtttagagcttactattgagttgccgacgagccaattggagaaagagattttggagtcgtcgtggttggatttacagaatattgctaggtatccgcacacttatggatctcgtgccaacgaccaagtccacgattatttagaagagatcatccaggatatggagtacgacaatgatggagagaagattatgtttgaactggggaagggtgttgtttcgtattatgagagcaataatctattggttagggttaatggcagtgatggcacccttcctgcgttgcttctttgtgcacattacgactcggtgccatcgagttttggggtgactgatgatgggatgggagtggctagtttgttgggagtgttgaggtttgtagcccacaaccagccgagacgaacaattatctttaactttaacaacaatgaagagtttggattatttggtgcccatgcgtttgtcaaacacccctggtttaaacaggttggctactttttgaatctagaagggacaggtgctggcggcaaggcggtgttgttcagggggacagactatgggattgtgaagaactttggcggtgttaggtacccgtatgccacgtctattttccaggttcttgcaccacgggggctggaagatccgcga

SEQ ID NO: 493 - DNA, 624 bp, Candida albicans
tgtgagtcccaaattgtgatgtcgaatgcgatagattttggggttgttgacgattcggaggagcctgcggtgtacaccacttttttgccacgcccaatatctgccctagctagggttaatttggtgctacatgagcaccccgttgttgtcaagtataagaccatcactagggtcagaagtggtgatgagccattgttgagtggggaagaagagaggtacggcacagaggatgaacgggatactgagaaacctttggtggagcataactatgactggtcgttgcagtatttgcttattgtgccaatatcatcgttggtggtttacaattcggggtggctagtattagaaggagtcaataagactgtgcaagaatcactagcctctgaacaccttatctattggatagtggtggtgttttcccagtttttggtgttgcctgttgtgccatttattaccaagtttaatcggtatattgtcttggggttactggtggtggcggtggttggggtgtcgatgagtatggctgtgcacccgtttaaccaccgtattccgatgaaattgagatttatagagaagattagccacaatgatatggtggacgtttatgggagacaatggtctgtg

SEQ ID NO: 494 - DNA, 561 bp, Candida albicans
accggtgtggattgggggaatacgtggagtgaccagagacttgttacgatgatcgaggtgtcgtttgtttactgggtggtgttggtctatgtgacatggagtggtggcgaccacaccggtgagtttggggtaactgtgttattttttgttcaagccagtacgtcgttgttaggactaattgggtggaccttcaccagggttagaggtggtgatgagccattgttgagtggggaagaagagaggtacggcacagaggatgaacgggatactgagaaacctttggtggagcataactatgactggtcgttgcagtatttgcttattgttccggtatcgtcgttggtggtttacaattcggggtggctagtattagaaggagtcaataagactgtgcaagaatcactagcctctgaacaccttatctattggatagtggtggtgttttccccagttacttggtgttgcctgttgtgccatttattaccaagtttaaccggtatattgtcttggggttgctggtggtggtggtggttggggtgttttcttacaccaccgggctga

SEQ ID NO: 495 - DNA, 306 bp, Candida albicans
tgtctatcgtgtactaggactaattctcacggatattccggagagaagggcaactacatctacaaggaccgcaatgggatcagccagctagaattgtataagttggactggaacaaggagtatcttgttgggtttgagtggttgcccgatatcgatgatgaggggggtatgcaggtggaagtagagtgttattggggagttatggtgccggcctaccaggaggtggtgcattatagtccgaactgggtcacttgggcgaacaaagagagggggttagtaggggtagtgaagcatgtagatgtatag

SEQ ID NO: 496 - DNA, 645 bp, Candida albicans
  unsure (43),(55): Identity of nucleotide sequences at the above locations are unknown.
cgaccatcatccccgtgggggtcaataatggagggttggccanaaggactcgtgngaatatatgggagacaacggtttgttgaggatgtgttgctggatttgcccctggtgaagcaaacgcaagctaaacttgaatgtgaggcgttgccagatgggttggaggtgtgcaagtacaagagtgggctaaccccaggaaatttgactgtggaggtaactactgaaccaagagccgagtcgtatgggttgatatctggtgccataactattgctgcacccgaaaacagaatgtgcactgtgcattttccgccagaccgagtcaaagcagtggtggtaggcaagtttgggaacaattttaaggctatacccgatgggttttccacagagaagggcaactacatctacaaggaccgcaatgggatcagccagctagaattgtataagttggactggaacaaggactatcatgttgggtttgagtggttgcccgatatcgatgatgaggggggtatgcgagtggaagtggagtgtttctggggggatatggtgccggcctaccaggaggtggtgcattatagtccgaactgggtgacttgggcgaacaaagagaggggattagtaggggtagtaaagcatgtagatgtatag

SEQ ID NO: 497 - DNA, 1158 bp, Candida albicans
cttcccccccccccccccctaattatggctccacctcataagaatcataatttccgtccagaaaacgttttaaaacgtgctgaagatttaattgctgttggacaaaaggaagcagcattagatacattatatgaattaattacttcaaaaagaattcgttatttacaagttcaagatttagaacctattgctagtttattgattgaattagcagttgaattaagaaaaggtaaattagctaaagatgcattacatcaatataaaaaaaatattcaattactggaaaatgggttagaaagtgttcaaaccattgttcgtaaatttattgatttagcagaaaagaaattagatgctgctcaaactaaagctgatattaaaattgacgaagaagaaaatgctgctgctgctgctgctgctgctacaagtagtggtggtgctggtgctggtggtgatgcaggtggtgctggtgcaggtggtgatgatgatttagaaactgcacaaactccagaaagtattttattaagtgctgtttccaatactgattcagctgatcgtactgaaagagaattagttactccatggttaagatttttatgggaagcatttagagctgttttagatattttaagaaacaattctaaattggaaatcacttattctgctattgttaatcaagcttttaaattttgtttaaatttcaatagaaaagcagaatttagaagattatgtgaattattaagaactcatatgcaatcagttactactcaaactactactaaaactagtggtcataatgccattgatttatccgatgccgaaaccgtgcaacgttatttagatcaaagatttgctcaattgaatattgctgttaaattagaattatggcaagaatcatttagatcagtcgatgatgttcattcattaattactgcatgtacaaaagcaccaaaactaaataagatggctaatttatatgaaaattggcaaaaaatttttgctgtttctgataatactttatatcatgctgctgcttggaataaattttccattttatattctcaatcacttttagctactgatgaaaaaattgaaaagatatgcttcagtctgggttttatccactttatcaatcccacaaagagtggttcaagatgttga

SEQ ID NO: 498 - DNA, 918 bp, Candida albicans
ctactgatgaaaaaattgaaaagatatgcttcagtctgggttttatccactttatcaatcccacaaagagtggttcaagatgttgatgaacacaagagtaaaaattctaaattatcttcattattgaatttaactcatgttccaactagagaaggattaattaaatcgattttgtcgagatcaattttgaaatatgttgatgaaccaattcaacaattgtttgaattattagaaggtggtgattttcatccattatcaattaaacaagaaattagtcaactttttcaaatcattgaatccgataaagaatttaaaaaatatattcctactttaactgaagtcattttaattagaatttttcaacaagtttctcaagtttatgatgcagttaaattagatttcttgatttctttaggtattttccccgatttagaatattctttatcggaattacaagttgaagatttgattgttaatgctgttaaagatgatttagtatctttaactattgatcatgaatcaggggttgtttcatttaaatctaatccatttgatgaaattgatcaagaatttgctaatgctggtactaccaccactaacactctcaccaccaccaccaccattggtacttctagattacagatatcaccagcagaattggttcgtattcaaattagtaacttagctgcgacattaagtgattcgatttatttgattgatccaaattatgaagtttgtcaacaacaagttaaacaacaagcactacaacgttgtattaaagatatggttaatgaacaacaaagaattgctgatcgttccaagattttgaaagatcgtaaagttgctgctgaaaaacgtaaacgtgaagaagaagaacgtcaagcccctgtgttcaccacgaggtggaagatccgcgtc

SEQ ID NO: 499 - DNA, 750 bp, Candida albicans
aggaaaatgaaaaacgtaaaattgttgaaagaaattaatgctaaggggatcattaaaattgatttaaataatttgaaagaattagatacgacaaaattacaattgatgcaaattgaacaattaaataaagataaaaaagaattggaaactaaattacaagccacggctaaaaaagctgatcatttagaaagagcttatagaagatatgaattgaatttattagaagctgatttggaaattcaattggatttagaaaagaaagattatgaatttttgaaacaatcgaaaattaataaagctaaaaaagatcatgataatgctattgaattaaagaaaagattacaaagaattttacccgattatagtaaatttaaatcagaaattgatgccaagaatgaagttaaattgaaacaattacaaaaagaagctcaaattaaatttgaaaaggcaaaacaagaacgtattgaatcagttaaaaaacatcgtattgaagaattgaaaattagaaaggaaagagaacgtaaagctgctgctgaagaagcggcaagacaagctaaagctgctgaaatggctaaattgaaagaagaattaagaattcaaaaagaaaaagatgaagctttagcaagaaaaagagctgaattggaagctgctgctgctgccgctgctgctccatcatcatcaccaccaccaaagaaaacaatgacatttgctgaaagaatgagattaaagagagaaggtaaattaccataa

SEQ ID NO: 500 - DNA, 780 bp, Candida albicans
ctacgcatgtccttccggcccgtcggtgaagacgatgatgcttatgagttgagagatgaaattaataaagaagaaaaattgtggattttgaaacctagtatgagtgataaaggtcaaggtataagaatttttaaaacactcgatcaattgcaagaaattttcaactcatttgaagaaaacgatgagaatgaagaagatgaggaaggagtagacgaagaagataacggtataattttgtctcaacttcgtcattttattgttcaagaatataagagtaatcccttgttactatcaaagtatgaccataagaaattccatttacgtacttatgttgtttgtgttggtgatttgaaagtatttgtttataagaatgttttgaccttatttgctggtgaaccatataaattgcctggtgacgaggatgaagtagtatctttagcaggacacttaaccaacacttgtttacaggaaaatgaggatccgttggtggtaccattttggaaattacaaggtcttgctgataatgataaaaacattgtgtttgaacaaatttgtgatattacaaaagaattgtttaaagctgctacaagtgtcgacaaaatgaattttcaaccaattaataatgccattgagatatttggtgtagatttcttggtgaacagtgatttctccgttaatctattagaagttaattcataccctgattttaaacaaacaggagatgatttgaaagagattatttacgagttatttgacagagtggccactggaattagttga

SEQ ID NO: 501 - DNA, 783 bp, Candida albicans
ttttcgtttattttatttctgaaattctctgcacttttttctcaaaccacccccctactaagtattacaacaatgtttacaaagacattgaaatatattattctagccttccttatatcaacacataagacactaccatttgcctatgtgattcgtttctattaccaagctttccgtggattcttcgctcatagattccattacaatgctactaagaaaaattcctttggctatgattcacctaaggatttgttcacttgggtcacattgaattcctatgttactccattagaaatagatatgtacatgcataaactgaactcaacttactttttggatttggatattgctagaaccaagttgttgacaagattgtttcaaacttattggtggtcttgttatgataatgaaaatggcaagttcaaaaagtctcatactttggccaacgttccatacgtaccagtcggtactgtccaatgtcagtttaaacgtgaattgaaaccttttgaaaaatataaaatcagttcgagaattttagcctgggatagaaaatggttatttgtcatttctaaatttgtaactgccgaaaataaagttaacgcgattgctattactaaatatgtttttaaagtgggccgtcttaccattgccccagaggaatatcttagacattgtaactttttaaatgaagaaaatgaaaggatcaacgaaaagaattttcaattggttaaatatttggttgacaccgaagatatagagaagatagctgaagcagttacataa

SEQ ID NO: 502 - DNA, 423 bp, Candida albicans
attacaacggaaggcttgtttggtatttcttcatttatcagaaattttcaacctggatatgcaaagttgaagaaattgcagggtttgaaactcattaattttgataacaagaacaacaagtatcaattgagaattttatcattaatatcatccattttgagtaatgggttagacgatagcttgaaagcacaattcaaagaagcaaaattacctcactatttagcctcggtattgaatgaggattcaaacactagtttggtggacaaatctttaaacattgtttctcaattgaatcaattaaactatgagtttagcttagaagaaaaatatgaaataaatagaggaatccaagtggttgaagggttgagtgagaaacttaatattgatgatctcaataatgccaaacaggccacatcctcttag

SEQ ID NO: 503 - DNA, 1848 bp, Candida albicans
ttattacgagacatcattgagaccgaagaattaatcactcgtgacattaaggataatattaatcagaatcaaaaaaatattttacaattaacaaaagacttgaaagagacccaagaagaattgattgaattgagaggaaccactaaagaattatatgaagttttaggttatttcaaagaatcagctcaacgtagattagaattggaatttgaaccagaaacacaaaaagaacttcatctgcctcaaaaaagtaatcaattgggtattcccagtaataaaaagaaagatcgatcatcaattatggtgcttaaaaaaatgtgggattctcaattacaatcattatttaaacatgttgacggtgcatcaaaatttgtgcaaccattacccaatagacacattgtcgcggaaagtggacgatggtttgaagttaatgtggggaattggaaaccaagttatccaactcatttatttatatttaatgatttaattttaattgccgttaaaaaatcatcatctagtagtcaggaacctactacagggggaagtaatggtggttcaaaatcgagattacaagcggttcaatgttggcccttaactcaagtatcattacaacaaatcaaatcaccgaaaaaagatgacgataagatgtattttatcaatcttaaatccaaatctttaagttatgtatacctgacggatcgttatgatcattttgtgaaagttacggaagcatttaataaaggtagaaatgaaatgattcaaagtgaaagattattagattcaagactttcatctccttcaaataataatggagattctaaagaagagaaacgacaattacgggaatcattaagaaactcaggcaattataaagaaggagttactgatgatgccggtggagctgcaactggtggtggtaggaaaagtgccggtactcctaatagaaatagtactgattacgttttacatgatatatctgctcgagtacattcacgtaatcgatcacaagatttagggaataatttcaaattagctaataatgggaaatcacaatttttcaatgaaatcaaaactttagaagatcgattagatgatgttgacgttgaaatatcacataatcaatatgctgaagccgtggaattaatatcaataattgaatctaaattacgtaatattgaaaatgcattaactaatcaacgtaatggaggtaaaaatgtcaatattcctgatgaattattacttttagatgtatcaaaattgaaaattaaaaatcggaaagaaaatgtatctaatggattaatatttgatttacaacataatatagctaaacttaaacaagatgatattgataatattttgacgttatttgataatttagaacaattagatcgaggggttcaaggatatttggattcaatgtcagcttatttatcaagtacagtatcaaaattaattgttggtttacaaggatcaacgaaaatcgatgttgttaactatctttccaatttaatggtaattaatgtatcgattgtgaaacgtacaattcaaacttatgaacaaataattgctccaattttaaaacgtcatggtgatgttgattcaagtggattgattaattggtgtattgatgaatttactaaactttgtaaacaaattaaaaaacatttgtatggaacattgttgatatcttctgggattaatatggaaactgatgaaccaatttataaagttaaagaaagaaaattatatgataatttcttgaagattatgcaaccacaattggaagaattaaaactggtgggattaaatgttgattatatatttgattctatattaaatcttgaataa

SEQ ID NO: 504 - DNA, 1428 bp, Candida albicans
tcacaatcacagccatcttcatcccaatcactgcaacaacaggaagattcacaacaactacccgatgctgaggatatagaatccaccaataatcttattgatagcttaactacccaacaacaacaagaacaattattcaacaaattacaacaattacatcagctgcgcaatcaagatttcgtgtccgatgatgaaattacacaatcacacatcaccgataactccacctattatggcccgttgcacgacaaattttttttccactcgcaatcgcaaccacaacaccaccaacatcaccaccaacgttaccaaacactttcacaacaacaaaataagttgttactgtcggaagacggctcaaatggtatagatagtgaacaaaatacattgtgtcctgtaatccataacggcagctccactttcaatttggcgccagaaaatgctgatcaagaacacaaacacgatatagaactacagttacatttgaaacagcaacagcagcaacaagaaaaagaagcagaggaggagaaacgtcgtcgacaacaacagcaagaaagggaattatcattaaacaatcaggtgaggaaagggtattctttagattattttgatcaatttaataatgtgcataatggtataaacaactatcaagcatcggtttttgataatagatatttacaacctaattctctgttcattggtgaacaacaatctggtaaagcaagcttccatattaaagttgagttcaaaacagttgatttgtttaattcgatgattactgggtttttgcaaataaatggcttgactgataaagattctgaaattactacatatttcaaaggggaaattataaacaatccattgaatcattttatattgagaaataataacattgaaggtgactctgacgttggtgtgaatagttttgaaaatccttccatacaaaaatattcattcgtgacagaaaataaacaatgggggtcatttgctaaaaatgattatgaacattggaaaaaattgacccaatcaactacatttttatctgatgaagaattgataaaacgattagaaaaagtacaacgaggagaacaagatgatcaatatatttatatgagatggaaagaagaatttttattgcctgattcaagaattaaacaaataacaggggcttcatttgaaggtttctattatattgttttgaacattggtggtggtggtaataataacaatggccgttttggtaaaggtagatccttgtccacttcttcatcagcatcttcatcctcctcttcttcgtcattgtgtgatggattgttacctggtggtataagtgggttatattatcataaatcgtcagaaaaattccaatcattgtcacttcgtcatgttgatgataaagtagatgttggaacttttgattttgtttag

SEQ ID NO: 505 - DNA, 597 bp, Candida albicans
  unsure (92): Identity of nucleotide sequences at the above locations are unknown.
cattcaccttcacctaaagccatgaaccccgctgtttccaatattgttatcatgcttgttttgatgcaagtagccaataaattagattttgnagatccaattattttgttttacaccagagccgcttatcttggatgtcaagctttaacatttttgatttatttccttgttagatacaagattaatgccaagaatgatttgactactttgaaatatgttgaaccagctaacccaatgtctggtcaaactgaaccaagagctgttgttaccactgtcaaggaatacgatttacaacaagtcaaccagcaaattaaaggtatctttaccgggttagccatgatgtcatttatgcatttatacatgaaatacaccaacccattgttcatgcaaagtatttcatctttgaaaagtgctttggaatcaaacattgtcaaaattcacttatttggtgttccagcttctggtgatttgaaaagaccattcaaatctgctccaggattcttggaagccttaactggtgctggtggtgttcaaaccgataaagcatctgttgaaagtgctgaaactgccggtgctggtggtattaaacaagattag

SEQ ID NO: 506 - DNA, 225 bp, Candida albicans
tgcggatccttccagccgccgtgggtgaagaaatatcctcaaaaaccaattattattaatatcacattactgaatggtcataatttatttcaaactgctacaattaatggtacaattttagataatgataaatgggtcaatcggaaaattaatactgtgattatatttgaaaaatcaagtttttatattggtcaaaaattaagaaacaatatgaaatcattataa

SEQ ID NO: 507 - DNA, 753 bp, Candida albicans
gggtttttttctccttttgaattaattggagaattcccatcaaccaaattgcccatacctttaattagaatattttcttcacaaccttggccatgcatagatgttgaaattacaccgcggggaggcattgaagcttacccatctgcatcaactcaaggtcaagcaagtaagagaggtggagactcttctaaaaagttggtagaatggttgaaactggacttgtacaaactgaaacttcaaaatgtacatgccttggaaattggctgtcttagtccttataatgcaatatccacaagttcaatatttgatgatgttgttcgcattgatttgaattcccaaaactcattgatacttgaacaaaattttatggatcggccacttcctcagaaggaatcggaaaagtttaatctaatttcctgttctttggttataaactttgttccttcaccaaaagaaagaggagagatgttgcttcgaataaccaaatttttgaagaagcctaaacacgcaatgagtgccttgtttttggtattgccgttaccttgtgtttctaattcccgatattttgataacgagaagctaatagaaataatgactgcgttgggatttactcagactttttcttatgaaggaaataaggtggtatattggctattcgattggaatgggaaggtgaatttaaagaagaaaattccaaagaaagagttacactcgggatccaatagaaataacttttgcattacgctagcatga

SEQ ID NO: 508 - DNA, 1020 bp, Candida albicans
atcattttactcatagcctttacaatgatagcaccacctccagcaccaatagtactagactcccaatccgtcagtggaataactggttccatatctattgcttgttggattatagtttttgcaccccaaatatatgaaaattttaaaagaaaatcactggaaggtttatcattaacatttattgtattatggttagctggtgatgtatttaatgtacttggggcagtattacaaggggttttaccaacaatgattatattggcagtatattataccttggctgatattgtgttattatggcaatgtttagcttatggtgatgggaaaaaccctgatttaattcatttatctccagctaatccattaaatgaagatgtattggaaactgccatgtcaaatgaagaacgtcataatcgtcgcagaaatcaaggtaataccactgaagacttggaaagttcaacaacaagtgttgatagttcaataagtaaatcatcatcatcacaatttcaaagttttcttataaatacattaatggttactttagtcatagcatcaggagttattggatggtatatatcatacattaaagaatccaaacatcattcaaaacatcctggcaaacataatccggaagaattgatatttgatccattagcacaaatatttggttggttatgtgcatttttttatttaggttcaagaattcctcaaattgttttaaattatgaaagaaaatcttgtgatgggatttcatttatgttttttttatttgcatgtttaggtaatttgacttatgtgatttctattttatcaattgatatgagttggaattatttatgggttaattcatcatggttagcgggatctttaggtactttgggtttagatttcactatttttattcaatttttcctttataatgaaaataaagatgatgagtttagtgaatatgagtcttcaagtgaaacagaactggaatcattattgactagtagtgatagatcttatggtactgcttaa

SEQ ID NO: 509 - DNA, 1068 bp, Candida albicans
aataaagataaagtaatcaaacaaaagaaaatgctgtcaatagtttacaatatgcttacaacggcaggttctcctatcaccaccatacaaccatcaacatggaggacacaaattagtggagttatgggttcaacatcattagcatgttggatagttttattaatgccccaattaatcgaacaatggagattaaaatcagctgaaggaatagctattgggtttattactatttggtttatgggagatattttcaatttaattggagcattatgggcaaaattattacccgaagtgatttttttagccgtttggttttgtattgctgattttttaatgatattttcttatgtttattataccaagatatatcctaaacatcatcatcaacatcaccaccacgagcatgggcaaggagataatgaagaaaaccaccaccaccaccatcatcatcaccataataagagaaaaagtagaggaaatgataatgaatctagtccattattaaatactactagaagtagaagtagtagtactggccatggagatagtactcacaaaagaacaagaagaagaagtagtacattaactgatattgctttagaaccagaatatcattcaatttttattaaatatattttaccaattttatttgttattggatgtggaacattaggatttttcatcagtggtacttcaggtgaaaacaactcccccgatgataacactccaccttctcctcctcctagtgatgatattattgctattggaccacaagttatggggtattgcagtgccttattatatttgggtgcaagaattccccaaattattcaaaatcatcaacgtaaaagtgttcatggattaagtttattatttttccttttttcaacattaggtaatttaacttatgctggacaaattttattttatcgtaatgattctcaatatattttattaaatttaagttggttattaggttcattaggaacaatttttgaagattcattgattttcttacaattttatatgtatcgtgataataacaaggacgaagcaactgttgaataa

SEQ ID NO: 510 - DNA, 297 bp, Candida albicans
agaaaactagtttgccgtgcattctataaccctccattggacatcagtcaattggcaggctattactgctccccaatcgaaaacaaaatattgtatgtcgacccagaatctttatcagaaaatttgagtcaacgattcaaagaattgtttgaattggataaaagttggaactatgatgagtttattccattcattaaaaagtttgttcctgccggtaaaaaggtcgactcaattattttaaagtatggcaagaagaagaaagttggtagagatagatttatagtctgtcctagataa

SEQ ID NO: 511 - DNA, 498 bp, Candida albicans
catcttatacctctaagcaaaatgtcagagtactctgtgtatcaacagttgaatgaagatacaaacgcaactaaatatacttataaattactacagctaccatcaaagatactaaatcaacttgaatccaagtcaactaacttgtatataaaatctgatatcaattccctagcattatgcactgattcagaaactttcaagttacgacaaatgaaccattccaatacagtcttgctattgaacaaagaacctgacaacaagttaattgggtttcagaaaaccagttatgaatatgagttgacagaaatcaaaggttcgatcgatacgtccgatatccctattttcaacggacaaacagcacagcaacctattgatttgatagcattggaagataattcgatttgttcacatcaagagtttttatcgaattggtatgagttgggaggttgtgaaattgataatggagcatatataatgagtgcagatattattactgaa

SEQ ID NO: 512 - DNA, 870 bp, Candida albicans
atactgttaatctataacttcactataatggcacctacagaaataaaagggttttatgtgttgcctctcaagttaacaggtaccaaatcaatacattacatatactttaagaaacatgaactgaaaggcactgccaatgataacagatcattatttatttgcaacttgccaatatccacagacttgtctactatcaaaaaattttttcagaaagtagccataggatctacaatagaactgtttataaactcacttttgactgattatcctgaagacatatggattaatttaaccaaactaacatcggacttggatttggtcgacgctgttgatgaacaagcaagcaagttacctaaaaactgtggtattgtggcatttatagataaggcctctttcacactagcctttaactcattgaaaaagttatcatctagccttactgagtgtgaatggccaatacaacagttcacatcaaattattatttgaaacaatatcagaagcagatactagacccaaatagcttaacagaagaagtctcccaagcgttaatagattttgacaaagcagaacaacagtcaattgaagaattacaactgcaaagaaatttggttgatgaagatgggttcactttggtggtcggtagtcacagaaaaaccaaagcgggtattttgggcaaacagaaattagcatcaaccgttggagttgtgaaagctcaatccaagatgaagagtaaggaaaaacaagacttttatagatttcaattgaggcaacgaaagaaggaagaaatgaatgagttgttgaataagttcaaattggatcaagaaaaggtcagaatgatgaaggaaaagaaaagatttagaccttattag

SEQ ID NO: 513 - DNA, 1410 bp, Candida albicans
ttacataagatgcccttgtttagtgatcatgcatacacttccatcactataaaaatcaaccaattggctgatcccaagagaaatgacgaaattgatgactccatagaattgtacttgtctgatttgattgaattgataaaagtccagtctaattctggtgctgtagaagcagcacgagcaattcgaaagaaaatcaaatatggggatagtagggcagagcaattgagagccttacagatcttggagctattggtattgaatggtggtccctcaattggaccaattattgctcgtgatgataaattattggatgtgttgaaaggaattattaatggaacagcacgaacaggagttggtgttgaatatgattgtaaagttcaaaaaagagtggtggctatggctattggttggaagactgaattggatggattggatggttacaaatatatgcaatctttgtataaggcaattccaagaagaaagcgtgtttcctccagtcatctggggcatcgtgatagagatgtacatgataatgatagtgacgaaaattcggaggatgtgttagatccgtatgctgatgatgctcaactcgattctcatgcaagtaacagaaacgtttcttcgccacgtacaccaagatctccacccccaccaagaccctctactaaatcaccatatgcctctggcaagaaaaatgatgacaaagacaaaaagaagaataagaagaaaaagaagaaaaagagaggacttgtttatgctgatgaggaattcgagattccccaaatcaattacaaagttgaagcaccaaagattagagagttgatagccaattgttatactcatacaacagccttgaacaatttgttattacaattacctgcagatgagtcaccattggacaacgataaaactttggaagaatttgctaaatgtaagaagattagaagaaaggttttaagttacttacagtacgttggtgctggttcaccagaagccaaatcatccgaggttgctgctttagatgaagagtttttgggtagtttgattggagcaaatgaacaattggtagagtcgtttaagagattcgattttagagctggttattcaaaagacaatccagctccaaactatgatgatgaaagcgatagcgacgagagttattatacttctgaggagtcagaagaagaacccgacgatgtagaggaacaggatgaaaatctgatttctgctaggttgcagaatgccacattacaatcaaaactgccaccgccaccaagaccatccaaaccttcaaatttacaaagctcatttcaaccaagacctaaacttgacaaagttgaaaccagtgagtcaattgaaggcaatccttttggtgatagaaatgctgtaacgaaatccgtatatgattga

SEQ ID NO: 514 - DNA, 1131 bp, Candida albicans
tttttcttcttcctccaacaacgtacacctggaacgatgacaggcttgcaagacccacaagacaatgggaaaagtggaatacatatacattatccaaacaataagaaacctacatatgagatttccaaagagcatctactggagatgacatcacacttggaagcgctaccccagtttcaaacacttgaagatgagtcactggcccatcatattatttaccaaagcatggtagataaatacgctagtaataatcaaaacttcaaaaccaatcctcgactagcagatccaagaacgagaaacaacttgcttgagttaatgaaagatgtgtatggacgaaaatcgatattgtttgctcttgacgtcgaagcatgggagctagatacaaatattgtaacggaaatagggattgcaatttacgatcctcgaggccaagccgattccctaataccagctaccattcaacttcatattcgaataaaagaacacctagctagaaccaatgggaaatacgtgcctcatcacgcacacaatttcaatgggaatacttcttatataatgagtgagcgtgaagctgctacattgacacaaagtttgattaatttctatttcatctcagcagagagcaagggtactgggtgttatctagtgggtcacgatctaaaaggagatgtgaaatggatgaactcgttgggtgtgacgttcccatcacaattcaaatcgttggacacaaactacttgttcaggatatcgcatgggaaggaaaacataagtttaaaacgtgcacttgcttttgtccacataccttttgcgtatctacataatgctgggaacgacgcatactacacactattgttggccatgaaactatgcgatccacactcgagggttaggtacagattggatgtcttgataaatgtcgagacgtatccaacattgacaaaggaagagaaaaaagagaggaaaaatagacgccgtcaagagaaattggaggcaatagcaagaggtgaacatgtagaacaaaaaccaccagcaccaaaacaaacaacgaaaaagtccaataggaaaaaactaacatgtgaatctattgaattggagagcgctatagaagtctttgatgctatgtttaagtaa

SEQ ID NO: 515 - DNA, 945 bp, Candida albicans
actctctcgatgcttggacaattctttaactcggtgatatctttttccatactggtgacgtataccaacaaggatttaaaaaatttgcgagaaaaaaaaataattacaaatatttcatcatttttgtcaccaaccatgtttaaatccagtccattcaaaacatttgtgagaaccaaagttgaatatgtgaaaaacaccaaatttaagcctgtaaagtactcaaagtttatacccaagacatacacatttcacccctacgagcctgccaagaaagtggaaattacatcgagcttgcagcaattgaagaaccaagttaagtccggggatgagatcaccaaagagcaatatctcaatagccctcactttaaattccaagaaggtaaagaggggaattcattggcatatctaagacagtgcattagtttgataaattcagggaagccattgattgcgatggattgtgagtcgtacgaaagaaaccatctgcaagtgacagaaattggagtagcgattatgacttaccgaaagctgacagtaccgcaaatcaaaacaatccacgtggttgtaaaagaacattttaaaaagcgaaataccttatatgtgcccgacaagaaagatcaattcatgggtgggtcgtcatttgttatgactgaaaacaaaacgcgtatatttttacaaaaattgcttgataagtacgtagatgagatggacggtgtatttgtgggacaccaagtgtcgtctgagttgaaatatttcaagagcattggtgtgaactgtaaagcagacgttcatactatagataccatgaaactaatgcagttgagcaagtctgggggtaattctctatgggcgacattacgagaacttgagatcccatacggacatttgcataatgctggcaatgcatgcttactttacattgttagcagcgttgtcgttatgtga

SEQ ID NO: 516 - DNA, 1176 bp, Candida albicans
  unsure (1): Identity of nucleotide sequences at the above locations are unknown.
ngaaaaaataccaagatctgttactttctacttactaatacatgttctaaacatacacatccaaatataatgggagtatacataccaccaccgaacgacaaagattacggatataaaaagaaacaggataccaactccaacaccaaccaaccaacccccccctcatcatcatcaccgtcaggttctacaactatatatatcccaaacccagcttccttaattccacgaaatcccaaagttggtttaatatggggcccattaactccagcatctgataatttgcctgcattatactcgatgatcggtttacaatttgtaattggttgtgggtttttcaaatacgcccgaaccttatctcgacttcgaccaattggtgggttccaacaacaacctcatgctcacatggctccaaaattggtacgtactggtcccatttggaaaattgccttgagtgtgattactggatccgcgttatcatttggaagtggattggaattgtgtcgagtgacattaccgtatgatccatggtatgatgaagcacaacactatcgacgcatggcagtaaagaatggcgataaaccaagttcatggtttggagcatatagatattataaaccaatggattttaaaacttggatagacaaagttggtgattggattgaaaatgtcgaaaaggaaataaaaatcgatgatccagcaaattttgccaatctatcattggaattaggaaagaatagcaatgtaatcaatgttcaacgtcaacctcaaacaagtggagggatattaaacaagttgaataataaggggaaatacttggaaatttacaccaagttgaatgaaaataatacgaaaagatgggagaaacttttacatgaagatttgaatgaagtgacagaattgaataaggctccaagattagatttgatactagaagggaaatctgatttgatcaacccagaatttacaaaatctgccataatcttggggaaccatactatggatgacgatgatcagtttgaaatggtgtggttgaatttcgagccatgggatgaattgaaactagatacagaatatgatattcgtcttgttccaagctatgcaggtgccactgaagaaatagaaaacgaggatcaagagtctcctctcactgacaacgtggtggcgaaacagacctaa

SEQ ID NO: 517 - DNA, 537 bp, Candida albicans
acaatgccatctactcataatcgtgataaaccatgggataccccagatatagataaatgggctcttgaagagttcaaacccgaacataatgcttcaggtctacattttgctgaagaatcatcatttatgactttattccctaaatatcgtgaacaatatttaagaagtatatggagtgatgtgactaaggcattagataaacattttattaaatgtgaattagatttagttgaaggatcaatgactgttaaaaccactacgaaaacgtttgatccagctatgattattaaagctagagatttaattaaattattagctagatcagttccattccctcaagcggtgaagatattacaagatgatattgcttgtgatgttattaaaattggtaatttcgttgctaataaagatagatttatcaagagaagacaaagattagttggtcctaatggtaacactttaaaggcattagaattgttaactaaatgtcatatattggttcaaagtaatactgttagtgccatgggtccattttaa

SEQ ID NO: 518 - DNA, 285 bp, Candida albicans
tctcgaggatgggaaataagtttgtatctaaagaataacataatggccggagtatacgtagatgacatattaatctctgctgaaaccgttgaaaacataaatgaaattaaatcatttttagaaaagaacttcaaaatgaaagatttaaaggaagtaaaaaagtttcttggaatgaatataaatcaaacaactattatgaccattctttgtctacacattactcagtaccacgaaaaaaaaattcaacgtccaaaatttgtttcgtttaattgtgatcattattaa

SEQ ID NO: 519 - DNA, 591 bp, Candida albicans
tttttgttggaaagagcaactacacctggcaggtctttaccttctaataattccaatgaagcaccaccaccagtagaaacgtgcgataatttttcaacgacaccgtatttcttagcaacggtagcagtatcaccaccaccaatgataacaatgttaccattttcagcagatttgacagcagcatccaataaggatttagtaccgttggcgaatttttcaaattcgaaaacacctggtggaccgttccaaacaatggtcttagctttggcaacagcttgttggaacaattcgacagattttggaccacagtccaaacccatccagttgtctggaataccttcagcatcagtagcagaagaagttttggcatctttgtcgaatttatcagcagtgacaaaatcaactggcaagatcaattcaacattgtttttcttagctttttcaaccaagtgttcaacgtttttagcaccggcttcatcgaaaagagaatcaccaattggcattttgttcaagattttcttgaaagtgaaggccataccaccaccaacaatcaacatatcaaccttgtccaacaagttgtcaatcaattga

SEQ ID NO: 520 - DNA, 771 bp, Candida albicans
tcgtgggtcgacacaatgaaatcatttgtatcgaaatcatcactcacacaaatcatgagacattcacgaccaacattagttatcagcgattgggatgagacaataaccgaagaagatacaattaaatatgtggctcaagtaccttatataaaacaacgacaacaaagagtattaccaccatttgagaaatttgtggaatcatataatcagaattacaccaatttgaaaaactcgtttaattttccaaacactactacaactagtattgaatgttccgattatttatctcagcaaatcaaattccaagatgaactatccactgtcgaaaaccaatcaattgagctcattgaacaatcaaagatattcgaaggtttgaccaaaaaagatttccaggattatgttaacataaaccataataaaataaaactccgacctgggtttagtcagtttgtcaaacgttgtcaaaatttgaatatcccaataattatagttagtgctaattggacaagtattttcatcaaacaatgtcttgctaatcatggattggctgttgatgatattatcactaatgagttgagtttccatagtgatgatgaagaagcaaaaacgaaaatgactactacgggattgtgggataaatcaaaatatacaattagaacatcacaagataaattggatatagtgaaacaaatacaagaagaaaaagacggcctaatcatccatattggtgatagtgggatatcctcacccacggggctagaagatccgcgt

SEQ ID NO: 521 - DNA, 1107 bp, Candida albicans
  unsure (30): Identity of nucleotide sequences at the above locations are unknown.
attataatttacgtcgtgaagaattcaccnaaaataaaattctccagttgtaaaattttcaaacaaactttaaccattataaccattttattggcattatcaatttcaatttttattaaaagatatcctagtgaaccattcaaaccttataatgaagaatctcaatctttcactgcaggtatttggtgtgttcattttggattagataatgatatgtggtcatcggaaacgagaatgagagatttgattcgagatgcagaaattgatatcattggattattagaatctgacactcaaagattaattggtggtaatagagatttcacccaaaccattgccgaagatttaggaatgtacgttgattatggtcctggacctaataaacatacatggggtgcagcattattatcaaaattcccaatcattgaatctactcatcatcttttaccatcaccagttggtgaattggcaccagctattcatgcaactttagacatctatggagaattagttgatgttgttgttttccactctggtcaagaagaagatgttgaagatcgtcgattacaaagtttaggtatacaagaaataatgggtaattcttcacgaccattgatattattgagttatttagtgacagaaccattacaaggtaattataacacttatgttagtgaaaaatctcgagtttatgatattgataatactgattgggatagatggtgtgaatatattttatttagagatttaagaaaagttgcttatgcaagaatttcaagatctactattactgataccgaattacaaattgctaaattcaaattattaaatgaagatgaaaaaaatgatgatgatttggaattttattatggtaatcattttgttaatgaagatgaaattgatgagaatttaagaatgccacaactttttagaggtgatggtgttagaggacatagatatcatgtatttgatgaaccaagatattttgctcaacataaatggcaaagatataatgagcaagagcaagagcaagagcaacaacaacaagaagaacaccaagaagaagaagaagaaaacggacaaaatgaagaaggtgatgaatattag

SEQ ID NO: 522 - DNA, 822 bp, Candida albicans
  unsure (631): Identity of nucleotide sequences at the above locations are unknown.
acagaaacagaaacagaagtaaacgttgaaattgaaaccgaagtaatacctggtccatttgatagtcaatttagtgatattgatgtaattgttaatttgatcaattcattcatttattggacagtcgtcacgtcattatttttatgtgtttggtatttcccattatggcatatgggtatttcaggttatgaagccgctgttttatctttctttttggctcctttattattgattattccagtttctcgtaatttgtttgtgacttatccatcaattgctagaagtttgacggtgattttaggtgttggagcttataaagtccctgatccagaacaaagacttttaactataactgctggaaccgtatttgctgtaatttcagtattgtctgaattttcaatttttgccactaatcctaagaaattgaattcttatatttcaacatttacattaggacttttagctacttcaattttcaaatatttatgtttttccaataatcctatttggccaattatgcataaagaaaatggtggttataatgccattggtatatttttaggattattagcagcttttttcactcccaaacaaaaacaattatctccaaaagcaacaaacaatgaagtanatggtgcaaatggatcgttattattagctgcattaggtttcggtggttactatttctccctttcatcgtatttgtcggattctggtactttggctctttggacttgggaaagggttcctatcaaagggacaactccaataactggtgccttgtatcattttattgccattatgacagcaataaattattaa

SEQ ID NO: 523 - DNA, 927 bp, Candida albicans
  unsure (86),(143): Identity of nucleotide sequences at the above locations are unknown.
gctcgaatttcccatgaaagattgttcaatctggagaatttggtagattttgacaaaattgagcatatgatgggatggccattgtntggcttgggacttaaggggaacattaatgatttgtacactgaactttcagataactntgataaactagattccaaagtgacatcacattatcatatatataaagttgaggatataccaccagagtttcaatttggtggtgaaataactgctcataaatacaattaccgcttagccccaatctggatacttcctgacgttggatattcaattactacacataaacaaatggaagacaatgggtttcagtataaacccaaaggtgttcatgggtataataacactcacttgctaatgagagcaatatttttaggaactggaccatactttagaaacaaaaatttaaaagtggaaccatttgccaatacagaagtttataacttgatttgtgatacattagatattgtacctgctccaaataatggaagcttaccacatgaaatttggtctcaaaaactccctgatgaatggaaagatgatttgactttcccaaatttgccattccaagttgagcatattgttagaacaaatgcaacttatgatttgctttggagaaaaggggacgaagctaaaattgatcctgctccagctccaacaaataagcatccggttgaatctatgaagtcagaggagtcaactattacctctctagaaacagaatcgttgccgaaaccaagtgattttatttcgtcttcaactggcaccacaatggaaacgctgacaactaccaaagctcatgaaggatttggaaagattgtaggagatatcattggtggaattgaagacggctttgatgccattggtggtgtagtgcatgattttatagacgatatcttcaattga

SEQ ID NO: 524 - DNA, 1179 bp, Candida albicans
tttatttacccggatgacatttatggtctcgattttttttttccaacctgtttaatgcgttttgttgatgagcatcaaacattaaaatacaaacaatctccaaactccaaaaaccaaacatttagcatggctgaattgaaacaagttacattttcaccagaagtattggcaagaattgcacctgatgtatcattacaaagacatttagcattaggagtcagacctaatttacgtaatttcactgaattcaaaccagtcgaagtatctaacagtactcaattccaagacaataatgacaatgtattttcatcatcagtcgttaaaagcggttcaactactattataaacaccattacattggggattgttgaaaatttcaatagcaatgaatccgaatatgccactatttacccttgtgtggagatattacgtggaagattgggagcacccacagatgaagaaatgatattatcacaagatttatttgaaactttatatcataacaaaataattccctctacaagtttaaaaattaataacttagggatttctatcaaagatgaccagacgacgacgacttctcaaaccaactccaccatatattacccagatttaaatcctggacaatgggaatacatcaatcttacaagtcatcatcacaaatcatactcatttgtattgttgtcaaatataaaagtatattctaagagtacatcgacgtgttcattgtttgacttgtgttatttatcgatgcttgaagcattgaaatcgttgaaattacctagatgttatgtatcagaaagtttcactactaaagttgccatgaaatcacgaagatcgaatactagagggttggttgataccaataaagcaagtataaacattgatttgaataaatctttatacgaaaaaatcgatttaaatataaaaagtgggacaattgctagtaattttggggttatatcacatgaaggtaatacaatattattggctgatttagaaggtgaggctgaggaaagttcagtgttgtctcgtttatcaattatgacaaataatgatagtattaacaaaataagtttggttaacggtgatccacaaagtgaaattacattagaaatgttgaacaatgcaattgaaataagtaaacaaagaagtatagaacaagttcaacagatatag

SEQ ID NO: 525 - DNA, 354 bp, Candida albicans
atatcacacttgttctttctttatactatcattctcttatattcacatcttattggttctattcatgatatgaagatactatattcgtttttaatgctatttgtggtagcatttgcttcccttggtgacaatcttcctgagtttcaatcatgtttataccaatgtgattgtcatgtcattcctcaatcgatcttttggtcctgtccagcaaattgtaattactattgtcaacaattaattacagatcaacttgagtcactgaatgtaccaatggttcaattttacgggaaatggccatttaaaagagtgttaggggtgcaagagttttttgccatgattttttcaattaggtaa

SEQ ID NO: 526 - DNA, 717 bp, Candida albicans
cccaatgattcagtaccatcaaatttaaatattcaatttacaaatatctttgtggtgcagatagtgacaatgtgtgcatggttattttccacaatcttccatgtcagagattacattttaaccgaaagattggattactattttgctggattaaccgtgttaacccaattccatgccttgggtgctcgttatttcaacttgtataaacatagtcgagtcgtatatcgatggttgttttctttggcctgtattttggcatacgtatatcacgtgcaccggttatacactgattggtcatacacctacaacatgcaagctaatatttgtgttggacttctgcaaaacgtgttttattgtttggtgtgttttgggttatatgtcaaatattataatttggaacagactgaaaataaagtgatcttgaatcatttgaattatgtcgacagtcaacgaatcatcttatcttcatttttcaccagaagctctaaattattctcattatatccactacttttgtgctttattgttgtttgtggcatggcgttggaggtgtttgatttcccaccagtgtttttcgatttagtcgatgctcatagtttgtggcatttggtgacaatagttcccgtatatatgggctggtacgattggctagtgtgggatgtatatgagaacgtgtggtcaaacatacaagaggaggacaagaaaaagaaggagtag

SEQ ID NO: 527 - DNA, 717 bp, Candida albicans
caaagatatctcccgactatcaaaatggtctctaacatatggatagcagctgcagacaatcaaagacaaatagtcgaacagtatatcaattccaatgagtacaccccaaactcaaaagaacctaacggatatactgctattcatgcagccgcctcatacggtcatctcaatttattgcagtacttgatagagaagggaggtgatataaatatccaagataatgaaggtgatacaccgttgcaccatgttgaggatttgaaaactgcaaaatatatggtggagaaattgggagccagttataagatcaaaaacaatgatgggttaacggcacaacaatacattgaagaagaggatgaattccctgaagtagcacaatacttgaaaacattggctcatgataaacctattgctagtgaagaagaaataaaggccaacgagtttatagaatctttacctgctccaggaaatatcgatggtcaccaaattagatatagtttggaaaacgaggctgcacaagacggagaagaaaaactatcaccagaggaattggaggaaagaaggaagaaaattcaagctatcttggaaagtgacaatccagaggaagcattaagggatttggttaaaaatgctgttcatgaaggtatgagtcagtacaaacaagaacaacatacaacaggcaatgaagaggaaccttcaagtaaaagaagaaaagaataa

SEQ ID NO: 528 - DNA, 1554 bp, Candida albicans
gggtattctctagttctcattcgccgtggtttgtcgatatttccggcgggtagattgttgcagaacaacgaatttcgcttttttcagagcgcatcgcggaacaaaaaaagaaatctacaactcaaaagatacttccatagaactcatcccgacatactactaatgacagatatagatatcgacacaatcatcaacagatcgttgcatgcacttgagaattctgaatattctgagtttgatttattgttgaatcaattgtcctacttaattaaacaatcagtgaacagcaataacaagactgcttcaaaagaacaaatcacccgtattctagactatacaccaaacaatttcaatcaggttgaaagcttgaggctatatcgtggactacttattttagttagaaattttgccccattattggatattgatttgtttcccatagtggctaacagttttgagaagtttttgaaagcattaaatcaaacaagtgaatggacagacagaataattgaggtctattggcaaatactagccaatttccagagaaacgaatttacagaagtagcaaatgaattctttggtcaatgggaatctaaatataaatggaaagatataccagtgtcggtgatgctgccagttattcatttcttatttcgtcaattcaatacccaagatccacatataactaatgaaaatttgctcagcttattgaaactttttgaaacgaatcatgttatgaatgcagtttacgaaatttttacaatgattgattttgctgatactaataatatcggtcatgacaataaaatgtttattcaccttctttatgatattatcacccacgagagttttcaaaaatggattgaacagcaaaatgaagaagaaactattactaaatggctttctttgacttcagtgattgtgcaaaccaaaactgactggaataattatgaattgatagcattgctatcttggaatggttcattatttatgaaatatgccccattaatcaacagcaatcgcaacactactgtgaatggagaggatgatcttggttatgtagaggatgatattctggcaattattgctatttttgctgaattgagtcaatttaatgccactaaacaatactttgaacattatgaggatttattaccaaaattgatatttgttttcaagtggattcacgataacattgaaccaataacaataaaaagttcgaaaattgaagaagtgggaagatactcttccgtgaaaactaatataatcacaatattatcatacctcagttacgattcgtttcaatttcaagaaaaaataagagagctaggtggtctactgttggtgttgtctaactgtatcattgacaataataatccgtttataaaagaacaagcaattgtatgcttaaaatatttattacagaagaaccccaaaaaccaacaatttgtcgctgatttagaagccaaaaaagttgttgatgatcaagtattactggaagttggctatcaagttgaagttatagatggtaaagtggctgtgaaaagaaaatag

SEQ ID NO: 529 - DNA, 411 bp, Candida albicans
agagcacctgaaccagtgattgaaaagatagaggtaacgccaactaatgagaaacaatccaaacaagctacaccaattgagcagcatgatgatgtgcatcaagaattgaaagatccaacaattgattggattcagtctgatccaatagttgataggggttctacattcattgcatatgttagacaagtgaatactctacaagatgctcaagagtatttagatgatttattaacagataagaaaatagccaaggcgactcataatatatctagttggagaataaaaatggagaatggagttacattccaagattgtgatgatgatggagaaactgccgctggaggtagattactacatttgctacaagtatgtatcaataatgaaatattattacttcttattaatttctag

SEQ ID NO: 530 - DNA, 366 bp, Candida albicans
  unsure (329): Identity of nucleotide sequences at the above locations are unknown.
aaatggagaatggagttacattccaagattgtgatgatgatggagaaactgccgctggaggtagattactacatttgctacaagtatgtatcaataatgaaatattattacttcttattaatttctagtgaatttgtctatactaactttttttttgttctattctatttgaagatgatggatgtatggaatgttatagttgtggttagtcggtggtttgggggaactcatcttggaccagacagattcaaacatataaattctgctgcaagggaagcaattattaaagggaactttattgttgatgcaaatgataatacgaatggtantaccaagactactaatgcaaagaaaaagaaaaaatga

SEQ ID NO: 531 - DNA, 645 bp, Candida albicans
  unsure (40),(44),(54),(87): Identity of nucleotide sequences at the above locations are unknown.
gttacgcaggggacgcggatacttcatttcttggtgtcgnatgncataatgcanaataaattggtgccccgagaaagatattctggngataactacaatactactacgtatttcactgtcgaaagtgctcatcgtcctgcattatatttgcatattgctgttggattgttttctgtgtatgtattttatccaataagtttaatattcaataatttaaatatgggtaaaagctacatgaccatgttgttaatacattcaagttgtattgttttttcattgttgaattattcgattttcattaattcaattcccgatctatatccaggtaatgcctataatagcatggtaattatgttatttgtcaccacgattttgcaattgatttttgcctttatcaaaaacattgaaccaggagaatcggatggcaataagtatttccaattgaataatcaacatatgagagctaattcttctgatgaagaatcattacaatcaatgataagccctccatcgactgatgatgttattccttcagaaaaaccatcatctttcaagatgtcaaacttttatgataaagttatgaagtttagaacttgggttgctcaaacaaaattccacaagatttccaaaatagggtttaattta

SEQ ID NO: 532 - DNA, 888 bp, Candida albicans
attaaaggtggggtatttttcgcatatggattattatcattatcaagatattgtggtggattcactaataaaggttgggcatggaatcataaatttattgatagaaccaaaaagcaaagcttttggttttcgttacaaaacaaaggattatggacaatggaaatgattgaaagttcgttgattttattttatggctcaactaatattttcttggaacatttagccaatgctggaggtgaatggtcaccaaaagatttgcaacacgcttcaattgcatttattttcattggttgtggattatgtggtgttatcaccgaattaaaattacaagattggcgttatgaacaagcaatggctgatatggagaaatatcaataccaaggtgaagagcaaaatcaacaagaacttcaaagcaacacgaacaacaacaacactattattaaagctagtcccggttttagtcctaaccccttcccaattgtgactatatactggaccggtatattaatgtccaagcatcaacaagcatctagtttatctactgaagttcatgttcaatggggtaatatgtttgttttaggatgtgcctttagatttatcacctatttgatgttaatgttgaatgcaaaagtaccaaaagatttactgagaccaagtagaccatttactgaattagttgtcagctttagtttgttatgtggtgggttgatttttatggaactgactgaccctgtgattttgtcatttgaatattatgggttgacaagtatgtttactttgaacatcagtttaggttttactactttatttatgggatggcaaatgttattatttgctttcaaagattggttgaagagtaagtataataagcaacaagatatggtataa

SEQ ID NO: 533 - DNA, 438 bp, Candida albicans
ggatattaccaaagtatacatattcaatttatatttatttacctgtcaaaaaaacaccttattatcatgagaccaagtagtatattatcaaaaatccatataaagactcctaaaccggaattccaattatttcaatttcctaaattatcagaaatatcatataaagaattacctaataatggatttggaataaataattattatattcctaaaactaaatttaatcattggccagtttatatcaagattcaaaatactaaaatcactactgaaatcaaaagagtagaaggtgatttattaaaattacgtcaagatttattaaattttaatccgaattataaattaaccattaattcaactgcaggaattattaatatcaaaggtgatgttgttgaagaaattaagagttatcttgataaaaattctagttcaacttaa

SEQ ID NO: 534 - DNA, 1038 bp, Candida albicans
aaaagcctttctcacttgggtcattctagtagtagaatcattcgtttgtataaggaagacaagtatagtgtaaatttgttacaagtcaaagagtcacagatatttaattttagtatttttgatggccatgggggtgatcaatgctcgacgtacttggcagaaaacttatcactggcattagaggacctggaccaattggttgagaatgataacgaccgtcaagaattgttcaaaaaatacgccaagaatgttggtggatattggaaacggtggtataaacaccgtgataacactgttgcaaattgggagaaggaacgaataaaattaaagaattttctttctgatgatttagcaacaagagtgcctcttgcgtttttgaatgccgattacaactttttcagtaaagaacagaaatcaggttcaacatgtacgtcagcactaattgaaaccatttattccaaaccaggaaccttccaaccgttttttgaaaactattatttcaatagacacaccatttccaagttaagtattggtcatttgggtgacactagggctattgtagcggacaagaatgggttggctcatacactaaccactgaccaccatccactgaacccaatcgaagataaaaggttgagaaagtatgcagcaaatttttttatgacagactcctttggagaagaaagatttgttgcattagcaaacacacgtgcttttggtgacgttgattataaagaggtcggagtgacagcagagcctgatttcaaccagtatataattggtgatctggacgccatcaaacagtttttaactcctgatgaaatcgagaaatacactataggaggattaggtggagatgagagtttccttattttgtgcagtgacggggtaactaatatattaactgatcaggaaatcgctgatattgtgctcacacatgttaatttgaaaggtcaaactgtggccaccccacaatattgtgcagagcaagttatcaaatttgttgagtttgtgggaggtgatgataacgcgacatga

SEQ ID NO: 535 - DNA, 774 bp, Candida albicans
aatttgtttattttttattttttttttttcgtcgtttttttttttctttttgttatatcccctttaaactatcagcacatacacaccaacaccattatggccccaaagaaacaagctacggtagtgacagaacaggatatttcaaattcagataacgaacagcttgtggaattgataaataatctagtgaacacaaaacaagacgagttgtttgccaaatataaagctaaagttgagagccagttagagaatgaccatcagctaattgaggacttgcaagcggaattaaaagcaaaagacgacagaatagatgcgctattggaagagctttcgttgctaaaacaagatccgggcatggagtttgcctctcctatacggaagaaagcttctggcagattaaaccaagatgagttagctaaggagagggaaaacatttgctttacgttggatatgatagagctattgacgggggtgaaagttatcaattttgaaaacacctcggacgaatacatatttgacattaagcaatcgtcgtctgtgaaactgggacttactatgcactatcagttggtattggcgtctcagcccagcccggaaatcaattacattccgacgtttttggacgctctagagggagaggaagttgaagattatgaaaacgcaaagatattacaaaagatcttgccagattatctatgtgagaatttgtcgttcccattcgacactttggcacaattctacgggaaagtcaatcgagccttaaacaaaaagtaa

SEQ ID NO: 536 - DNA, 612 bp, Candida albicans
tttaacattaccataattcagaatgtgagagatggaaaaaaaaatggattactcattcaagcatacttttcagttttcgaatacatcaacaatcatcatcgaaacaccacaatggttaaatttttattgaaagcatcagctgaactatctaatgtcactggtttggaaccttctgacactccagaacatccttatgaatatacatttcaaatagaatgcacaaaatgccgtaccacccatgataaagacattcagataaatcaatacgaaaagcatgaaatcagtggtagtagaggagaagccagttttgtattcagatgtaaagaatgtaaacatgaacattcagcgagtatattgagaacaaatgagaaattatcaactactgaagatagtgttaatgataaagcatcagccacaatacttgaaattgatgctagaggaatagattttttgaaatttattccaattggagagttcctggctgttggatcagaaactaatactaagttcgcagatattgatttatctgaaggtgaatggtatgacgttgatgaaaaatcaaatgatgaggtatctatagtagatgtgagttgggaaatatcacgttcatag

SEQ ID NO: 537 - DNA, 483 bp, Candida albicans
caatttggtacagcccaccatttaactatcatcaagaaagtaacctccaccatcatgaatttcttgcgcaaaagaaggtcttcagaagatgaggatgatgatgacattttgaacaatgatcctaccagctctattcataaatcaagaaagcctcctaatactgcattcagacaacaacgattgaaagcctggcaaccaatattaacaccaaagtcagtaataccattattgatattaatagccataatattcactccgctaggcatagccataatttatacgacatacaacgtacaggatcttattgttgattattccaagtgtaacgaagcctcgaatagttatgaaaatatccctaacaagtacactcgatatcatttccgtggtcacagcgccaaccccaattttcaatggcgtttcgagaataacaacacggttgttaaaacaattcaatcttgctcaggactggagaggtcccagtaa

SEQ ID NO: 538 - DNA, 804 bp, Candida albicans
aacaattcaatcttgctcaggactggagaggtcccagtaaacttgtattacaaattgacgaatttttatcagaatcttcgtaaatatgttgaaagttacgatttagaacaattacgaggggaggctttgtcaagtgatgatgttactgataactgcaagcttttgagacatcgtgtatataatggagaggaaaaacttatttatccttgtggattaattgcaaacagttatttcaacgataccatatccaaccctgtgttgttgaataccaggaatggtgataacaacgagacttatatatttagcgataaaggaatatcttggccactggatcgtagtcacaagtttaaaaagacacagtattcaccagacgaagtagtccccccaccaaattgggatgagatgtaccccaatggttatacaaaagacaatatgcccgatttacaaacctgggaacatttgcaaaactggatgagaactgcggctctaccttcattttataagttatatggacaaaataccactcaatcaatgtctagtggtatttatcaaatcagtattaaaatgaactaccctgttgaaatatttggtgggtccaagagcatagtgataactacaaacaccatattcggaggaagaaacatgagtttaggggttatttacattatagtggcagtggttgccttggttttaggaattgcatttttgttgcaatacttgataaaacctagaaaaatgggtgatcatgattacttgcaagactcgaatggtggtgacataactacctatagagatcaattataa

SEQ ID NO: 539 - DNA, 1290 bp, Candida albicans
tcttcaacaatgcttgtaccaccagagaactttgggacggttgagtctggaatttacagaagtaccaaattagaaagtgaaaacttcccgtttttacaaactctcaacttgagatcaatggtgatattagataccgaaaagccaccacgatcattgaataattttttagaagccaatcccagtttgcagtttttcaatttaggtggaatgaaaatatctaatcatcagcatactggtattgtttccaaaggtgaccaagacgatgttgatatggccagaggcaccagtttatctctcaacacacctaaaaatttcttcagttctatttccttaaatcgtaaagatcaatggatgttaattgagaaaaatattgttatgaaagcatttgaaataatgtttaataagaaaaattatccattacttattattgatagctctgccactttaattggagtgttgagaaggatacagaaatggaatttcaattcaattcttaatgaatatagaatatattccggaatgtctacgaaaaataactattatgcagaaacttttcttgagttagttcaagtggaattaattgcctatgaacatcatagcacaagtagaagaaattctcgaggaaataacagcatgtgtatgagatcaaattcaatcgacactgataatggtgaccttagtgaaacaagtgatgtgaataatttcgatgacgactacgatgctattgaagatgaagatgatgaagatttggatgatttggacgatgaattgctttcggcatctccgcagattccggcaaacttgttaaagctagttgaacaggggaacaatagtaatagagaaccaaagaaacggttaagttctgtcgaggggaagaaaattagtcaccccagaagcaacagctattccaattctccttcattcagtggtgatcatttcttgagtgcaagaagtaaccgacgcagatcatctacacaagagaatagttttaacgtgtacaaaaatctaaagttcagaaacagtcatgccaaatccccctctggtgattatatcagtacttctcctacattgagaagaaaagagtcgagaaataatagtcaagtggaatttagtgaacttactgatttcatgtattacaagaatttgcaaaaataccctaaaactttcgaacatgttcatgtattaaagataaagctacctgccgagtacaagctacctgattggtttattgtttgtagaaatgcttgggaacgagagttccaaaggttgaatagtgaagaaaaatactaa

SEQ ID NO: 540 - DNA, 834 bp, Candida albicans
caaatcaaatcaattcaattcaattcaattcaattcaattcaattcaattcaattcaattcaatcatcccttgttcttccttcccacctagtagcaaacacgcttagtctaatgagtgatttaaatatatttataacttctaatttaacttcatcagaaagaagaatatcacctcaatggaatttgaaatatttaaaacaaaaattagaatcaatcactgggatttcacctcaaaatcaaattttacattattatccaaataattattctaatgaatataaattgattccccccattaatggtagtactactactgatgatgacgatgatgatgaacaaattttattatcatcattgaatttacaactgtatagtcgaattcatgtaatagattctgatcctaatagtgatgtcaataaattacaacaacaacaccaacaacaccaagaagaagaagaagaaaagtcggaaatcgaagaaggagatgtcgctggttttacagaatttcaattactggaagaagattataaaactcgtcaaaattctgttttgaattggaaaaaaatcaataaattgggtcgatttgatcctcaatttcaatcattacaagaaaaattacatcatgaaacagaaatgaaattgaaaaccatgtcaattggttcacgatgtcgattaattaatattgaaaataatgaaagacgtggtatcattagatttattggcaaaattatgccattagataatggagaaaatgattgggttggaattgaatttgatgaaccagttgggaaaaataatggtagtattgatggtgtgaaaatatttgaatgttaa

SEQ ID NO: 541 - DNA, 801 bp, Candida albicans
agactttcattagattggctaccaccatccgtgaccaatattgaagatccattcaaatttgcaagttctacttatcattcagaaattcctcaaagtattctacaaaacaagactgaaccaattgtacttggtgttgacgaagctgggagaggaccagtattgggtcccatggtgtatgggattgcatattctctagaatcatttctgtccaaacttcaaaaagaatatggctttgctgattccaaagtattgacagatgtgaaaagagaagaattattcaagcaaattgaggatccagatcatgaattgcataaacacattggatgggctaccacaacgatgaccgctagagacatttctagtggtatgttacagtcagtaaatggtaaaggagcttacaatttgaatgaacaagcacatgatactactattaacttgatcaaacaagtattagctaaaggtgtaaagatatcgaaaatatttgtcgatactgtgggtccgccagtaacgtatcaagccaaactaaaaagattcttcccagaaattgatgtcacagtaacgaaaaaagccgatagcatttacccaatagtgagtacagcctctgttgttgctaaagtcacaagagatacaaacataaagttctataatgaaaacttgccacttttacaaggccaaaaattgggttcaggttatcccagtgaccctaacaccagcaaatggctccattccaacgttgaatcaatgtttggttgggtggctatggctttaataaattttcctgggaaaaccggaaaaagaaat

SEQ ID NO: 542 - DNA, 1230 bp, Candida albicans
tccggtggattttatggtttacgtaaggaatcgaagctgattttccatgccaaatgtcgtggatcaaatggacaattggatatggattttttgagaacaggcttattggggttcacttttaatgggaaagtttatgttctcggattgtatgaagatagaatcagacaaagagtgagttggattgatcaagcattgtatcaaaaactacatcgtgatcttgttataggtaatggctccaggtatcattattcttctcatttgcttgcaacattggcatcagaagttaaacaaatttatgattgtacgattttcgatattttcattggtaatgaatatttaccagtagctattgttgaagctgaagttattcggaaacaagttgccgacgaaactgctggtgctgaaggaggtaatgccaaggcgagtgaatctgtccatgttagtggagtaccacttaatgaacccgtcttgaatgctattgctcaaaaatgttttgatacattatacaaaagacattttttgagattatattgtgttgtggttgtcgattgtgataccttgccgaaattactaagaagtggtggtagagaaatcgccaatatgttgtgcaaaaagaaatttcttgaaggttcattgaaagctgattttgtaaagtttttcattagaaaatccattagtatgatcccgcatggtgaagatgtaattggtgggatttggtctccgtatgtttccgaattaagatctaaagcacttgccaatttcccagatcaatattctacaattgattatcgtgaaaaatcaattaatgataaaactggcgctcccttgactgatttcaaaaccattgttgatattttgaaatttagagtagctaaatctggtgattccattgcatttcaaaatgttgacaacaattcgaaaagtaaaccattaacttggaagaaattagagaatcgtgcttatgctgtatgtcaatatttaattgaaaaagccaatattaaggcaggacaatatgttatattaatgtattcattatcagaagaatttgtcattgcggtatatgcatgtttaatgtgtggaatcattgctgttccgatgttaccctttgattccaatagaattggtgaagatttcccagcatttgttggtgtcattagagattttgatatatcagaaatcttagttaatgatgaagtcggagaaatttttgaaaaatgggcctatagctga

SEQ ID NO: 543 - DNA, 858 bp, Candida albicans
ttaatgatgaagtcggagaaatttttgaaaaatgggcctatagctgattcattaaaaaaaattactcataaacgagtgaaatctttgaaaattaaaaataccgttaaattaactaaagtttctaatatggcgtcattaaattcaaagattgctagttatcaagcagaagtgaatttccgtgatgaaaacactaccgctttagtatggttaaatttcacttctgatcattatagagtgggggcaactttgagtaataaaaacattattggggtgtgtaaagtattcaaagaaacttgtaatttaagttctcaatcagcaattataggttgtgttagacatacttctgggattgggtttttacaagcttgtttattgggtgtgtttttgggtacaaccacttatttaagttcaccagtcaattatgctgaaaatccattatcattctttttattacttgctagacacaaagtgaaggatgtatttgttactgaacaaatgcttaaatatgctgccattaaattcacccccaaggggttcaatttatcgaatttgaaaaatatgatgattagtactgaaaatagagttgaaattgatttatttagaaaaattgctaaagtgttcctgtccaccaaacttaatgcaacgtcaatgtcaacggtttataatcattatttcaacccaatgatttcttcaaggtcttatatgacggcggcaccggttgatctttatatacatcctatcgctcttcgacaaggttatgtatcagtggtgaatcaagctgaagttcctaatgcattacatattcatgatgctggtatggtacctgtgtgttccgaaatagtcattgttaatccataa

SEQ ID NO: 544 - DNA, 951 bp, Candida albicans
tccttatatggattattaaaatattttcaagattttctttcttttttcttttatattacatgtcaaactaattctttaatgtcccattcaaataataatattaatttaaaggtgcctggtaatagtttatcaggttccaattccaatcatggctcatcctcttcagaccgtcataataataggcacagatcagtatctgctgcaagtttaaatccaaccacaggaactttaataactggtgaattaaatgaaaccgatccgtcaactaatatcactccagatataggtggtacttctggtgttggtggtgatataccaccagatatggcaatattgttacaaaaattagatgaagatttcttagtgaacaaagtgattgatcaatggacttttatcaatagaagagaagaaattatgcaatcaataaatcggttacatcaaaagcaaaatgatgatttgctcaatttggatcccttaaaattacagatgcctttaaatccaaggatgtcaactggagatttcctgaaaattagtcccgacaatttgatcgacatattaacctatagagcgaatacatacaaatcagaattagcatttatagtgcttgatgcaaaaggcaaagaagttagttcgatcagttgggagaaattatatttgaaagctgtcaaagttgcctatgaaattcaacataaattgactatgaagaatagtgacagtgttgtcttgttgtataaagatggagaagtcactgaatttgtggtagccctttttggttgttttatggctggggtcacagctattccaattcatcaagatatttctttaacggaagttttgaatatcatcaatttaacatcaacaaaattattactttattcggacaccgtggcgacagaattggatagattaagtgttcagaatctgagaatcaatgggcatcgaaactattaa

SEQ ID NO: 545 - DNA, 1500 bp, Candida albicans
cttattcataatgaaagattctatatcacgatgtctataccagggtttgggagtgctgaaaaagtaaaccatacagcatcaagtgttacattgacgattcctcagagctatgaatggcggatagaggttcccttcaatagaatactcaagttcaaggttttaactggaatagtggaaataaatgggaccgagttagcaaacaatacagaaattcaattatccgggacaaaaacttacttgtactcgccagtaactgatgcggtaattgagtacgttctagtggaaaacaaagacgatttatcattggtttccgcttctgatgaaggttttgtcgaatacttgagtgacgaatccaatatggattccatattgaacctacatatgtatcttgaaagcaagagacagtacacaaaagattacaatttttcaagttctattgaccagcaacaaagtggtccaaaagtgttgattattggctcaaaatattctggtaagacaactgtgctgaaaatattatcagcgtacgccaacaagatgaacaatacacctgtattggtgaacttgcaacctcgagatggggtttttgctttacctggatcgttgactgcaacacctataagtgactcttttgatgtagaaagttgcaatggatatggattaacaacaaccagcggaacactagtacacaatcccaagcaaccaattgttaaaaactttgggatggcagattttaatgacaatgtggatttttataaattgctaattgagaagttgggcatagcagttttgtctcgattggatcaagacttgaatattaaaaatagtggagtgattattgatacaccggctttgactctgaagaattttgatattgttgagagtatggtgtctaattttttgattgacaatattattgttattgggaatgaacgattagccattgagttgaccaagaagtttgcttataaatcgactcaattgaacatcattaaattaaataaactgtcaggatgtattgaagttgaagatagatttattcgtctacaacaagaacaaactataaaagaatattttaatggaaatttcaaaacaagattgtcacccttcaaaaccgatattgagttgctggggttgaagatttataaaaatgtattgacaaaggatttgctttctcaaatggcatttttgcccggaggagacgatttcgagaaagatgaaaccaatcccgaagaagatccagaaaagaaacagttggaaaaatattatcaagcaattgaagatcccaacagttcaaatttagagaattcgattgtggccataacgcatctaccaaataatgataaaaaactaggaaaagatttactaaacacaagtgtcttagggtacatacatgtgagtaagtttgatgatcagaagaagcggttgaaagtgttgtttccatttcccggtgtgtttcctaaaaatgtattgatctctactaatataggatacaatgaataa

SEQ ID NO: 546 - DNA, 1494 bp, Candida albicans
tatgatttaattctttacactttatttattagacgcattcacacgactcactgtattgtcaaagtcgtgtacagagacaaagagagagaaagagaaaaaaaattattgccatacaaaatcatctacctcttctctccaccatctcatctcatcgctagtagtattcttttccatttaatacaaagactatacataactggttcaaaaatggtgttatttgaagttaaaggatgggatttgaaaaataataataaaatcaaagtaggtggattacctgaaaaaaagaatagaaacaagaataagaataagaacaaaagagaaccgaaacaaattgataatggttcaaatataacaaataatgaaaccaatgcaaaaccatcgaaatctgataaagataattcaaatccaaaaaaggataaaaagagaaaacatgaaaatgaagaacaacagccagccgaagatcaacataaactgtctaacaaacaatcaaagaagcaaaagaaaaccaatcggacggactcaaatgaaataaagaatcaatctagtgaccaatcattaacaaattcatttatatcatcaaataaaaaattgactccattacaacaaaaaatgatggccaaattatctggatcaagattccgttggataaatgaacaattatatactataagttcagaagaagcattaaaattagttaaagatactccatcattatttgatgaatatcatcaaggttttaatcaacaagttgcttcatggccagaaaatcctgttgatgtatttgttgatcaaattaaaactagaggtaaaaatagacccgttaatgcacctggaggattacctggtttacaaaataaacaagttgttattgctgatatgggatgtggagaagcacaattgagccttgatgttactaattttgttaataattataataaaccccagaaaaagaataagaaatattttaaagggttggatattaaagttcatagttttgatttaaaaaaacaaaatgatagaattacagttgctgatattaaaaatgttccattacctgatgaatcatgttctatagttatattttgtttatcattaatgggtactaatttcttagattttattaaagaagcatggagaattttaataccaagaggggaaatatggatagcagaaattaaatcacgatttagtgaaagtagtgaaatcagaaatcaaaatgaagaattaattggtgaagaatttgttaattctttaaaagcatttggattatttcataaactgaccgataattctaataaaatgtttactagatttgaattttttaaaccaccaccagatattttacgtgaacgtcaattaaaattggagaaaaagaaaaagaaatttattgaagatgatgatgatagaactgatattgaaaaattggaaagtaaaagatcggaaaaagctgaaggagaatggttattgaaaccttgtatatataaaaggaggtaa

SEQ ID NO: 547 - DNA, 837 bp, Candida albicans
attggatttctgaaagttgcctactatagcaaaatgaactcatcatatacggcaattgaaccagatgaaccgttagactcaccaccttcatattcagctaatgatcataatacaacaaccaacacaaccaccaacaatcctctgacacaaccacatgttaatcaaccgcaagcagatcaaccacaacaaccaggaacttcttctctgtctgaacctcgaactttgttacaaagattgaaagaatcatcacacccaatagcattactattttatatatttttccgagtatcaccaattgtcacatatatatttggaaccatagtgattcatcaattcacttccaaaaatacatttatattacattttattgttttgattttgctagtagatggtgatttctggaatttaaagaatatttcaggacgattattagttggattacgatggtggaatgaaaccactttaatagaaagtgaaaatggaaatggaaatggaaatgcaagtgggcaagttggtgaatcagctaaagattttgaaaatgtttgggtatttgaaacggctgatcccaacagatatatcaatccaattgattctaaagtgttttggcttttattatatggacaaccagtagcttgggtagtgttgggagttttagcagttttaaaattgcaatttttataccttttgtttattattgtcgccacttcattatcaatgactaatgcaatggcatttacaaaatgtgataagtttggtaaggcaaataattttgctaatgatgtgtttacaagagctgctggatcaatgtttaataattttaatccatttggaagataa

SEQ ID NO: 548 - DNA, 873 bp, Candida albicans
aatcaagaatacatcaaattcctcttctacacaccaacaacaataatgtcacaaacctcaagttttgtcaagaaactagcatccaatgacaaaccaacaagagattcggcattggaatcattaaagaatttccttggttccaagaaagatctatcattattggatttgaagaaaatttggaaaggattatatttttcaatgtggtattgtgatcgatctaaagcacaagaaagattagctgaaaacttgggtaaattatatagtgaaacagttagtgttctgttgtttcctcaatttgtgttggcatttttcgatattataagtattgaatggccaaatattgatcaatggagagtcgataaatattatttattaattagaagaattttaagacataatttcaaatttttgaaacaaaataattgggatgaagaacttgtggaaaactgggtcaatgtattacatcaaagcgtattaagtggtgaaaaaaatgtcagcatgggattaccttatcatttgtgtgatatatttatagatgaattggaattagtcatgtttgaagatattcaagaagaaatcgatgatttggataatgatgccagtttagaagataaaactaaactacttggtaaaaaaatcgatattgtatcagaagttcctgtattaaaactactcgagccattccaaaaattgaataaactggcacaattgaaaacattgagagaaaaatgtgctgaagaactcttgaatgatgaaagattgaaagattggggtgttattgaagctgatgatagtgatgatagtgacaacgaaggttcgggtgatgatgatgacgatgacgatgaagatgaagatgaatggaaagggttttaa

SEQ ID NO: 549 - DNA, 1551 bp, Candida albicans
attccccaactccgctatacacatatttataccagttacagttatttattgatgaaatttggtgataatttacctcatttatcaatcccacaatggaaaagttataatttagattataataatttgaaatatcaaattagatcaatcactaagtccaaaaaccctactaaaaaagatttattttctttaaagcaatcatttattgaaaattttgattatataaatttattcattgaaaccaaatacggagaattaacacgaaaattcatatgtctagaaaatcaatttaaattcattaataataattctagtggtaatgaaaatggaaatgatagcattgacactatattgattcaattagatgaactattttatcaaactattgaattatcaattgaattgaaaaacctttcaaaatttatcattattcaaaaaatcgccatcaagaaaattttcaagaaatttttaaaatattatcctcataaacagcaaggtaaagaatttgtactaaatttgaagcaatattatttagaccattccaagattaaaaatttaaatgcattaacattgaaattaactaatttaatcaatatcattaaatatgaaaggaaatcacaacaagtgcaataccaacaatcacatcaaaatcaacgtgaaaatctaaggcgaaataattcgttatttagtatatcttcaacaattatgacgagttcagattatcaaaattcaatcttaccaccaagaaatacgggcaccaccaatgggattgccactctgaataatctaccaatacaacaaactccaacttcaaatgagtcatggtatgatttaagtttattattgaaaaagaatttccacatccattgtttaattcatgaagatgccattaatgatttaaagataaatttcaatttgtattaccaactaaaaccaatcaatactggtactgatgatgatagttgggtttcatgtacatatttgacacgagattatttattggatgatcatcctgcttatattattactcataaaaataatgataattcaatgatagtggcccccattggtggattaagacaattttcttattgtatattgcctaataatattgtacaaacattaatttatcatttgaatgatagatcaaatgataattatagacaagaattgttagaatttttccaaaaactgtcttcaccaagtttattaaccaaaaaaactattgattttattgtttctaatgattttaaaccaagtttgaaattattttgtaaacgatcaaggtatttaattgagacaaatgatgaagatggtgaaggaagtgttatagatagtgagtttactgatggtaagaacactaataataacaatagcaaatctggtgatgattcaatcgataatgattatttgattactttggatagtgatattatgaccaccaatagatcacaatatgtgaatgaattaacattccctaatgaaaaaaaattgaatcaattaaatgttttcccctcatgggacacgttaacatttcctccgaatgatattaat

SEQ ID NO: 550 - DNA, 678 bp, Candida albicans
tcaactgaaaagcaacaacgtgaagcaatggaaaccgaagaagcaaaattagaacaagaaatcaagaaatcagatgataatggcgacgagttaactggtgataaaatagaattacctagcactgaggaaataaaggatcaattgaatcttttaccggaagctgatatgaatatgttagggaatccagaaacaaaccctgctttgaaaggggatgtggtgttaactatatttgatttatgtatcccggctttgcttgagtccataccaaaatattctacagcaatcaagcccgatgacaaggtatttgaaattgttgagaaattcttagcattgtttgacaaattccctgatttgaatagagattacttgtatttgcatgtgttgaactacattcaaagggaatacgccaatgatttaagaacactacttactgatataacattgccaatcagagctgtcactgtcaacagtgacaacttggcggaggcattgcaattagctgtgaacaaatttattgcctataaacgcaagttacaagatggtgcagaaagggacatgttgactaatatgtttattaaccaattaaatactcaattcttcaacgacaaagagcatccctcccaaaaaatcgatgctttgctcaaagcaattatcaaaaaatgccgtaccgttaattaa

SEQ ID NO: 551 - DNA, 531 bp, Candida albicans
gttgccatcatgacaatttccgttataatgatgactgataaaccagaactgggctcttcttcctcttcttcttcttcggttgggatatttatggtattgatggcttctatgttgagtggattacgttggtcatttactcaaattttattgaaaaaaaatccttatactccaaattcaattagtacaattttttatatctctcctggaatgtgtataattttattttctttaggtttgatatttgaaggttggacaaattttattaatttagaaatttggatcactaaaggtttatttacaacaataattttattgattatcccgggtgttttagcatttatgatgactttatgtgaatttaaattattaaccgtggctcaagtaattacattatctgtggcaggaatttttaaagaattattaacaataattttaagttcaattatatttggtgataaattaagtttaattaatattttcggtttgtcttcaccctacggagctggccaatccggcgcttattgcgccgaa

SEQ ID NO: 552 - DNA, 528 bp, Candida albicans
ttaaccaattcaaaacaaagtgtcaatcaaaaagtcgtatcatttattaaaaaattactcgatactattccttatgaagaaaattgtctaaaatctttccccaccaaggcaacaatgattagagaaatcaatgaagaatcatctcattttactgagggcaataaagaccaaagtggtagtgacagtagtgatcaaatgccagtccataaaattgttcaagcacaagtagatgatttaaaaattagtaccgaccaattaaaaccaattccattatatcatcctcaattccaaaatccttcagtgattttaaatcaattatattcatttgaagaagaaaacaaaaagaaacacaagaatcaagcgattttatgtgccattggaataccaatcactttaccatttgctcttgttcccatattacctaatgtacccgggttttatttggcttatagattatattgtaatattaaggcattacttggacttcaacatttgtattatctttgggcatcttcaacacgctgctga

SEQ ID NO: 553 - DNA, 468 bp, Candida albicans
atagtcatttacctaattatattgccagtatcaattcaattccatcataccggtatgtcaacaataaaaatcactaatgaatcagtcaaagaagttgttgcttcagtggttccaatgaatattcaatattctggtccagcaaacactgaagattatttcgctccatcaaagacacaagaaactcaacctgatggtacactcctagatgttgcttattttagaggatgtaaattagttgggaaaactttggagttagacaaatatgatgttaagggttatgtgataaataagtctgaacatttggtgtctgataaggaaactggtgaagttaaaactgcagtaacctacattccagtaggcaattttcaaaagttgacggtatatggacatgatacattacctagtcgaactaatcaatggtccctcataccagaatatttgagtataagtaatatagttaatgaatag

SEQ ID NO: 554 - DNA, 696 bp, Candida albicans
ccccctcttcgtaccgggttggtattaagcttggctaacccacaacatccacaaataaaacaatcaatgtttttctctaaaattactaatcacaacttgataactttttatattcaacactataaatctaagttctgttattcatcaattgcttttgatagtaactttaagatgataacacaatcaagaatatcaaacttagctaaaccaatattagcatttctatttattttaacactttattccatcctatttagaaaatccgacgatggtgcagataaaatactagaaccccatggctatgctgttgataatgaagaagatcctttatttttaaaacaacaattcatgcaacatggattatccaacaacaacaacaacaaaaaggctggtgggaaagatgcaaacaccaataaacttcaacccgataaggctatagttattgataaaacttttcttgatcaaatggataaaaaaactcataaatgtcctgattacgtggtgtattctcaaaaacgacatcctccattttcaattggtcgattcaaatatccttatatgagaccagcacctaaatgtcgtacatttgtatcaacagcagtagaatcagtgattgaagatttgaaatctaaaatagaagatcctgatttggcaagattattagaaaattgtttacccaataccttagatacaacg

SEQ ID NO: 555 - DNA, 1305 bp, Candida albicans
acaagaaggattattgccctcaatcaatttattggtcaacggtggatattccatgctgggatggttaaagagattcccgctagacaattattcagtatatcgaccttatgggtagatttgatcctaaaattaaaagaattgatttttggagcaatcaacactcaggcttattacataatcaattctccttattgtaatgcatttcatccgccacctggatctggagttaaacgtggggatacagcatttgatcaagttcatcctaaacctgattggaaacaagtgtttgaatgtaaatatgaactagattctttggcatcatttttaactttaactaatgaatattacgaaaattcgaaaggtgatacttcattcattaatagttcttggttaaaagcatttgaaaaagttttaattatattacatagagaaagtgtaccatcatttgatcaagaaacaggacaaatgttaccattttattattcattccaaagaaataccaacattggttcagaaactttacccttgggaggagttgggaatccagtcaattatggtactggacttattagaagtgcatttagaccaagtgatgatgcaactatattacaatttttcataccagcaaacattcatatgttgacggaattaaaacgtgccagaaatacttatttaactaatgaaaatattgctagagataccatgttagtagaaactaccgatacatttattaatgccttatctactggtattgaaaaatatgggattgtcaatcaccccatttatggtaaagtttatgcttatgaagtagatggatatggtagtgcaacatttatggatgatgccaatataccatcgttattatcaatccccgatcttggatatacaaaaattgatgatgaaatttatcaaaacactagaaaaatgattctttcgaaacaggggaatccatactatttgaaaggtcattttttcgaagggattggaggacctcatattggtattagaaatgcttggccaatgtcattacttatgagaattagaactactgatgatgatgatgaaattatactgagtttggaaatgatcatgcgaacgactgctaatttagggttgatgcatgagagtgtcaatgttaattcaagacaagggagagattatactagatcttggtttgcttggtgtaattcagaatttggtacaacaatcttacatttggccaagaataaaccccatttaatatttaaaaaagaatggcaaaatgtgccgtatgatattgaaagtgtattaagtcaatttatataa

SEQ ID NO: 556 - DNA, 798 bp, Candida albicans
  unsure (742): Identity of nucleotide sequences at the above locations are unknown.
ggaaataatgcggtccggctcgtccgtagtgaagacgaaggtggagataacccaattattggagaaattgcattccatcgatttattgctgtttctataggtattatgtgggcattaactatggctacgtggtttttaccaaatagtgcaagagtcaggttaaaaaatgggttgtctgccttgtggctaagattgggtgtgatatggaatagtgatcctttggaatttaatcctgatacaaagcaactagttgggttcaaggctgaggaaggcacaaataaattacttgctgaatgtgaaaccttgttgaagcaagctccggttgagtttagattaaagggtgcttttccttctcatatatattcgagattaatcaaggatacgtctgccatcattgacgccttccagaatttagacttgttgattaaagttgatcccacattgagtccaagtgaggaatttgttttcaaatacattgaaattgaacgagaagaggtcgaacagagaatatttttggtgttttatatgcttgctagtgcaatgaaattgggtttcccgatacccagtaaaccagcttcaattgaacatgctaaggatcgaatgttgtacaaattgagtaacattagacaacaacacgaagaagagttggttttgaaaaatgctgatcttattttgttgtattcgtacatattagtggccactacgaatgcggagcaattagatagaattatggttcaactanaaaagttgttgggagatattcagaagatatctttcaattggtatgaagaaacttga

SEQ ID NO: 557 - DNA, 411 bp, Candida albicans
ataagccatgatataacgcatattaatggagttgtttttatttgttcactttttttttcttctttatatcccccaacatatacaaacttcccaaatatgactacattttctaaaactaatttcaaatcattaaactacaattcatttcgtcctcattatccaccatcattttataaaatattagctgattacgtcaccaaagtggaactgccacttccaatcaatttaccaattgataaaaccattgatttaggatgtggaactggtgttgctacttatcccttattaaacatttccactaatgttattggagttgatttatcactgaaaatgattgaaactgcaaattcattaattgaaaagatttacaacgttggggtaataataatctactctgaacccgagaattaa

SEQ ID NO: 558 - DNA, 375 bp, Candida albicans
atgggaccattctatcaacaaccaggtcatgattatttaagatcattgatgaaagaaattgaagttccaacaaataaattctatgatatagttcgacatgagtatatttccaatatacacggtgctccaaaagaaaatgaagatccatacttaaccaaaacaccactttttattaagaaaactataacaatgaaatggtttttagattatgtcaaaagttggagtgcatatcatacttggatgacccatcacggtgataaatatgatatagctgaaaagtttgttgcggaattgaaacagaaaatgaattggaatgatgatactgaaattgatgtaatctgggatacagtttacacgtttgctagaaaaaaataa

SEQ ID NO: 559 - DNA, 462 bp, Candida albicans
  unsure (28): Identity of nucleotide sequences at the above locations are unknown.
aaagacatgaatatttacttcatcatcnaagaaatcccaccaggtaatagtagtagtactagtaatggctctaattattcggtgacatttttccatttaggtcataaattaactggacataaagggataattcatggtggattattagctactttattagatgaattaacttgtcgattagcttttcttaattttgaaaatcaacgaggcgtaacggcaaatttaaatattgattataaacaacctactatagctaatcaatttataatgataaaatgtattgtgttggagaaatcaggtcggaaatgttgggttaaaggtgaagtctataaattgaacaaccaagaagaagaagatgaagttgatgatgattatgatttgattattgataagccagagaatttattgactagttgtaaagtgttagtgattgaacctaagtgggttgataagttgacatag

SEQ ID NO: 560 - DNA, 660 bp, Candida albicans
tatcctatccaactcaaatcaccactgctagtatcattagcaatgacagtacttccattaatagattcttcctctgtctcttcttcttcatcttcatcttcatttgaatcacaattaaattctcatccccaatatatcaatattattaatcaatatcaaaatttcattaaaactaataatgaaacttcaaaaatcattgaaagaatcatgccaaatttaactggtgaaacacttaaaggtgatgataaaatcaatcttcgtaccaaaactttatatttcattaatgatgaatatttacttcatcatcaagaaatcccaccaggtagtagtaatagtactagtagtaatggctctaattattcggtgacatttttccatttaggtcataaattaactggtcataaagggataattcatggtggattattagctactttattagatgaattaacttgtcgattagcttttcttaattttgaaaatcaacgaggcgtaacggcaaatttaaatattgattataaacaacctactatagctaatcaatttataatgataaaatgtattgtgttggagaaatcaggtcggaaatgttgggttaaaggtgaagtctataaattgaacaaccaacaccaaaaaaaaggacaatgtacacggagatga

SEQ ID NO: 561 - DNA, 975 bp, Candida albicans
ggagaaaaaaaagttgaggaaaataatacaatcctccaaaaaagaacaaacagtttagtgttatacctcaatctaatctatttaactaaccatttttacatgttttgtcgttcaaagactataccagttaagcgcttgcaatttttccgatcatttgcaacacgctcatcatttgattcacctttcgaccatctccctaaattgaataaccgttcatggtttaattggaaaacaactacagcctttttcttactaggctcctacttagcatataatgaaactttatttaactattatgagaaatacactgaaatagatgaaaaagatcctaatatcaagattttacccatgcaattggaatataagttgaagaacttgcccatatatcaacaattagcccaccccaaaaattcacatcaatggtataaattacaaagttgggaaaatctcgatagaaacattttagataatcaaacccaagttaaaaagcaagatgagtatcaagagccaactttaaccaatcaaacattgaataaacccggagggattttgataaaaccagtcatctttcacaatatagaaacagatgaaggggttcatattgtacatgctggatataggttatgtggatatccatttatcatccatggtggaataattgccacattattgaatgaaacttttaaaagaaatgcatctttatcgaaatatactacatcaaatttgaaagatgatttcaaagttgagaatttgacaattaattacagacgtccaactttagctaaccaatttttgattgttaaaacgaaaaagaaggaaagtcctgaaaatgacaacagaacaatagtcttggaaagtgttatcgaagattcaaaaggtaaggtgttagttaaaagtgaggcgttattgcacgatacaggaagagcaacaaataggattaaagaaaatgaaaaatcaaagaaatcatggtggtag

SEQ ID NO: 562 - DNA, 420 bp, Candida albicans
aaatgttccccaggtgaagcgattaaatttgatcaaaaaattaatgttgatttaatcccagcaaattatgaattgattccttatgttttcattgctcaagatagtttgattaaagtcattccatgccgtggtcaattggctactattgttgatgctgctgtttcatttttcgatccaagattgatctttttggaattggtattgttgattacttttgctggtttgatatatgttggttatgaaatttggggtaaacaatatttcaaaggtgttgctccagttaaggctaagaaagtatctgctgctaaagcttcaagtcctgttgctagtggcccctctactacttctgccactggatacgatactaactggattccagaatctcatttgaaacaaaagaaaaccaagaaggttaactaa

SEQ ID NO: 563 - DNA, 483 bp, Candida albicans
ttcaaaaaccccataaataatgacattgtcactaatttgactacagggaaagttggtcctattgctgttccaccgggtgaagcgattaaatttgatcaaaaaattaatgttgatttaatcccagcaaattatgaattgattcctcatgttttcattgctcaagatagtttgattaaagtcattccatgccgtggtcaattggctactattgttgacgctgctgtttcatttttcgatccaagattgatctttttggaattggtattgttgattacttttgctggtttgatatatgttggttatgaaatttggggtaaacaatatttcaaaggtgttgctccagttaaagctaagaaagtatctgctgctaaagcttcaagtcctgttgctagtggcccctctactacttctgctactggatacgatactaactggattccagaatctcatttgaaacaaaagaaaaccaaaaaagttaactaa

SEQ ID NO: 564 - DNA, 408 bp, Candida albicans
ccaatagtagttataaaagataagcattccctaatgtcgacaacaaaacctacagcaacagacgaacaaaaatcacaagtcttgcaacaagaatataacagatatcaagaattaatagcggaactagactcccaattgaacaccatatcatcacaattacaagaacatcttatagtggatcaatcattaacatcaattgctcctgagaaaagagaaggtcgtaaatgttttaaaatgataggtggagtattagttgaaaaaagtattgatgaagttatcaaaattttgaatgatgagattactcagttgaaaaccgaacgtgaaaaactaaacaaagagttgactgaaaatagaaagaaattggaaagttggataactacaaataaaatcaaaattgtgaaaggttag

SEQ ID NO: 565 - DNA, 816 bp, Candida albicans
gcaatgtctaattcaagtatagtccctacatataatgggtatattcataacacaagagatgcattagcagtgattcaacaagttcttgataaacaattggaacctgtttccagaagaccccatgaacgtgaacgaggcgtgcttatagtttctggaagtgtatttgtgtttattgaacaactgtcgggaatcaaaagatggacagatggtatttcatggtccccatcaagaatccaaggtcgatttttagtatatggcgaattggataaaaagaatctaattgataaagacaagaagaagaaaaagaagcgtaaatttggtcccgacgacgagtacgaccacaatgtcaatgaaccagattatactggtgggtatggtaaccaccttcataatgacaacagaagtcaccttaataagaattctcgatcaggtccaatgttgcttgcgactggtacaggtagtatcactcacactgtaatagaaaataaaccatcgtcatcggcatcaatgattcattcaaatgttattccagcatcgagttcatttttaaccgactacagaacgagtctaggtaatggtcctatggtttcagctgctatactgcaaaacggattagttaaaaagactataactttgacaactacaacaaaggaattacacatggaagggaaagctgaaaagcaaacaatccatcttataagttattatagtaaacaagatattgattcagggaaattgcaaggtccttctgaatctgatttaaaacacgttcaaatttctccagcgttatggaacatggtacaagaaaattcataa

SEQ ID NO: 566 - DNA, 753 bp, Candida albicans
caacaacaacaacaacaacaacaatcgcataacaacaatcaagaagatatcaaaatgggtgcctgctgtagttgtttaggtaatcgtggaggtgatggaagtcatactcagttattattagcagaaaatgaaagagaagccatttcagctttattacaatatttggaaaatcgttctgacgttgattttgtcagcaatggaccacttcgtgcattgagtactttggtttattccgagaatattgatttacaaagaagtgcggcattagcatttgctgaaattactgaaaaagatgttagagaagtcaatagagatgtattggaaccaattttgatattgttacaactggctgattccgaagtgcaacgtgctgcatgtggagctttagggaatttggccgtaaacactgaaaacaagattttaattgttgaaatgggtggattagaaccattaattagacaaatgatgtcaaccaacattgaagttcaatgtaatgcggttggttgtataaccaatttagccactcaagatgacaataaatcgaaaattgctaaaagtggtgcattaattccattaactaaattggccaaatcaaaagacattagagttcaaagaaatgctactggggcattattaaacatgacccattctggtgaaaatagacaagaattagttaatgctggtgccgtgccggtattccgtctttgttgtcgaatcaagatgacgatgtgcaataataattgccccaccacg

SEQ ID NO: 567 - DNA, 864 bp, Candida albicans
ccaaccaatttctttatttctttttatatatctccaataatgactgaatttcttaattataaagttgatttaacattaaaggatggaacaaaatcaactggtttgatttcacaggttgatagtcaacaaattagactttccaatgcaattcaatctattcaaccaaaacaaactataccatatttagatatcaagagttctgaaattgctgatttaaaagtaattcaattacctcctgattttaaacaacaacagaaaaagaaacaaaaaccaagaaatggagaattgattgatgatgccatagtatttgcatcaaaaccagggacacctcgggtccatactccgaaattgaaaactcaaaaacctcatgctgtttccgctggttcagaacaaccagattgggacacctctagtgatgttcaagatataaaaagttctaatgaatttgatttccaagctaatttagccatgtttgataaaaaatctgtatttgctgattttcaaaaacgtgatcacaccaacattggtgacagattagttggacataataagattgaaaatgtcaataaattgaaaaaagaaaaatatgataatgatgaaatggtattggatcaaaatagaactgacaattgggataatattggaactgcaaccaccagcaaaacgggtactccagttgttaatcaaaatggatataaagattcacaacatcaacatttgaaattaatcaatgccaataacttaggtaatgttgccttggcttcacctgtacaaatgttggaaattgaaagattagcaaccgattcttttggaataactcaagcaatgatgttttcaacaggcgtagcgatccgatttgcgtaa

SEQ ID NO: 568 - DNA, 1293 bp, Candida albicans
ataaaatgcaaatccagttacaactgcttagatttttctcttttatttaatatcccgagagttagatatccatataaccaaatgtctatcaactataatgcacaaccacatgcagtggacgtgcctgttaccgatatggatgatcctgaggatgacattatttttgccgaacaagcttctacacaacagaatagaacacgaagttcgtttttagataatttagatttcgaaaataacaatgcaaggtctgagtctggagggatcttgaacaagtttcggtccttttttgaatcaagactgaggcaagatgatgattacgaaatggttctgcgttttgacgtagatagtacaaacgagagtgatgacctagataatcaaccaccaatcgacattagagaacgcagacttcaattattggagaaacaagtcaaaaatcgtactgttgtgggtagtatatttttacttacagtgggtatattgacatttgtgctatttttcaataaaaatagtgttacacttttattgaatagtggaccatcccgtaagatctattcaaattcaacacatgagtttcaccaaacaacaatattgatatcacttgatgggttccaccctcattatatcaaccctttggacacccctaccatgcataatataatgaagaatgattatggtgcaccatacatgactcctagttttccttccctgactttccctaatcactggacattgattaccggattgtatccatctgaacacggaatagtggggaatacattttatgatccagtgttgaaaaagcaatttataaacaccaatcctaaagttggggggttggatccagatttttggagaggcggcgagccaatttggaagaccgccaagaggcaaaatgttagatctgcagttcatatgtggccaggttcagaagtaccacatattggcccaacagaggattttgatagatacaatgggtccgaattactatcttcgaaagtggatagggttatgggttggatagatcgtgaatccatagagacaagaccagaattgattcttacctatgttcccactattgatcaatttggacacaagtatggaatttcaggacaaaacttaactgaggcattgacttatgtcgacaattttattgacctcatgcaacaagagattcataatagaaatcttgatgaaattgtcaacatgatcatggtaagtgatcacggaatggctccgacttccaatgatagaatgctctatctggatgatttggtaaattgggacaagaatgag

SEQ ID NO: 569 - DNA, 1242 bp, Candida albicans
gtagttcaagattacttactcgataatagtcgtggaagttttaccgctagaatcatcgctggaatgattgagttgcttggtttagtgaactctggattagaagatatggccccacttgcttggagaatatacacaagttgggagtatgcgggacaaccagttattcattcagaaaacaaaaccctgaccatggccaaagagtttaagaaatctttttctcgtaccgatgtaagagtgcattttatggggttgtgggattcagtaaattctgtagggattctttgggatcgaatgtttccatacaccatcaaaaccgccaatgttgatcacaccaggcatgccattagtattgatgaaaggagatccaagtacaaacagcagcttttctcgccaatagagtcaagtgacgtaggtagtaaaggcagtaatacatatagttccccaatcagttacgggctgtttacatcagtgagatcgttagttgatatacttaaacaatttgtggaaagattcaatagaagaaaactgcgaccactaccagctattaatgatttaatcgaagtatattttccggggaatcatggggatattggaggcgggtggaaggcgtcactggataatcaagtattatcaagtgtttctcttaggtggatgcttgctcatgcaattaaatatggggtaaggttccagccacaatcaatttcacaatggtcttcagatcaccctccaatatctagttttttatctcccaatcatgatatattgtcattttctagcaaatcacccgatagtaggtctgacatcgttcttccagagtttcccataaaactatttgcggggagaggagaagaatcgtttttgtatgttctattctggtggattttggaattgattccctttttaagaatcaccgagatccaagaagatgggtactggaaacgagcttttgtacctaacttaggaaaacacagagttctcccaagcactagtttgtttcattggagtgtattttatagacttcattatgcagcggattacaatccgaaaaacttgcataacctatcattgggtgaaaagtttatagagctgttgatgcaattcaaaattttcaaatttaatgaaatatactcctattcagaaaacctcactgttaaaaaaatcaaaaatgactggacaccaagattttggaaaaaagtccccgacgaattgagtgagtatctagagaaagacgccaacttgtaa

SEQ ID NO: 570 - DNA, 441 bp, Candida albicans
gctatgtcgttagttgaagagccaatgattgtcaataatggcaaaaatcaccccactcaccacaatgcttcaaaatcaatacaaaagacaaatcactctaaaagcattgttttatgttttgatggtacagaaaatgaatttggtccgaaaccatttacaaatgttttgaagttgtttcagatgttagatagaaacaactctagtcaaatatgttactatcaacctggaattggatccaaattcaatgctgacattaataatgtttttgaaaagaactttactagtactgttttatctaaaataaccaacagggcggattcacttgttgcctttacacttgaaaagcatgtaatagccgcatacagttttcttactagtgtttacaaaacaaatgataaaatttatttatttggatttaggtatgtgttaaagagtacatga

SEQ ID NO: 571 - DNA, 1164 bp, Candida albicans
aaatttttcattttcttgatttccattttctttgattacaataaatcttattcaactgataacattattatacaccagtccacgttacaactcccacctctttcttattacattatgaaatcggtattatctatacaatctcatgtttctcatggttatgttggtggccgagctgccatttttcctttacaaactcaaggatgggaagttgataatatcaatactgtcaatttttcaaatcatactggatatggatcatttaagggtacattattaacttcaaatgaattaaatgatttgttaaatcaattaatcaataagcttcatatttcttatcgagctattataactggttatatccctaatgcgtcattaattaaaaccaccaatgaatatatatcgttgattaaacaaaagcagcaacaacaaaaacatgaagaagaaaaagtgatatatttgttagatccagtgatgggggataataattatttatatgttgataaatcatgcatcgttgaatatcagtcgatattacataataaattggttgatataatcaccccgaatcaatttgaattggagttgttaacaaatagtaaaattattaataaatttggtcttgttgaagcaattaataagttgcataacgattatgatataccgtatgttgttgttacttcgatcactagtgggagtatattcaaatcagaagaagaagataaatatattcattgtgtcatatcaactaaagatcaatcaataataaaagtgtttgatatcccaatgataaaatcatatttcactggagtcggggatttattctcagcattattattagataaattttataaaaacaaacacgatgctataataaatgggatacatgattcaatgacgatcttgagtcgatcagtgaatcaagtattgacaatcatggcaaaaactctaaaacttactcataaattagggattcaacaagctatagcagcaacaagaaaagacgttaatcataataataatgacgataaaaataatttcattagtggtaaaatcaatgatggtgatactatgaaatatttcgaattaaaaattattcaagctaaagagtattatgattatgatggtgatggagaatttattgaaaaagtactcgaattgaattaa

SEQ ID NO: 572 - DNA, 648 bp, Candida albicans
aaaatgccagcaaatggctcttttgaaaagatgagtcgacctgcaaccgcgtttcaaaaagtactagacaaagttggatcagttttcagctcaaccgaaacttcacgactgcaacacgatagccaacttgatgataaagcgactaatatatttagtgtttcttcacagaaactatatctgaaacttagtaaaatgttgaaaatagaaaccagatccaaaaatttaaagatggaattgtgtaatgactttggtgtttggggacaatctataccaaacctagagagctcggcatttgtaaaagaattcagcgctttattaaacacacaaacaaataatcaaactatattacaagagaaaatggaaagacttaagctaagtttgtcgtttgttaatgaaagagagaaaaagcagaaagggttaataacggcaaaacttaaactagagaaacaattaaaagaggctaaagcgaagtttgggccaaatgcatcaaacacaatattattaaatgaaaaagcagaagaagttgattgtaatttgcaggttgtggagcagcaatacatacggtcaatcatcaatgatttgaaagatgctttaattgattatgcatattccatgagtgctgccgctagtaaagtgttcacaacgcct

SEQ ID NO: 573 - DNA, 258 bp, Candida albicans
ggtggtggacgcggatcttccagcctcgtggtgaagacatttgatactccaacttataattcaataatgtcaccaccaagtttaaaaccaacaatgaaatattgtgatataacgggattaccaacaaattataaatgtccttctaatcaattaagattttataattcagaaatttatcaagaagttattaaaaatatgcctgctggtgtagatcaagaatatttacaattaagaggtgccaacgtgatattaaaataa

SEQ ID NO: 574 - DNA, 459 bp, Candida albicans
cgccaccacctaaaactaacaatgtcaaatactccaggtcgttctatgtcaagtactccaataacaaccaccaccacaactcaagtaaatcttcatgaattactggaaatcactactaaacctcattcatttaaacaaaatcctaaccgtaaacaacaatcaaatagaagatataaaccaagtagacaattaatttctgatgaattaaaatatttacaatctaaacaatcaaatttaaaatttgatactccaacttataattcaataatgtcaccaccaagtttaaaaccaacaatgaaatattgtgatataacgggattaccaacaaattataaatgtccttctaatcaattacgattttataattcagaaatttatcaagaagttattaaaaatatgcctgctggtgtagatcaagaatatttacaattaagaggtgccaacgtgatattaaaataa

SEQ ID NO: 575 - DNA, 1665 bp, Candida albicans
tttcttcttcaattcatactatataagaagaagaaaaagcttagttcagtcatcacgttggtccgattttttaaacgatatctattaataataggtatcagtattattttagtttattgtaaccaatctttgtacacattcgcctcgtcattcatgtccaaaatcttgtcgtcaatcccaggaaatatgagtaaatcaatagctaagtacgatacaattgtgattggatcagggttagctggattaaccacaacctatcagttgctgaaagctggtcaaaaggtggcattgttagagaaaagtgaaaaattagggggtaattccattaaagcttcatcaggtatcaatggtgttcccacaaaatatcaaaagcagccactgacggactccattgaatcctttgttcaagatactttaaaaactgggaaaaatttgaacgataagaagatggttgatattttaactaagaattcacgtgatgctatttactggcttagcgatgaaataaatgtcgatttgtctaatgttgtcttgttgggtggacattcgcatgccaggactcacaagggtgacaagttgcctcctggatttgcaatagtttccgcgttaactaagaagcttgacggtttccaagctgaaaaccctgatcaacttacaattttaaagagttccactttgaccaaaattttaacagaaggaaacaaagtcaagggaatagaatttaccgacagtgaaaaacaaccccaagaaatgtatgcagacaatgttgtgttggccactggtgggttctccgctgattttgactcacccacatcattgttgcaaaagtacagacctgacttgcttggatttcctctgtcaaatggtgcacaaacaactggtgacggacaaaaaatcgcagagcgtgatgtcaatgccgagttgattcatatggataaagttcaagtacaccctactggatttatgaaagtatccaatcctaatgaaaattggaaattcctttgtggtgagctcatgagaggtattggtggtattttactttcaccggttactggttggagatttgtcgacgaattacaaccaagagatgttgttacggatgcagtattgaaacattctcagatcggtcaaaacaatgagattgggttgaaatctgataatggagatggctacggttctgtgattgttattagcggcaacgactaccaaaaagccaccactcacatcgagttctacaagtcccaagggttattacaagaaggatcaattgaggatttgtattacttgttgatcaaattgaatccaaaattgccattaaccctcgaccagttaaaggataaattttccggttgtgacgcgatcattgaaggtacacaacaggatagtttaggaagaacaaaattcgggggcagatttggagatttgaagaaattgtattttggagtgactacaccagttgtacatttcacgatgggtggtatcaaggttaacccatcaaatgccaaagttgtcactaaatcaggtgatacaatctcgaacttgtttgctatcggtgaagtaagtgcaggtgtacatggtaataaccgtttggggggatcttccttacttgaatgtgttgtatttggtagatttgttagtgagaatatactttcaggcaaaaactag

SEQ ID NO: 576 - DNA, 1101 bp, Candida albicans
tttggggaaaacttttcatttcaagtggatgagatcgggaaactacgtgtcaatgaagcatgttttaaattattatttgatgtattagaagccaaagagaatacacaaggtcaagaaaaactttttgagggagatggggaattccaagaaggtgacggtgatgaagaagacgaggaggaggatgaagaggccgaagaagccgaagataacaacgagaatgatagcagtagtgatattgatagtgatagtgacaatgacagcgacaatgtcagtgagttagacaacaatgaagatactatcactgaaattgacaaacaaactaatttaaaactagctcaagctttaggaatccccaccaaggaatcaggtgaagttaaatttgatgagttagatgacctttcttccgatgatgattatgaatctgattcaatggacgatgaacaaatgatggcaatggatgatcaattatcgaaaattttcaaacaacgacaggacacaataactaatttggccactggtaacaaacgtaaattggaagttttagaagctaaggaaaatatgattttcttcaagaatcgagtattagatttattagagacttttaataaagtcgcagtaaacctgcattttaatttggcattcattgaacctttgattaatttgatgaatttgacattagataaaaatttgggagttaaagctcataaattattgaaaaataaaatctccaaaactaaaattgacagtgaagaattaaagaaatattataatgatgatccattggaatattatcatcaattaatcaatttaattgaggaattacaaacaaaggcaaacactacacaaccatctaatcaatcagttgtacaaagttataatcaaagttgtattatcattgccaaaaacttgttgaatttagatgaatcaaatatgcaagcaattgttgatatttattgcaactcattaaaacaatggtgtttacaatctgaaagcaaattgcaaccttctttgtttttcgatttcatcaattgggtcaacagtaagaagagtaatgcttctcataatcaaaaccaaaaccagaaacaaaaacataaatcttag

SEQ ID NO: 577 - DNA, 735 bp, Candida albicans
aacaatgttaatccatttatcaatattttattagagaattttactatcaaattacaaactcaaacaactttggatgacactagcaacaataataaaaattctaatgataatattttaaaatggtatttggataaaattgtttccttaattaaacataataacaataatcgacacaaattatctgatactgttttggaatctattttaacaaaattacttcaatattcatttttcgacaccaatgatattaaaatatcaaaatttttacaatctatttgtaaagaaaaattcaattcaatattatcagaaattatcactttaaaactttcccatagaaattataaaacttggtcaacattttgttatagaatcattaacaaattatctcgagatccagaaaataaatgtcttgttgaatttgatgatgaaatatctatagttaaacaagaaactgaagaattattatccaccatcattgaattaaacaccaaatcttcagataaattgtatatttttgaattaatgttttcaatgtgtttgatccaattgtatatggaagatgaagagactatccaggtgattaatgaattgaaattagtatttgaaaatcaattcactaccgccaacaaatatgacaacgaagaagatgacaacaaagtagatgataatttagtgttgactgaaattgtattgagttttatttcaagaaaatctactttatttaaaaaattttag

SEQ ID NO: 578 - DNA, 951 bp, Candida albicans
  unsure (856): Identity of nucleotide sequences at the above locations are unknown.
aacgagcatttttattcggtaggctatcttgttttacaagtattatttaattctcaattcattattttgaaaagtgaaccggaagatatgttacaattatttgaaattttaatggaattgagtaattttaaaaattggattcgagaaactggaattttcaccttgatacaatttataaaattattagataacagtaatgttgaatatagtaagaaaatttatatcaagatattgaatatggttaataatttgggattgaatttatcaactgaaggtttagcaatttatttatcaattcctcaaagtgcccaattatcacaaaatgtatctaatatgaaagcaaattggaaaaatggtgatccattctataagggaaatttaccaatattagccaaagttttgaaagatgttgaggtaatcagtgatgaagaaacaggggatgaccaaaagaagaaaaatcaacaaaagagtagttggaattctcggttaccatttgtgtgggatttaatcgttgccaaattcaatcaagttgctgatgattcaaatgttgaagatgaaatgcaagacctgttggtcacttcaaagaagagaaagaaaaccacatcaccaaagcataataataaacgtgctaaaatagaaccagaatatatttcattaaaagaattctggaaagttgttgttgatgaaactttattttcagaaaaatcatctaatgaacgtaaatattgggggtttgaaatttttactaaatttgtcacatctttagagacaacctcactggttcaatatttatttacaccaaatattatgagatgtttaatcaatcaacatgcatcatcaacgagaatgttatacnagattgctcaacaaactttaaaaacttttgttaaacccattcgagaaaccaagcctgaattggttcctattgttttaactgtgtttattagatga

SEQ ID NO: 579 - DNA, 630 bp, Candida albicans
aggagcggaggaaaatggggaagttggttatttccggaagccagggttcaatggggtataacgttcccatccagtgtatttcccgatcaggcatttcgagccggtggtatttacaaacaatttaaatgggagttttccaccaattttttttttattccccaaccactaacgatgtcagttacaatcagaccaattgaagagaaggataagccggagtggttgcacttgtggacgggaaaaggcgggtatattgagttttacaattcgctggacaaaatcacacctgaaatttcagatacaacttttgccagatttttggacgccaacgagcccgtatactctgttgttgctgttgacgattcgggtaagatcattgggtttgccaattacttgacacacagaaatacatggactgttgaagatgcactttatctcaatgatttgtttgttagttccgagagcagattgcatggtgttggaagaaagttgattgagtatatctatggcgaagccgatagattaaagtgtaagaaatgttactggagcacccaatttgaaaaccaccgtgcccagttgttgtacaccaaagtaggtgttaagagtgggtttttattatatagaagaccctga

SEQ ID NO: 580 - DNA, 966 bp, Candida albicans
cttcgccagaaactaagacacaacaccacctcatatgtagaagaagaaattgtgacgatctacactaccctctcaacaagaattttgtttcttgtttcttactttccagtctcaccatgtagcactcattgctccaagatgtctttcgaagtccttgcattgtcatattcttgggtgcacaaagactccgtgtcgtcaaggtttgaaaatttgaaacacttgatcaatgcttcatacaataaacctagatacagatttggtatcattcaatcaccaagaatcaaaaataatgatacagtgttgtcagatctagcaattgatgcatatgacgagatttgcatttacttgctacttggaaaacaagaaaagtttgatgatttggctaacgaaggatataaacgagacttgactaaagttgcaactacatttaatcaagttttcgctaatgatattccagaacgttattattccattttcaatcttgaagatataaacaccgcaaagatcacttttgctgacagtgatttcgaattcagtgatgagatcttgaataggtgtattgccagtgttggattgagatcatttcatggcaaggcaaaaccagccaccaaggattttgagttgacagcattcacatcgtttatgcggaatactgctccagtttttttagactttataataaaccaatgcctattagatagtgaacgatttgagaaaatttcgtttcagggatccctaaatgatttccaaacgatcattatacacgcagatgtgattaaagaacatggattagttgagtactatacaaaaaagtgctctttcaccaagtcgtctcaagaggacattttgatcaaggtagacaatggacagaaagtagatgacggggtattagagaagggaatattagcatccaaagattttcatctttcgtttttagaaagaattattcatatagaacccaaatag

SEQ ID NO: 581 - DNA, 540 bp, Candida albicans
tgggataaatcattaactttgacacaaaattataagagattaggtattagagccaaattaggaagatctgctggtggtgatgaacgaaaagttgaaagtttatctgaattacaagccaaacgagagaagtaccagaagaatcaactgaaacatgtgcctactgtatcagaaattgagaatttggacgatccttcacgtattccagaaggtgaagcaagattaataagagaccctgaaacaaacgaagtgataaaggttatttatgggactatgaaagtcgatgacaatgatgaatcggaagaagaaattgaaaacccatcagtcatcaaacaattagaagaatatgctgaaaaaaatagtaaaattaaaaaggaaagacatcaatcagaaagagaaaatgattggatcaaaagcttgtatgaaaaatatggcgatgattacgataaaatgaaatgggataaaaaattaaacatctatcaacaatccgctggtgatttaaaaagaagaataattaaatggaaaaaggcaaatggtatatag

SEQ ID NO: 582 - DNA, 750 bp, Candida albicans
aaaccgccatctgatatgtctattaccaagtcattgtcatccaaagaggtcatctcaatcttatccaagttcacaccatgcgacgtgtctgattcattaaataaacatggcattgccaatggaggttttatccccaacttaactaaccaatcaccagttttaaacacggcatcctctgttgggaaagcctacacagtcttgtatgctcctaagtctgaccctatacctgcagttaaacaagcctacatagaccaagtcccagaagattctattgttgtaattggcttgccattggaattacaaacagtgaatgctccttatgtcaaggttaacaatgccttgtacggagggttgatgtcaactagagcccaataccgtaaagcaaacggatcagttatattgggcagaattagagatctagacgagcacaacgagttaggataccctgtttggtcatatggtgttggaaccagtgctcctggtccattggtgaaagtagttggcataaatgttccattagaagtaaaagttgcaagtttagacaaagatagtgaggttttaactataaatgcaggcgattatattattgctgacaagaatggggtagtcaaattagaagataatgaacaattggatagtgtattagattatattcccaagagagttgatgctgatatcaaggttagtgaagatatcaaaaacgggaaacctgctgctgaatcacaaaagttgtggcgaagcaaaatataa

SEQ ID NO: 583 - DNA, 759 bp, Candida albicans
ttaaattttcaaaaggaaagctaccttaaggttttgggggatgccagttactctactcatagagcatgccaagcttgggattttgccaaattggttcgaatgttgaaaaaagcggggtatgcggtaattcaggttggtgatttaaattcgaagccagattcgttaccatacaaattatttaccgttgaaggtggactaactgattcatggaatgttttgaataaagataatgttgttcccaatgaccaaatagcaacactttctcttgaggaccagatatcattagcaggtgtgacatgcaattctagacttaacacatggagggaatccagaccactttgggaggcttgtcgtctagattatgcactaattgatgcttctaatatcacacctgtgtctgctcaggttaagtttgttgataaattacctcctccactttcttgctcttactcggatcattttgcatacagcgtggatttggtaattcgaccaaaagaagaaagggttggactggctgatgaaatgtcaaataatgaagaaaaggtgtcggtgtatagagaacttttagctgaaatatcgcagtaccgacggttaacaatcccatttcaaatattatggcgaaagttgcatttcataatatcacttgtaattgttgttgggatgcatattgcagtggtctttgttgcaaacgtggcagcttgggtttctgtgattttgtttgtttttaacaacattatttgtactgaccggtggaattaa

SEQ ID NO: 584 - DNA, 552 bp, Candida albicans
agaatgagtctagatgatcttggtggttcaaaggttgccagtgaaccaaagaaacaatatattaaacttttaacatttaacacatggggtctaaaatttatatcaaaacatagaaaagagagattacgagcaattgcagatgctcttgcaaatcccaaaagccctgatgaagactatgacattgttgctttacaagagatttggtgtgaagaggactggcagtatttggatttagtgtgtcgtccacgatatccatacagacgagtctttaaagctggtatagtcagtggtcctgggttggctgttttgtcaaaaatttacattgctgaaacttttctttaccgattccccatcaatggcagaccatctgcattttttagaggtgacttttatgttggtaaaagtattgcggttacgatgtttcaaccacaccaccctgatattttgccaatagcattactaaactctcatatgcacgctccctatggctctggtgatgccagttactctactcatagagcatgcccaaaggccctttttttgggggggggg

SEQ ID NO: 585 - DNA, 285 bp, Candida albicans
aacttatttgggcactttattgttggtttggaaaaacatatgaatttggtgttgtctgatactgaagagtcaagaattaccaagaaatcatatagtcaattaaagaaacacacaccgaacgttgaactagtatatgacaagagaaatttaggattgattatcttgcgaggcgatcaagttgttagtttcactatagaaagcaatgctccactcaccgatgtcaaaagtagattagatcgaccaatcaaaaagccagtaagtagaatgaaaaaaatcattgcatga

SEQ ID NO: 586 - DNA, 591 bp, Candida albicans
attgaaaccaaaacaactttcatgaaaaatcgacagcaattcagtagttactctgtgcataaatcaaattgctacagcccacaaattatgtcagacgaatctaaacctattgaagaacccccaattgaatctaagccacaagaggagcaagataccgaaaaagaatctcttaccaactcagaagaatccaagaaaagagctgttgaaccatcaacagacaaaaaaaagaagaggagaagaagaaactacgatgaagaggacaaagagttagaaaaagaagaagccaaagaaaagaatgctaaaaccgaaaataatgaagaaggcgatgatgatgaagatgatgaagatgatgactatgaacaagggaaactagaagatgaggaggaagaggaagatgaattgttggaaattgatgaatccaatattataactactggcagaagaacaaggggtaaagtaattgactttactaaagcagctgaggagttggataaggaacgtggagtagttgcagaagaggacgaagaagaggaggaagaagaagaaaaagaaaacgaagatgatgatttcaaagaacaagttcaaaattaa

SEQ ID NO: 587 - DNA, 450 bp, Candida albicans
agcatgaacagtcaaatagatccaaaaaatgataattatccccaatccactagcaacaacaagtacagcaacaacaacaacaacaattacccacaaccaacaagttacaataattacccacaacccaacagttacagtaattacaagaatctatttgatgtcagcaatagtgatacgactgatgacgaaaaaactgaagttgaaagtgatatggaatcgacaatcagatcgttgcaatcaactactttggcaacaacagttaaccactcagtagcttacaaccataaggacgaacaccagagtaaaatggcacgagccaattcttatgatcaaactaaatcaacatttactagtttgcgatccaatattaagaataaattgaaattcagaacacacagaagttcaagtgaacaattaggtatgtattattattttctgttcattaattag

SEQ ID NO: 588 - DNA, 480 bp, Candida albicans
ctaagcatgaacagtcgaatagatccaaaaaatgataattatccccaacccactagcaacaactatagcaataacaattacccacaacccacaaactatagtaattacccacaaccaacaagttacaataattacccacaacccaacagttacagtaattacaagaatctatttgatgtcagcaatagtgatacgactgatgacgaaaaaactgaagttgaaagtgatatggaatcgacaatcagatcgttgcaatcaactactttggcaacaacagttaaccactcagtagcttacaaccataaggacgaacaccagagtaaaatggcacgagccaattcttatgatcaaactaaatcaacgtttactagtttgcgatccaatattaagaataaattgaaattcagaatacatagaagttcaagtgaacaattaggtatgtattattattattttctgttcattaattggttgacttga

SEQ ID NO: 589 - DNA, 498 bp, Candida albicans
aaaaaaaagaaaaagaataatccgagaaaactaactcttttctacactatttttctttacctctacattaaccaaaacacaatgcttggatattttgaatcaattattccttatactaatggtgggaaacttccatattggcttttgtttatttccgtggtatcaattttcaattctgttcaaacttatcaaaacatcaatttgactaaaagagtatacgaaaaaaatccaaatcaagtatctccattatcagcaagaacttttggaacttggacattaattacttcaatagtaagattttatggtgcttattatttacaaaataaacaaatttatgaattgactcaattcacatttgctattgctgcctggcattttttgagtgaatggttatattttggaacttgtaaattgggtaaaggattaagtggtccattgattgttagttctgttagtttggtttggatgtatttgcaaaaggacttttatgtcaattga

SEQ ID NO: 590 - DNA, 1446 bp, Candida albicans
atatcagggagtattgtctcatatacacaaagctttttatgcataatgtttttgagaaaaaaacctccacaaatatcgacactagacgagcttcaacaaacgtataatgattgttgtaatttgacgataaaaaacctaacattggaagaagaaaacaacgtggaagatgctttgaaaggttggaaaagcttgcatacctcattattatacaaattggatatatttgataaaatgagttcaaaattgaatcctgaagagaagacaatattgggcgagttaaagggaattcgtgatgaaaacatcaagcacttgatacgtgtacaattacgattggatgaagtgaatcgaagaaagcatagggaagcaaaccatggagcaccacctccaccgccaccgccaagatcaactgtgagcaatagtactagcaacataaatgtcccactgacactaagaaattcgtcgtcacagtcaacgtcagcaggtggtgctgcttccagacctatgatgaaatcgttgcgcccgcattctaatggacacagtgcatcgtcgtcgtcatcattatccaaaactcatgccagattgaagcccaaatcagttcaagaggcatcaactgcagcaagtgcatcatggactaaacccataacttcacaacaaaaatatcaaatatcgaaatcaaatttgaagagtaaaaaggatgatttattccaagattttgatcaggatacttatacacccaatcgaaatgatagtggtaattgggaaaaatttgcaaattctcgatcgtcgtcgggattgtcagaatactcaaatgaagaagatgggggtgattacaatttaatagatctagatgattataatggtaacggaagtctatcacattcaatggatgatttaacaataaaaccagtgattagtcccaaagatgcttcatcatcttcagcatacacatcaatacccgcacagcaacatcatactccagtacagtctaaatcactggcaggaaatgcaaacaagtctaatggtttattaagaccatcccagcaaatggaacacatttctaaaagtacttcggatataagaacaaaaccaaagatcccatacgtttatactaaacccaaaccaatgaacattcaaaggctaatgagacaactggcttcacaatccaaatcatcgccatcgtcgtcgtcgccgtcgaacaagccagtaactacaagtaaagttgcagctacaacagccggtaaaactgcaaagcccaagcttaaatcaaatattacatataattttgtccgtgcaccagcaccaggaaaacttaaagcagcaaattctacccctagtactactagtagaccgggtactaatggaacctcagctggtactgtcaatacacagggaagtaaacaaccatcaacttcagtacgacgccccaaccaagccagcagaagatga

SEQ ID NO: 591 - DNA, 309 bp, Candida albicans
gaatcaggagaatttggtggatatgaattatgtatggcagggaaagatgaagaagaagaaggcgaagacgatgatgacgatgatccagcaatttataaagttagtgatcataatgatgatagtttattatttacaaaccaatgtaaatggaattcattgacattaatggttagagacccttcggtgttgaaatttattaaatatgttagtattaatgccaaaggttccagatgggatattagttgccaatggaatgtcaagacagatgacgatgaagaagatgatgaagaagagggtaatgaaaattaa

SEQ ID NO: 592 - DNA, 1422 bp, Candida albicans
acactactttcaacaagggaagacattcattcattttttaatcaacaaatctgggacacaaaatttcaagatgatttgaaaacaaccattaccgaatcacaaccttatagatggggaactataaaaggattaatggatgatacattattaagacaagttagaaaagaagtattatcagaaattgccttcacgaaaaaggagactgatatttataaagttttccaactgggtgatttggccaatttactgggattagattgggatgatttactgagactccctagtttatataaattacgtgctgggatttattctcaagaatttagagatgttattagtaaagtaactggatgtgggaaattaagtgggattaaaacagacatgtcaatcaatacttatagaaaaggatgtcatttattgactcatgatgatgtcattggtagtagaagagttagttttatattatatttacctgaaccagataaaacttggaaagaaaattatggtggtgcattaagattattcccagctattgtccccaatgtcccgaaaactgattttagtgccaaattagtcccacaatttaatcaaattgcatttttcaccgtgcaaccaggattatcatttcatgatgttgaagaagtaagagtagataaacatagattgtcaatccaaggatggtttcatattccacaaccaggtgaagatggatatatccctggtgaacaagaagaaacggaggcaagatcaacattacaacaattacaaagtaaagaattacaagaatttgattttcctaaacctattagaaatgattttgatgaacaacaaatagatatattggggaaaacaattgataataaattagatgataaggattgggaatatttatctgaatttatcaatccagtttatttgaaaccagaaactcttgaacaattgaataaaacttttgttgaagaatcagttattgaaatcaatgaaattttgaaaaaagaatatgccgataatcttagaactattatgcgtgacccttttaattgggaaatcaatactcctgctccacaattagcatctgaagttaaacatccatggaaagtagctgttcctccacataaacaaagatttttatatattgatggtaaatcacctattgaattaactgaagcggggattaatcttgctaatagaataggaccacaagaattacctaattttaaattattggcagaaactgaaactaatgaagttgatcaaaaattaactaaacttggttcatttttaaaatccatggcatttaaaaaatggttgaaattagtcactagtttaatcaatatttctgatcaaattttgatcactcgatttagaccagtttcaagattttatattggcaaatactacggggatagaattggcacgtaa

SEQ ID NO: 593 - DNA, 888 bp, Candida albicans
tccaaaactggtgatatttaccttcttctatttttttttctcttattgaattacatcatagaatcacctcaccacccaagcatagcaatgccaattaattctgagtcatgtcccttgtgtaaagtgcacagcaatacaatcaaaaaagaagacgaagatgaagaagacaacaaaacttcatggattcaatgttctaaatgcaaagtatggtaccatgtccattgtttggaccttccaactgatgaaatagatcagatagttatctatcattgtcctgaatgtgtgcccaaatatggagaatctacctataaaagaaaatctaaacgtgccagagtatctattgactatcaatctttgaatgaaggagatacatttgcaattgacaaatcgagccatttccatttacacaattttttaaactttaagggagaaacaaacattaatgtgattgataaactcacaaagacatatgcattgaacacacaaatggagaaaccaattcttattccacaagcagatttgtccaaaaatggaatgcaactccccattgagaaaaacgaaattacaattgattatattactgattgctgcggagaagatacacctttggaggtgatggatgtgatatcacaacaaggtatatctccaccatggaaattgaagcaatggcgagagtatttcaagactaatgaagagaaacgtgatagaatacgaaatgtgatatccgtggagatatctgatgttgcaaaattgggtgttgatttcacaccgacccaagtgtgttcgagaactggaatgtatggaatccggtgtggattgaacaggaagaacctccagagaagccgagtcgccccaatacgggtcttaggttccggggaagaattcctt

SEQ ID NO: 594 - DNA, 819 bp, Candida albicans
  unsure (761),(763),(788),(807): Identity of nucleotide sequences at the above locations are unknown.
gcaatggaacacaataagaaattaggagttacccatgctatacgagaaaaactaaatttccatgatgaaaggttatggaagcggtttagtgccagaaggttagaattaatcgatacactagatttgagttctcgtaaggcaagtgaacaagaactggaaattagaagggtttcagaaatgctacgattagaatttgattatcctgcttcttatacttcagatttcaacaaattagttcgagcagcaatacaaagtgttcgaagaaatagaaaacggtcatccaaaaaacacaccagtcctgaagaaccatctttgaaaaggaataaactagatgatagtgatctgaatggtaatgtgaatgggagtaatagcaattcgtttttgtcggaaattgtccgtaatgaagatgacgtttatgatgtgaactacaacagagagaaaagattcactagtgacgatcaagcaaaagacactattgacaatatgactaaacctcgattaccaccattgactaatctcagcatgaatgagacaataaatattcctctggctgctgctgctaagaagaatattcttaataaaattgaaaaatcaagatcttgcaatgaaagtgttaattccaaactggaaaatttacaatttttaggcaaatcagtaatgtctacttgtattgggtacattttcgaaaaatcttttctgcatgtaaatccacaatcaatgttgtatttacgaaataaattgagtcgtgagctctcattgtntnaaattggcccaaaagccacaagatnaaaagatcccgctccaacnagaaaccaagat

SEQ ID NO: 595 - DNA, 288 bp, Candida albicans
aaacgacttgccaatgaaagaactttcctttcttggttgagtgttggtatgttgattggtggtgttgccactgctttattgaactatggttccaatagtactttgacagcatctattgggttctttattgctgctttgttcatcattggctattccacgtataaatatttgtggagagttcttatgattagagaaaagaaggcagtggcatatggagacaaatttggtccaaatatgatttgtggtgttatctttttagcaatttttattaattatttagttttgtaa

SEQ ID NO: 596 - DNA, 564 bp, Candida albicans
ggagctttaaaagtattacaaaatcaatatgattcagtaacatttagagatcccaataataataaacctatagatatccaaaaattaacgacccaacaaatcaagtattcatcaccaatatcaaaattaatatttaaaaatttaatgcaagtgaaaaaattaagtgggagacaaattaatcgaaatttagcacttgctttattaggtactgatgggaaacaattacaagattcatattatatttgtgagaatgttaaagaattattaaaaattgataatgatattgaaagagcaatgtatttatgtcaaatttccgataaaaattgtagtattgttggttcaaatgaaattttacaatggttattatcaaaagggaaaattaatcaagctttgaaattgtttagtaaacggaaatcaagtggtatacctacaaatttacaaacttatgtgattttatttcatggaattgctaaagccataccatggggtgacgacaatcaacaaaaacaacaaggaagtactattgttaatgaatcttcaccacgggctggaaggaccgcgatc

SEQ ID NO: 597 - DNA, 633 bp, Candida albicans
gaaaccgaaaactatttcattgatttcgaaggttccaccatcaagccatttattttgactagttacccaaaatttgttgcttatcaaggcgctaaaatctacaatttagaagaagacgttccgggatacaaagagatggaagaattggaaaaacaacaatacgagtttatgtattataagaccagaaatgaaagaatgtgggaatttgaattgaataaatatagacatgatttgattgctattgcttctcctcacattaaggttttgaaaagtccatatttacaagccttggatgtgaagaacggcaaagattatttgtatgttgaagggtccattgtccaattacaagccatgtgggaagcctatgtcgccaacgaacttgtcaattccaaggacactaaattcccaatagaatatacagctgaatatttggatcaacatcagcaggaattgagtgattaccaattggaaaccgtgtccagtccattttcagcaactggaggttggatcccgcaagatatgtttgacactttaaaagcacagggtattcttgttgagaccaaggatggtaattataaagttgaaaccgaaaaggtgttagaaaacccacctgcccaacctgaagaaaaataa

SEQ ID NO: 598 - DNA, 630 bp, Candida albicans
  unsure (556),(575),(597): Identity of nucleotide sequences at the above locations are unknown.
gaaaatttctccagcaaaaattgcttgcaacaatttgctttttttttgcataattactaccatcagcagcttacatatctgtattattcaaaaatgttatcaagagttgctagatgctcaagaactttaaaccaagtaaccagaaatggccaaagcggtttattttcagctgtattgagaacttctattcgtcaaaactcaaccgactcaccagcatcaaacaatgctaatgaaatttataccaaactttctgataccaaggatcctcaacgcaaccaatttttccaatatacttggggatcttggttgactaatgacaagtccaaaaagaaacagagagaaactacattttctattgaagggttgaccttatttatcgatagaatcaatcaattggaatcaaaactcgcccaaccaaaaagtttggaaggtgcatttgtgttggctaacaataaggaattattaggctcaactaaggacaaagttattgtcagatcaattgcctcgatacatgaggtagacatcccgtgtacacaaatcactttgaacaccgtanagaaaagtcttaaaattcntttaaggtccatcagatccgcnttgtttagtcgccacacggcctggaatcgcgta

SEQ ID NO: 599 - DNA, 1632 bp, Candida albicans
tgccaggcattaaacctaacaaaaacaacaaagaaatattcatcaaagatggctcttacaggtaaaatgggatcacatgagagagctggcaccgctcaatatgaaagagcaggactgtacaagaaatccaaaaggcatactaaagataaaaagttgaattcgaaattacaaagaattgacagacagtataaagaggccattcagtcagcagcaggaaccgatttattgttacaagaagaacaggggtttttagaagcagaaaatgatatggaaaaaacgttcaaatttaagcaagatgaaatagcagatgctgtagatagtagtactgccaataagaaatttgaactaaagttaccagaatttggaccatacacaatcgactattctcgtactgggcgtgatttgttattaggaggtaaaaagggacatgttgcttccattgattggaggaaagggaaactaggttgtgaattacatcttaatgaaacagtgcatgcagtaaagtatttacacaatgatcaatactttgctgtagcgcaaaagaaatacacttttatttatgataatcaaggtacagaattgcacagacttaaacagcacatagaggctacgttattagactttttgccctatcattttcttttagtaactgctggtcacacagggttcttgaaataccacgacgtgtcaacaggtcaattagtaagtgaactcagaacgaaattaggtccgactcaagcaatgaaacacaatccatggaatgcagttacatgcttgggtcacggtaatggaactgtaagtatgtgggccccgaatatgccagagccattggtcaaattgcaagttgcaagaggaccaatcagagacttggccatcgatagagaagggaagtatatggcagtagcagccgcagacaaaactttgaaaatttgggatataagaaaattcaaagaggttgataactattactcacaaactccagcatccagcttagacatatctgatacaggcctactctcagtaggttggggtccccatgttaccatctggaaggacattttaaaaggcaaacaccaatctgagccatacatgaatcatttaataccgggatcaaaaattgaaaaggccaagtttgtgccatttgaggatatattaggtgttggtcatgaagaaggtttcaattctattatcgttccaggatcaggtgaagctaactacgatgctcttgaattgaatccttacgaatcagtgaaacaaagacaacaacaagaagtcagatcattgcttgataaattgcctgcagacactatcgctcttgatccaaatgttattggtaccgttgacaaacgcgctagtactgtgagattgaaacccggtgaaatcacagaattggcagataaaacacaacagtctaaggataagatggagattaaagcagaagtgaaagggaaaaattctgctttgagaagacatatgagaaaaaagactcaaaacgtgatagatcaaaggaaattaagaattgaaaagaatttgaagatggaaaaggaagctagacagagaagacgtaatttggaacaaggaatacccgaggagaaggatctcttgggtccagctttagctagatttaaatag

SEQ ID NO: 600 - DNA, 948 bp, Candida albicans
agtgttcaatatattggtttacagtttttaaaaagcactaatcaccacaacatgtcggaaccagtagttgatacagctgaactttcggctgaagagaaaaagagattacttagagaaagaagacaagcaaagatgtcaaagggcaaggcaactgccaggttgaacgatattttgtcgcagggttcgtccgtgaagacatcgggagtgaaatcagtcttggatcaagagaaagaggccacgccaagtcacgatgaagatccagaaattcaagatatcacagagataactacccctcctccaagaacaccaccaattggtgaagatgctcctcaggatatagataagattttccaaagtatgcttcaacaacaaggacagggggcagatactgctggcgacccttttgctcaaataatgaagatgtttaatcaagttgagggtggtgattcaccacccagtgaaagtgcaacttcgacacaggatccagcagagctcaaatatcgccaagagttactcgaatataacacttataatcaaaaattgtggaaatttagatttttattggttcgtgtttcagtgaccttattcaacttcttttatcattacattaacctctccaactttcatgcatcgaattacgcttatgttagagatttgtcgtctgagaaatatcctgttcgagactttttcacttggtttgccactacagaagttgttcttgtggcagcttactattcgatatttcattctttggggttatttcatgcagccaatcaaaacagttttgttttgaaagctatgtcaatgggttcaatggtgttgccgcaattggaacattataagccattggttgctaggtttttggggtattatgaactacttggtatagttttgggtgacttgtcattagtcatagtattgtttggtttacttagttttgcaaattga

SEQ ID NO: 601 - DNA, 2478 bp, Candida albicans
  unsure (2477): Identity of nucleotide sequences at the above locations are unknown.
agacttcaagaaatatcattcttgatatcgactttattaaaaaatttcaatgggataattgcatacctgatcaatgactttacaagcattaaaaatctgcttatgaatttgcagaaaaagaataccaaagtacgagaatcgattttagatttgttattggatgctttaatgatccaaagctttccttggttgaaaaactcacccattggagattcaataatgagatataatgagttatttaacgatggctatcaattcaaatttgagttcaaaccaatagacgatgaattcagcaaaaacatattacaccatcatcaaggactcctaacgttgatacttatggaaaatggcatttggaaacatttaactcagataattgaagaaaatcgtgggatagacatcccatcacgcagcattgaacataaacgagcaactatgttattgacaaatttgtatgcaatggcaaacaactatttgcccgccgaattaattggtgaaaaactgttactccctgatttatctttatgtgcttcatttgaaattttcaatgaaacaagacatgaatttcgtcctacaccagagtacaatcaacacgtgaaatcaagcattaaacaacttaatatacaggcaaaatataacattgatgataacaccttcaaaactatggttagtaatagtaagatactagcagttaaagagtttgaagactggaattggcaattgctattaactttaatccaaggccccttaggtaatccaaaaagatttgatgaagttttagaaaaagttccaaaatttttcaaaagattattgtcattttatcggccatttaaatatcggttttccacagtatctctaacaaaagataaaaatagtttcaaatacattaacattggttgtcaattgattgaattatttttaagtttagacaatggtatcaagtacctaagcaaatctaaattattacctcaaatttccgagatagtggcacaaattgacccctttagtgggataacctcaaaggacccaattttgagcgaaaagagacttgaaacaacggcgtcagtgggatatttgagatttattggtgttttaagtagtcatagcctgggaattcgaatgttggaacaatggcagtttttcacactatttttaaatataatatcttcaagcactgaatcagaaactaacaatttgtttatattaacaattttcaagtatgcggatttttccattgattccccgtttagaaatacattggaaatggcaatcagagtaagcaactttaaaatcagaaactatatattaaaacacgtattaccccgattaattaagactgaagaatgcagattatttataattagatttttggtagaaaatttatattgtattggaccaagtgaaaacgggaatggcgatggagaaattgtcacaaaatccattgaaatattatatcattattatcaggaagacaattttagtaatttggatacattaatccagtatcaacccctgattgaagtactacaaaagtatcgattaggcaaaaagttattgaacaactttttaagatttcctgaagggttcaaatatttggaacgattagggtatttagaagagaaatttaacaaattgacacaagcactagatttcaagtatctttacaaaatcaactcaattattcaatatcagttttaccctcacgtatttcatgctaataacaatttaaacaatgctgataatgacaataatgatgccgatgatcagctttcgatttattttttaaagaatttactatctaccgaggaaggattaaactttttccaatttggtaaaggtaaagaattcttacattcaattttattatcaacagaaataattttccaacaaatttctcaagatgcaaaatttcatgacattgaaaatcaagatgatgaagaagttaaatttttaatcaatgccgttaaacaaaacctttggttgataggaaatttggcccttggagaatttggaattcaattattagatccaatgtataataattcattaaacgctaataataattcaataatcaacataatcattgacaattttaaaacttgctcaatttggcaaataagaggtatttgtttttatgtgttaggaatgattgccagtacaattgaagggattgagattcttgatgaattcaattgggttagttgtgttgatcaatatggcaattgcaagagattatcgtacccaaaagttgaaaacttggttgaaattttcagcatagagatgagtaatccctatagagatacaagatattatcatattttcaacagcattccagtggaagtgactgaagctaattctaacacgatcaataatgacacgggtgataatattgaggaattggtcattagtgataacaccgataagccgctggttgatgagaatggtggtggtggagaaacagaagacgatcaattctna

SEQ ID NO: 602 - DNA, 915 bp, Candida albicans
ggaacccttaaattgaacaaaaaaagccccctctctcatttgaagaacctcccaattattgcaacaataacaactactacaaaaacacgtatacattacctaccaaagatgttgaatctgatatcttggatatatattttctatttattcataacatcgattctagcatttgattttggattaggacctacttattataaacatggagataaagttgatttattagtcaataaaatagaatcagatactacacaattaccatttgcttatcatagtttaccatttgtttgtcgtcccattaatggtgctaaaccagttcatttatcattaggtgaattacttaaaggtgatagaatttggcaaagtggatatcaattagaatttggggttgatgttccttgtaatcgattatgtgatatggtactttctactcatgcaattaaacgagcttctgatcttataaaagatggttatgttgttcattggaccgttgatggattacctggagccacaacttttgaatcaactaaccaccgaaataaatattatgccgcgggattccccttgggatttgttagccctagtgatgatgagcaattgagttatatatataatcatgttatgttagtgattagatatcatcgagaaaaagaaaccgcatccaaaaatggtggggatcctaaatatactattgttgggtttgaagtttatccgaaaagtgttaatgatgaacattgtcctggatctctgaaaaattatcaaaatttaccattattttattctgttgatgataaaaatcaattgattgaaagtaaaacaacaattgcttatacttattcagtttattggcgggaagacaattctattgatctctcaccacgagctgccggaaacccgccctattgtgtggggcaa

SEQ ID NO: 603 - DNA, 801 bp, Candida albicans
ttaggactatcaacgatgccacaaaatgagtatattgaacagcatataaagaaacacgggagaagattagattatgaagaaagaaagagaaagaaggaagccagagagggacatagggtggccaaggatgcgcagacattgaagggttggagagccaaacaatttgctaagaagagatacgctgaaaaggttgctatgaagaaaaagatcaaagctcatcaagaaagtaaagtcaagggaccatcaacaccaaaggccgaagatggtgaggccttgccaacgtatttattagatcgtcaaactaacaatacggccaaggcaatctcaagttcgattaaacaaaaacgtttagaaaaagccgataaattccaagttccattgcctaaagttaaaggtatttctgaagaggaaatgttcaaagtgatcaaaaccgggaagtcgaaatcaaagtcatggaagagaatgatcaccaaacatacttttgttggtgaagggttcactcgtagaccagtgaaaatggagagaatcatccgtcctgctgcattaagacagaagaaagccaatgttactcatcctgaacttggggtaacggtatttctacctatattgggggtgaaaaagaacccgcaatctccaatgtatacacagttgggtgttttgacaaaaggtacgattatagaggtcaacgtgtcggaattggggttggtaactgcagggggtaaagttgtttggggtaaatacgctcaaatcaccaatgcaccagatagagacgggtgcgtaaatgctgtgttattagtataa

SEQ ID NO: 604 - DNA, 300 bp, Candida albicans
caatttatcagcccggagctcggcgtcaccgtgcaactgcccatcctgggcgtcaagaagaacccgcagaaccctctctacacccaactgggagtcctgaccaagggaaccatcatcgaagtcaacgtctccgaattgggtctcgtcacgacaagcggaaaggtcgtatggggtaaatatgcgcagatcaccaatactcctgagaacgatggcacggtcaatgcgtatgtgacctttcaccaatgtatctcccaagacagagtcatgctaatcttcgtgcgcagagtcctcctggtctaa

SEQ ID NO: 605 - DNA, 1257 bp, Candida albicans
agtcgtagaggagatgagataggtctggcttattttttttcttctactagcacccaaattttttcttttctctctcataaatcgatggagcacaaaacgaaccatttggattcttcgatgagtttgtttgaaaaaaaaaaaaaagagccccacttacactacacacacgttattcaaacccttaacttcaaaccaagagtatcgaccatgtcaaaggtagacactgtattaaaggaaatcatctcgtctaccaagtcaactgaagcttcagtgaaagagttgatagcttttgtcaaggactcgtcttcccaacatccagaattggtgcggaacttgttagcaaaatcaaacctgctgttagaaggggtatcgttgttggggttgaaaaacgaatcgttggtgtcctatatcaacaatatagtgcttgttgttttgtctcatctagagcgtctagaaagcgatctggagacgggatccagcgctgtcgaacgatcgataattcaaagggtgacattggaaaagggcgttaaacctctagaaaagaaactcagttatcagttggataaaatgatcagggcatatggacggatggaacaagacgaaatcaaagctgaacagaagttaaacgatagaggaagtggggagaacgatgagaacgatgagaacgattctgaggaagattctgaagaagattctgaagacgactctgaggacgacgaattggcttatagaccagatgcatcatcgtttgctaaattgacatcggccaaaaccaaactgaaaccaacatcatcagcagtctctacatcgaatgaaaagtatagaccaccaaagatatcagcaatggcacctccaactgcagtaaagagccacgaccttgatgccaacaccacgtcgtcaaagaaccgtaaattacagagcatggaagagtacttgcaagagcaaagtgatatgccaatggtggaggcatcggtggggtctacaattgtggagcatggaagaggtggtgttaaaacacagcacgatcgtaagaaagaacgagagatacaaacgtatgaagaggataattttgtcagactaccaaccagtcaaacaaagaaaagtttcaaggaaaaacaacgtgatatccgtaatcaatttgctggtgaagactggtcgatgtttaataataacaaggatgtgacccgtcaaggcacatcgcgaaagagaaaggcaaccaccgtttgggacaaagtcaagaaaaagaagaatacttag

SEQ ID NO: 606 - DNA, 624 bp, Candida albicans
tatctactagtgattgataattgcattatgagtaaaccaccacagcaacccccatttccaaataaatatcatgttaaactagttgcatctccggattcaaaagcttgtcttatatgttataaaccagcaacaacagttctactagctgatggtaatggtgattttttctatacttgtccacaacatttattagatgatcaatttgccaatgccatacatcctcaagaatacactgaactactagacaaaaaacagacactcacggacaagaaatcaaaattggagaaagatgttgagtcggaaaaaccatacatttggaacactgtggcaggatattggaaacagaaggataaagataaagacaagggcaaggataaggataaggacaaatctacagagtcgaaatatgaaaaattgaaacaagaattggtcgatgttacaaaagaattagaagaaacaagtaagaaaatcctggagtttaaattcaaattgtatcaattgaatcaagacatttataaaaatagattgatgtcttatcaaaaaaagaaatatagtcaacaaagagcggtgaaaattcaggaagaagggtttttcccatcagtacctaagcatagtttagaataa

SEQ ID NO: 607 - DNA, 375 bp, Candida albicans
tatctactagtgattgatgattgcattatgagtaaaccaccacagcaacccccatttccgaataaatatcatgttaaactagttgcatctctggattcaaaagcttgtcttatatgttataaaccagcaacaacagttctactagctgatggtaatggtgattttttctatacttgtccacaacatttattagataatcaatttgccaatgccatacatcctcaagagtacactgaactactagacaaaaaacagacactcacggacaagaaatcaaaattggagaaagatgttgagtcggaaaaaccatatatttggaacactgtggcaggatattcgaagtcttcaccgccgatgggcctaacgcgggagggt

SEQ ID NO: 608 - DNA, 1656 bp, Candida albicans
ggcacaagttattggcttgacgtagaagtttgcaaagattttcacaatatcatgtctacgttaatacctacagcaagcgcctgttacagtctacaattaccccccaccgaaaaggatgatcgattgaatttgaatgttagaacaggctcagcatatacattatacaactcattaatctttgtccatggaggattaacaataggtttagaactactcaactacaccatccctgaactaaatgagattttttacaatcgaattaatatatcagcatcaaaatataaaactgtcgaaaaatacttgtccggggagctcttttacttaagtttaatagaaagaaactggtctcgtgtcgtccttgaagaattagaaatacgaccaaaacctagattattgcatcagatttgtgcattcaacaattgtctatatctatttggtggattggctctactgcaagaaaatgacgaagacccaacattagttccatgcaatgacttatgggaatttgatttggtacttaagaaatggacattactagatgatggatcaaattatgaactagacgatgctgtgccatctccacgttttaaccataaattgactgttatttccagcttatcctttgcaaacagaaaagaccattttggattatttattgccggaggtaaagataaacaatccaatgaaatttacgacaattctatttttgacttggtggagaaaagatatgtgggatcacaacctttccgtttagtagccactactggagacgacacaaaggacaaagaaactggattgaacgaatttgtttcaaacccagaacatttcttgaatgtcgatcaaacaagaaatgctatcttgagcatcaccgatgatgccgacacaccaaaccgaaaacagaacaaaaatcctagcaaccatcatgagagtattgtagtgtatggcccaactcgacaaaccggagattgtcaaaactccttggtttcatttaaagtagggaaaagggaaataaaaggtggtaaagtattacgtcttcacaaaaattcacgggtcgcaaaattaaaacaactgatcatcccttataatctaagatatccaactgcaggtttgtttggtcaaaatgttgtgctaactgggtttctacctgatgaatacgagatctcaatttttgtttacaatagacctacaggcaaatggtcgcgattaaacattttctgtagccatgaatacggcagtcatagattttggggcggatttgcatggcaatctcatcataaggttattttaattggtaacagtatgacttctagaacaactagtagtgtccggtttttcagtattatgttgactgttagcttgcccatcaccaatattctagtcagttctgaattgtcaaaaggtcggtcaaataataggactagttcatttgtttctcatggcgaacaaagacaccaccgaaataagagtcagaatgacagcttgttgaaagccgaactttcacttgaaagtacaacagaggatctgacagacagtagcagcgaaaaaaacgccgaaagtgtgttagacgctcctgttccattggccaatctgaagaagaaaacattctcgtcccttgggagcgaaaaaatcacgactgctgttaagtttaatgaataa

SEQ ID NO: 609 - DNA, 558 bp, Candida albicans
ttacttagtgtcgttacattgagagacataatgacacttgcgagataccccaaagcagtagtttttgatctagactatactttatggccatgttggtgcgacactcacattatgactccgttgaaatcggtctcgccaacaactgtcgttgatcgttacgatttccagctatcattttataaagatgtcgaatcaattattcgggaactagttgaaaatgatgtgaagattatagctgctagtagaactgcaacaccccatattgctaagcagctattgtcaatgttgcatattcagggaaggccagcaatcgagtactttcatagtttacaatggggcacgggatcaaagacaaagcatatcaaagcagcagcgaaaaatctaaaaatgacaacagagttaacagacggtgaattcattttatttgacgacgaatggagaaatagagatgtcgagtcgatcaattgtcattttgctcatgttcccgatgaatcagtaggtttaacacgacacatttttgttcaagaattgagacaatggaacaaacggaatttatag

SEQ ID NO: 610 - DNA, 456 bp, Candida albicans
cttataactatgtctattctcgaactactgaaggaaattgacaagctagctaagattataaatgaaaaaaacaaggagctagaaactttacaaaagaattatgattcgaaactacatactatcaataaatacatcgagtccatcagtccatccacaacaggcactgtaccagaagaacaactaataaatgcgatatccaaacctattgaatgcccacattgtcatcaaaagttatgggataatcaagagaaatctacgtttttgttaattccaaagcaaaagatagacacaaagtttgataccacagttgcagtccgagatgaacagcctcaacaattgacaacctcaactaccagtaataagcagaaaaagaaaacaaatatagtttgctcatattgtaaaatgactggtcacactagagccaagtgtcgtaaaagattgaacactcctgtgtaa

SEQ ID NO: 611 - DNA, 900 bp, Candida albicans
ttcagtgaatcctggtttttctttttttttttatttctatacaattatacaatggagttgcttaccatagagagattcttaccattcttagaaccttttgaaggtaaagaattgttgacaccatcggaatgttccaagttgtccttgattatagtggaggttttggttgatcgttatgttgattttaaattgttgaaattcttgagccggtttttgactcaggaattgtatgatgaactaatagaagttaggaatatcgaacatgcatgtggatacataaagtgcaatcggtcaccgaaatcattgttgcgtcgatggtctatgaatagtaacgggataacacaagccggttcagaaagcgatccagttgcatcaaccaaatatcaaatctacaatagaagacctaccatgatattacccaacacgtatctttcccaatactgttgcaaagaacattaccaagcttcgattttttacagaaaccaactcagcaacgaagcacttttttccagaaagaatatatttacaacgccgccgttctcgtcagataaattcaattggtacgagaattccattacctgtttggaagaagtaattgcaaaacacaaggaattgaaacaatatggtaaatcgatttccgaggtgattgctatgatgaatggattgactgtgagtgacttgaataataatagtgaactaaatgatgagacaaaccaattaataaaactaattgaagattttgagattgtggagaacaatgaacccaacatgaatggagatctagaagaagtcgatgaagaaggttatacccaggataacgaagaaaacatacataatataacgaacaatgtggaaggttatgtgacatccaacaaaagttttggtgggtacgttgtgtag

SEQ ID NO: 612 - DNA, 2064 bp, Candida albicans
caattcgtcaattattggacacccaattcaaataacagtgtaaagagaaattgtgacactacactaccctctaacagctcaaatactcaccgaaacagacattctaatacttcataccatatgagaaggaagagaagcaatggtggccacagctcgcgcagcaacagtagaggtcgaaccaaaagaacggacctgatagtcaataatgaaattgaagagccatttccacaagtgagagggaaatccaaaacaactacaaaggatcaactcaaaccttgcaagtcatccgatcaagcccagctgcgatcaagagccaattctgtattcagttttatatttgataaaatttcagtgcatcaaccacgcaaagatggatccaaagggttctcattatataagttattgttgttagagctaaatttgaattcgaatgatacattaacactggagaaaagtactgattcaatgaatgataatcattttgaagaattacaaaacatgatcaaaataccgttttgtcttgaaaaatttatgatattcggactcttagtatgtctaaactcatttttatcattatttacattggcacctttgaaagtactcatcatatcatcccaatcagcataccagtttttgacgaagcaacagacttttcaattttgccgcttcagactaataaagaaagacgttattactttaagcataataattttatccatagtggtattgtcaaatcgaaaattggatatttccagaatgtaccacgacgtgcgaggccaaacagatataaaactatacgtaatgtttggggttcttgagtgtgctgaaaagctctgttcctcaattggtcaggatatcttgaacgttttatatgaatcatcacccaatagaaacatttatcgttttgtatccttctatttattgtcaacattctatttgtcattccatgcatatattttgatttaccaaacagtctccttgaatgtggctgctaattcatactcaaatgctttaatgacgttgctattatcgaaccagtttgccgaattaaagagttctgtttttaaaaagtttgaacgtgaaggtttattccaaataaccatggctgatttgacagaaagattccaattgtccttaatgttaggtattatcgcgctcaagaacttgcttcaactaagtgtcactggggggttgatacctaatagttggaaaagttggaaccgttgggttggtgcggtttttggacccagtgtagtggttattggatccgaaatatttgttgattggataaagcattgtttcattgcaaagtttaataagatacgtcctaaagtttacaagaattttttgtatgttctgtgtttggatttcttggaggtgtttaaaactaacaccaaaagcgggaaatcttctcacgagtttactgattatattgtgttgactagaaggatcggattgccattactagcatccgtcgtttgtttcttgaggatgattttagctgatttaaaacatatttttgtttttcccgtagcaggttcaaatttctacgccataatcactagtgggtcattaattgtgcttacattcttcacgttattgctaataagagtgatcctttgtatgttgattttcaaaatagccaacgtgttagttactcaacacaaacagcaccaagaaaaattacgaaagaaactaaatgattcccggagtgttgctgctacaagggattaccttctggaaggtaccccatcccctccagataacagaacaaatgatactagtattgacattaatgacagtgcagtagggacatatctatcgtcaccacttggattatcatttcttcctgggtcaccaaatactgaaccttcaacaataaacccaacaacccgagcccagttatatgatgccgatgaaaagatcccacctacaattgaagaaaaacgaaacaaacaactactacaaggagtgttgaatgaagattcctggtgtagtgatagtggcgacgaaggtttatcacaagttatgagatacaagatgtctagtaaaagaatttggtaa

SEQ ID NO: 613 - DNA, 243 bp, Candida albicans
gatcccacagtgctccccattgagattggcgattccaaaatcgagttgccgtgttccttccatgtggtggaaacgagtgttgggatcttgtttggtttagatatgttgagaagacaccggtgtacgattgatttagagagagacgtgttggttattggcaagcacattgaagccaagtttttgagtgaatcggaagtgccaagaaagtctttgggcgggaatatatttcaaagagagaattag

SEQ ID NO: 614 - DNA, 657 bp, Candida albicans
ccccgcacgtggtgcttccagcgcctgttgaaaaccacctctttcccaattccagtcattgttggtttaattgccggtatcgttgttggtgcattattgtactactttggttccagtatgtccatgcaaatcttcttaattatttccacctgtattttgtacttgattgctgctggtttgttctccagaggtatttggtatttcgaaaccaacacttacaataaaaaaactggtggtgatgcttctgaaaacggttctggtccaggtacttacgacatttctaaatctgtttggcacgtcaactgttgtaatccagaaaccgataacggttgggatatcttcaatgccattttgggatggcaaaactctgccacttacggttctgtcatttcctacaacatttactggctctttattatctgtgttttgttgttaatggtttacgaagaaaaacacggccacttgccattcaccaagaatttgactttggtccaattgaacccaatgtaccacatcaagggtaagaagaagttagaattaaacaaagctgaaaaggatgaattgttcactaaacttcaacaacaaaactttggtcaagctgcagaagttgatgaaacttcatcaaacaaattgatcgaatccaaagaaaacaaataa

SEQ ID NO: 615 - DNA, 753 bp, Candida albicans
  unsure (729): Identity of nucleotide sequences at the above locations are unknown.
acaagtttatttcgagcaaagatggttgatcttttcaatgttcaagtcttttttgttgttttcagagaagccttggaagcagttattgttgtttcagtgcttttagcatttgtcaaacaatcaatgggctcctcagcaaacggtccagagttgaagaaaaagttgtatcgtcagatttggctaggggcggggttaggtgttcttatttgtataatcattggtggcgcttttattggtaccttttacgggttgggtaaagatatctggggaaaatcagaagacttgtgggaagggatattttgtatcattgccacagtcttgatcactgctatgggtattccaatgttgagaatcaacaagatgaaagaaaaatggagagttaaattagcacaagctttaatcaaatctccagaaaataagaagaaccgattcaaattgggatatcttgggaaaaagtacgcactttttattttgccattcatcacttgcttgcgtgaaggtttagaagctgttgttttcgttggtggggtcggtattactagtcctgcttcatctttcccaatcccagttattgttggtataatttgtggtcttgcagtgggtgccttgttgtactactttggttccaatatgtcgatgcaaatcttcttgatcatctccacttgtatcttgtacttgatcgctgctggtttgttctccagaggtgtctggttctttgaaagttatcanttcaataaaaaaaactggtggtga

SEQ ID NO: 616 - DNA, 366 bp, Candida albicans
acattaacaatggttgacgtatttaacgttcaaattttcttcatcgttttcagagaatctttggaagctatcattgttgtttcagtgcttttggcattcgttaagcaatctatgggtggtagttccgaccctcaattgaaaaaacgattgtatcgtcagatttggctaggggcggggctaggggttctagtctgtcttattattggttgtgctttcatcggtgcgttctacggtttaggtaaagatatttggggtaattccgaagatctatgggaaggtatcttttgtatcattgccacggtcttgatcactgctatgggtattccaatgttgagaatcaacaagatgaaagaaaaatggagagtc

SEQ ID NO: 617 - DNA, 213 bp, Candida albicans
gaggaaaaacacggacatttaccgttaaccaaaaacttaactttgttccaattgaatccaatgtaccacatcaaaggtaagaagaagttagaattaaacaaagctgaaaaggaagaattgttcaccaaacttcaaaaacaaaagtttggtgatgttcaagaaattgacgaaacttcttctaacaaattagtcgaaactcaagaaaataaataa

SEQ ID NO: 618 - DNA, 1170 bp, Candida albicans
gtgttagattccgattacttttgttatgataccgaccctaacaaccagcacccattgcattatggtactgactcaggtaatttagatgttcgtgaggttattgcccaatgggtcaacaaaaagtttggcgcacaggtctcagaccccaattgtatcaatttgactgctggcgtttcttatggtgttggcaatatattgacatcagtcacgtcccccaaaatcacccaacgggtatttgttgttactcctacatattttttgatcaatagttgtttcgtcgatgttgggttggacgacagattgactgcaattgaagagacacacaacggcaagtacagtattgatttggtgtatctcgagcagcaattgcaaaagtactcccaagacttggagccagtgcatgatgacattaatgtttttcccgaccctgttagaggaaccagaaagtattatcggttcgtaatgtaccttgttccaacattctcaaaccctggaggattgaactatactttagaaacaagacagaagttggtggagattgcaagaaaatatgacttgttgcttatcagcgatgatgtatacgagtttctcgactataccgattccaagccgttgcctcgattgaaccaattagataaagcgggtgccacgaagtatgggaacaccatttccaacgccacattctccaaaatcattgcaccggggttacgagtcggatggcaagaaactgcaaccccaaaattggtcgaccagctatccatcactgggtcaaacagatcaggcggcacgccaaaccagttgtcaaccctcgttgttgccgatttaataaagacaggaacaatagacgaaatcattgcgaaattcaaaaacgtctacaaagaaagagttgcggtgttgaaagagagtattgccaagtacttgccacaagacacacaagtatacggcggagacggaggatactttgtttgggtcgtcacaccgtcagcaaactgtttcgatgtagttgctaaattggctaaacaaaacgttgtgcttgctggcggtgaacattttgaagtcactggcgacaaaagaaattggggccagcactgtgttcgattgtcaattagttatttgacaaccgaagaaatccaacaaggaatcaagatttggggagaacttttagaatag

SEQ ID NO: 619 - DNA, 867 bp, Candida albicans
actttttactcaatgataaacttcttcaagggccaccccagcagggaattgcttcctgtcaatgaaatcgcagactcatacaaaagagtattgttagattccgattacttgtcttacgataccgaccccaacaaccagcacccattgcagtatggtactgacccaggtaatttagatgttcgtgaggttattgcccaatgggttaacaaaaagtttggcgcacaggtctcagaccccaattgtatcaatttgactgctggtgcttcttatggtgttggcaatatattgacctcagtcacgtcccccaaaatcacccagcgggtatctgttgttactcctacatattttttgatcaatagttgttttgttgatgttgggttggacgacagattgactgcaattgaagagacacacaacggcaagtacagtatagatttggcgtatctcgaacagcaattgcaaaagtactcccaaaacttggagccagtgcatgataacattaatgtttttcccgacccaggtagaggaaccagaaagtattatcggttcgtaatgtaccttgttccaacattctcaaaccctggaggattgaactataccttagaaacaagacagaagttggtggagattgcaagaaaatatgacttgttgcttatcagcgatgatgtatacgagtttctcgactataccgattccaagccgttgcctcgattgaaccaattagataaagcgggtgccacgaagtatgggaacaccatttccaacgctacattctccaaaatcattgcacaggggttacgaatcggatggcaagaaactgcaaccccaaaattggtcgaccagctatccatcactgggtcaaacaga

SEQ ID NO: 620 - DNA, 210 bp, Candida albicans
tgctctgatttttcagcacctttggaaatattctcttttgatgttccattgggtattccacaagaattaagagggttaagggaccaagaattaagtgaaaaatcaggaattgatggttgtatatttattcatgctgctggatttattggaggagctaatactaaagaagccgttttggaattagccagattgtctttgaatacaaaatag

SEQ ID NO: 621 - DNA, 1113 bp, Candida albicans
tccatcaaatatggagttttgttccaaccagtactagacgaaactcaagaaaggttgatctttagggtacagaattacgttgacaataaattgatgcattttaaaccaagcgcactgtatctaaaaattggagataccttgaagcgctcttcaggtgcagaggacaagataaaccctttagatgttgactatgctgaaaatctatttcctgatttatatttacctttaggcaaatcattgactttgttgtctaatatctacgagctaattaactcaatggtttttgatgatttggctcataatattgtgcatgcatgcattgagttactcaagggcggattcttacctatcgcaataggccacatgggccctattgatggacaattagtttatcttaacaacttggttattttgcgaaaccaaatcaacaattttgacattcaatataccaggactgactatacaattgatttcacgagtggcttgagtgatatctggcagttaataaaagatagaaaatttggctttaacaatggtggtattttagatttggcgtccagggcagcaccaaaaattattaataatatgatagatgccaactatgaaatagaatttgagcttagaaatgcagtaactcagtttatcgatgagtgctcaagaacaatatgttatccattgttggttcacgattctgaatctggtaacctagtcgcggttacgtctgcatttaaagacaacttgatttcaaatatacctgtctattacggtcgtattaagctggtgattaaggatcccgttgtaacccaatttttaatgagcaatctatcaagtttattggttgcaacctacgaagactactacaacaaaatagatgaaaagctggaaactatggatgttttgctgaaagatcagctaaacgatatcatggatgtcgatacaacctatgcattcataaccgatatgataacacagcttggcgatgatagtgagtcgaaaagcaaagctaacactccagaattcaacgaggagatcttaagtagtctacaactcgatgaacccatctctaccagtaaaccagcatccccaaagacagaattagcggatccacagtaa

SEQ ID NO: 622 - DNA, 534 bp, Candida albicans
agaataatgaacttgccaaaccaattttctaaattagtcgacgttgattccgaggatgaggaaattgatttgcctgcaggggtaaccaaaccagaccaatggatcaagaacatgggtccaattaaaattgaaccaaaagtttggttagccaatgaacgtactttcaacagatggttgcacgtgacaacattgttatcgtcattgacatttattatttactcgtcgactagtggctccaattttgaaggattgagcacatatcttgcctacttttattttgcattaactcttttcagtggtctttgggcatattatatatttatggaaagaagaaagattattttggagagatctgataagcatttggataactcatttgggcctttgattatagctcttggcttgaccattgctttgattttcaattttatttttggttggaaaaatttaaatttggacccaaatgatgagttttataataacaacccaacccaaaagaaagtccatgaatttatggttaatatggttaattaa

SEQ ID NO: 623 - DNA, 1059 bp, Candida albicans
aggtcagaacttggtaggtcgatggcggtattgtcattcaattattatgtcgaatcaatatccgatagcaagacatttattgagaactgtaacaagaaggagggcttgatgttgtatgatggacgtgacaaatgtaagattgttaccataatacctgaattatttgctcaaattgagaattggagaaaagaatgtctacacttgactccacaggaaatactcaagacaaattatatatacacagccacaacagtcttgatatggataaggcaagagttgaatacaaatttgtctataatgtatgagttctatgtgtgcctgcacattgttccatttttacttgaattaatatatctgagagaagtgtgccaattggggaacattgaccctattacagttttgaaaaaagtctcacaaatcccttataccaccgattacttagagaacgtgatcagtatgttagaacattacgctgaaaaagaattgaacttggtgcaaacgttggtgatgggagaattcacagaaactgtgtatttcaagaacttgttcaaattaactagaacccagagagaacgtgttttcaatttatccaataagttactcaatcacaagcatgcagaaataagagtgtcggctgctgaaacattatctggcttgattcatatatcaccagtagaagaagttgaagggttggttgaaaagtatagtgatctttattccaaacaattggataaggtgagaaagaagtaccggaaaactggttataagaatatggaaaatgatgatataataaaattacatggtgccactttaggtctagcagcattagtacatgcatttgctttttcttccccaccaccgaagtgggttcctaagatattaactacattggcaaacaagtcaactggtatacctggaattgttggtaagactgcaaaagagtctttgggaaaattcaaaaagaatagacaagacagttggcacattgacagcaaagtatttacagaagaacaaattcaagatcttgaaggtgttctttggaagagttattttatatag

SEQ ID NO: 624 - DNA, 534 bp, Candida albicans
aagaactcgcttttgccagtggactctacccctttttacaaactagatttaaactcatctgatttagagaccataaagacattctcggaatttattaacaaagactgggtttcaaggatagtaaaattatgggtgactgatgcagaagttaactcatcattccaagtgatggatgtatttgtgattgcgtcattggtggttttagtttctaatgcttacaccaagcattttactttccatgatttactaagtatcattgatgaaatttatgtcccagatgaaaagagtgcccacataatcactggtcaattgatcattggtattttatttgggtccaaggcaatgtcaccagaattttgggaagaaagagatgaatatgtgagcaaatacttgaaaagaattttaaatgaagatttgtctcctgataatcaaggtatctggcatgttttcgctgcttttcttccaggacatgttgatgttagaagattccctaaagtgatagatgtcttcaccacgcggctggaagatccgaag

SEQ ID NO: 625 - DNA, 2469 bp, Candida albicans
  unsure (1772),(1780): Identity of nucleotide sequences at the above locations are unknown.
ttccgcgatgactttttcgagtttgtgttcaataatacataccatacaatagctaccacggtatcagaaatttgtggtggtataatcaaacgtgacccaaagtcttttaagaagaacgctcgtattctcattgaaaaaattaaggacgaaatccatgaaaacgaagcaggagggtacaaaggtggtgttgatatcgttccacgtgatcaagcacttttctggtatataactatcttgaacgagatggttggaaatgctggcaaccagattatagacatgtcgtctgagatctatgagttgtcgtactttttaatggaaaaagtcaagagtccattggttttccctgctgcttatcttgtaaatcaagttttacagacagtcacaaaaatcaaagtgaatgaatgcaggttgatttccccagcctatgagaaagagcacggcattgacgagaaatgctggggaggattttggaaccaaagcattagattttcaaaagaaaacaccacatttgattggttcattccttcagaacgagacgtcacgtttgctgttgattttttcaatgctcatgtttccaaaagtttagagaacgtgatgagattgatgcatcaatatgagaaggaaaagaattcgggtttaaagtcttcctcaggtgttgtggatgatatcagactgatgttactgttcttggcctatttattgagcggtgtttcatttttattggatccgtcttttgaggaaaatattccaaaaataaaccatgacagtgaatctatccagcaaagattattgcttttgaagcaaattagagaattggctagagtgtcaaaccaaaaagaagattctattgacgaggcaactccagaatatatggaaaaaattataaatgacttgaccaatgaggatctcgacatcctttctgaatttgatcaaggtgataatgaattaagagacaacaaaaaacaggaggaagagagtagaggtcgagaaaaagatgacgaaagtatcccttctaaacctgcttcgccaactcaaaaccccttggctagatttgaagtcaagtcatttccattaagtagatccgaatcagttgctccagcttatgacgagtctggcagagcaacaccacaaatcaacggtgtgcatatgtcaagtatgaatcctgctataactttcagagagaagagtctatacacatcaaactatttttttggtactggtctggagaatagaagatttgctgatttatattcaaaagttcacaaaactagagaattggtcgggaagagtttacacgtcttattcaagttcttgatggaaaacttccctgataacaccaaaattttcaaagactttttgtttgttattagtatttggttttcagatatggggcgtgaaagagcacttgatccaagtcattcaaaaataaattatggatatgttagctatcttcaaactatcaatagagtcagaaagccattcaccagaattgcgattggggctaggttggaattgtaccatctgtttagagttgcattgcatgcaacttcacgtactgaaacaagtttagataaacttttgttggaagatgttgtaagactttctgtatctacctattctagcatatctgctaatgctcaaagtatattagttgacgcaatgaaaagattaaatggttcttacagtcttattatcaaatcagcatttaaacatttgtccaaggcattaaaaataaacgaccaccagaaaatagagagtggactcagcatctntgcaatcnagaaaattagaaccagaatgcaaactgatttctacaatatttacaggtatttggaaattatgcaccgttgcttaaatgttgataaccaaaacgtttacagttctgcgtacgtcttgtacactagtgtacgcaaaggaataacgccgccaagcagtgtttgtatacttaacgagagtgcaattgattgtattagaccacctgaccaatttattgatttggagataaaagcggtaaaattggccaaggaaaacaagagaaagatttattttgaaaaacttgaaaaattacaagagaaaatattggcagacgaaagtaacaatggacactggaagattactgtcctgaatttggagttattactgaatttgcagtcgtacttggaaataccgacgagattggacattcttcttttgtttcacaaagaggcagcagtggaccatcctttgatttcaaggcaagctttacaaggaatcagtagagttgtcaacaaactttgtaccttgactaaatatgactatgatatcaggctgatgtacgatttgaattttgttgctccacattttacaactgtggacattagacctgaccacggagtatcttataaggcaaaatggcaagaagaattgccaaatacagaatacccaaattattatatcgattacaagccaagtgtgggttggttattctga

SEQ ID NO: 626 - DNA, 777 bp, Candida albicans
ggacgcgggttttccagccccgtgggtgaacaaaaactcgtggcttctataataatatcccagaaagaattcaagctctcaagaaatgttgtcaaggagtttgtatctatattattgccaattgtcaaaataggtattcaatctaagaaagaaaaagtcggaagtgattacatttctgctttacaacttttagcctttttagagcctgaatatgttcttgagaacacgcttttagacatgtatgaatctatcgagggggtaatatctactcacagagtatctacggcccttagcactattgaaaccttgtcgagatttattgtatctacgccggtttatagagttcatgctaccagaatattactgttggccttaccaggaattgactcaaatgatttagagaaaacaatgcagagtttagaggtgtttacatctatggccaactatgcacctttttatgacttgacaaaaggggaaggagattctatgttggcattggaatttactcaagggcatattgattatttaaagagaaagatttacgatggtaatattgagagtttccaagtcgataccgatttagaagtccaagcattaaaatcttcaacaagtgcctttaaggatttgatcaaaagctttactcagcgattaaccttgcttttagagaacttaccagatccagaaataagcatgggcttggagagcgcccttgcagtttcattaccaaaatttttatacatcatgtttgaatcaatttcagatgacttattcaagtaa

SEQ ID NO: 627 - DNA, 1230 bp, Candida albicans
tgcggatcctcaggccgtggtgagagattacccagtttgtggccatataagattgaaagtccaaaagaacaagctaagtttttaagtcacattgtgtctcatctttatattgcaatcaaaacattagatattcaaggctcactcagtgttagtgctaaagatttggctgctttaaaagacgctatttccgatgttgatttggctttggaaacaaacttatttgagatgaacaacgacccaacttgtgatgaaagcaatgatgaagctgtttccgatgaatttgaaatttctgatgatgaagaggaggaggaagaagaagaagaggaaggtgaagatgaagaagatgaaggcgacagagatgctactactcaacataagaaatcaccaaagtctgcagccgttgttggtgtaaaaacttggtcgcatgaattaatggtctggctcaaaatgaaatacgacatgcccgttacattgagagtgaacttggctagagtatattatgcgatttgtctttgtcgtggtcaacatgtgaatttgaagacttacattagaatttttgagctattaacaaaggatcaattattgttgtacagtcatggtttgagattgccatgggaggatttatgccgagaattagaactacattttgctcctattgatgcaggattaaccatatttgaaaagaaagaccacaaacaattgattaaacttgccagcagagccaattatttctttgcaagagattgcttaccaaaaatttacgaaaaaatgggttcatactttgccgtcaacagctctgctttggtgatgtcatctttgtcacttttccctacagtttttacacctaatggtgttgaagatgagaatgatattcgtcattacatccagtcgtttttctacatgtgggaaaaactaaacaaaaccaacggatttgatgtacaaataagctctagattaggtattatagccatgtctactttgtcaatgattaatgatgatatcgaaactagaaagtttttgaagttaggggagtttgggattttcactgcagatcagatgcagtacatgatgaatacattaattaatagtttgagtattatgatggacaaatattcttccatgaagataaagtattttcatggatttgcctcaacaattgttttcttcaatgattggagactcagctttagtggactcttcaccgccggactggaaggtcagcgtccaacc

SEQ ID NO: 628 - DNA, 1074 bp, Candida albicans
tcaataatgagttacgatcctatacatgatacatacactgcgtccacttctagtcagcaacagcaacagcaacaacatcaacaacatcaacaatcatctccaccaccttcgaaatcaacacatttacatgtaacaggatcttctccaccttcaataaatcaactcataagtccaaacattgaaccatcacgctcagatgtgaatcaacatcagaatcaatttgctgaccaagaacaaactattccttctttgatattaccacaaccagatgaacccaaatcgactgttaatacactgggcggtggagcattgtcaatttctaaccttgtttcgtcatctgccaacgaagccccatcactgtcagcaataccgccaattacatctacacatacttcactgcaaaaaatgaattctatttccagtttaatcaactcgccaccagatcacaatgatgacactggagatgatgattatgacgaaacagatgttaattcatcagttgtaggagatgatgaagactatgttgcaactccaccaccacaacaacaacattcatcaaccacaacacctggcaaatcacacaaatcctccccgagtaaaaagaaaaagaaaaataatatagccaatgctaaattatctttgaaaagagccgatggtgaagcattttggcgtagagatatacaatatgattttttgaaagaattattcgatgataaaactgcttgttttactaatactttctcggaatcaaacattgccaattgtaacaataatctgaaaattacctttggtgaattatacatccgtactttagcagaatcaaataaatcatcacgagtattgaaagaaaaattaattagagacgttgaattgggcaaagcggtggcgaaagtttgtattttagtcaatgtgggaagaatgaatacgacaattaattttgtcccggaaatgaaatcgactttgagaacatatcattctattccttcattacaaacttgtcgtgaaggtggtactgttaaacaattacaagatactccacgattaaaatccattttggaaaaacaattatgttaa

SEQ ID NO: 629 - DNA, 468 bp, Candida albicans
tcattgccacgtcatataatgatgttaccacaaggttatacattcagaaaactaaaacttactgattatgataatcaatatttagaaactttaaaagttttgacgacagttggtgaaatttccaaagaagatttcactgaattgtataatcattggtcttcattgccatctatttatcatccatatgtaatcaccaatgcatcaggtatagtggtagccacggggatgttatttgtggagaaaaaattgattcatgaatgtggtaaagttggtcatattgaagatatttcagttgctaaatctgaacaaggtaaaaaattgggatattatttagtcacttcattaaccaaagttgctcaagagaatgattgttacaaagtcattttagattgttctcctgaaaatgttggcttttatgaaaaatgtggttataaagatggtggtgttgaaatggtatgtagattctag

SEQ ID NO: 630 - DNA, 2268 bp, Candida albicans
ctggatatggcagcagcaccaccaccaccagcgaaaaaccagggtaaggcaaaacagcatgttacaggtgccaggttccgtcagcgaaaaatctcggtaaagcagcccttgactatttataaacagagagacctacctactctagatagcaatgagttagagcctagtcaagtccatcatttaaattctaatgcgtcatcatcatcaacacaacaaccgagagaccttcatgcagttgaaactggggttgacaagaatgaggaagaggaagtgcatcttcagcaagttatcaatgctgcacaaaaagcacttttgggttcgaaaaaagaagaaaaaagcagtgatatgtatattcccacaccggacgcttcgaggatatggcccgaggcacacaagtattacaaggatcaaaagttcaagcagccagagacatatatcaagtttagtgcgacagtagaggacacagtgggtgtggagtacaatatggacgaggtagatgaaaagttttatagagagacactatgcaagtactatcccaaaaagaaaaacaagtcagatgagaacaatcgaaagtgtactgaattggagtttgaaacaatctgtgacaagttggaaaagaccattgaagcacgacaaccgtttttgtctatggaccccagcaacattctatcgtacgaggagttgtcgtcgtacattgtggatcagtttaaaagtgcagtgaaaacaagcaacccgtatattgttaccaatggtgggaatctagagtatatatcgacgacagctttaaaagagagattgtcgaaggaaataaagtatgaaccgtttgttactatttttgataagaaccaaatgtccacaagtgcggtgagacctattcccaaattgtttgagttgttcggcagacctgtttatgatcattggaaggagagaaaaatagaaagaaagggcaaaaccatccagcccacactcaaatttgaggatcctaactcgaacgaaaaggaaaacgacaatgacccatatatatgtttcagacgacgtgagtttaggcaagcaagaaagacgagaagagccgatacaattggtgcagagagaataagactgatgcaaaagtcgttgcaccgcgcacgtgatttgataatgagtgttagtgaaagagagatcctcaaactcgacaattttcaagcagagcatgaattgtttaaagccaggtgcgctaccaaggcttgtaagagggagctcaatatcaagggtgacgaatacttgttctttccgcataaaaagaagaaaattgttcgtactgaagatgaagaaagggagaagaagagagaaaagaagaagcaagaccaagaacttgcactcaagcaacaacaagcactacagcaacagcagcaacaaccaccacaaccaccacaacaagcaccatcaaaacaagatggtacatcaacgagccagccttatgtcaaactcccacccgcaaaagttccagatatggatcttgttacagtttcgttggtattaaaggaaaagaacgaaaccatcaaacgtgctgtgttggagaaattgcgcaagagaaaggaacacgacaagggatttatcaatttgacagacgatccgtatcagccatttttcgatatttcaaccaatagggccgaagagttgagccatattccgtattcgtcgattgcggccacacactatcaccaattcaacacatcgaactacatgaacgaccaacttaaaaagctacttgaagagaaaaaacctttacctggtgtaaaaacgtttttgggttctaacggggagttggtaccatcgaaggcatttccacatttgctgtcgttgcttgaggaaaagtataaggcgacaagtgggtatattgaacgattattgcaaagcgtggagacgcaagattttagttcatacaccaatggctttaaagatgttgagccaaaagaaacaaatgaacctgttatggcgtttccccagagaatacgtcgaagagtgggcagggctggcagggtttttttggaccaccagcaagagtacccgcaaccgaattttcagcaagacacagatcgtgtgggaggtatcccagatgtgtattgtaaagaggatgccattaaacgattacagtcaaagtggaagttcgatacagaatataaaacaactgaaccatttagtttggatccttcaaagttgaatggtattagtccatctacgcaatcgattagatttgggtctatgttgttgaatagaacacgtaaatag

SEQ ID NO: 631 - DNA, 888 bp, Candida albicans
acgatgtcagtcgttacttcagagatatcctatcaaccttcttcatcaatggatatagatttcttaggagaatcattatatcgaagcaatgaagataatttgcccctaaatgatcatatcaaaaatttaaaagttaaaacaatttataataccattaccaagacaaagacaaagacaaatgataaacgacaagtactaaaattgttaagtgatttagctcgatctactgatggacttattaataatgaattaagatgcaaaatatggccaatcttattaggtatagaagatgataacaacaacaacaacaacaacaacaacatcggttcgacggatgttgcatcccaaagtgacaaggtccctacgacttcaatactttcaaataacaaatattctactgatttatttttacaagatttacaatgtgttgaattaccacctcataaagatgaagatcaagtgaaattagatattcaaagatcaataacaattttaaatcatattcaatcattactgtattcaggttcatcttcttatacaacaattttaacaacaaatgaaattgatcatttaaaggggaaattatcaaatttaataataaaattattacggaaatatcctagtttaaattattatcaaggattccatgatattgccagtattattttattagtatgttatattcctaatgataaactggatgattataatatcaatggtacgagttatatcagcaataacaacaacaacaacagtagtagtagtagtagtaatacaatcaacggatccaataatacatatgaagactccaatgattatcaaattgatgaagaattggcatctaaaatgttggaacatttagccatttatggtcaaccggcgggctaa

SEQ ID NO: 632 - DNA, 1071 bp, Candida albicans
tacttttgtcggcgccccccctttctttttttcaattatttcattcatatatacccaagatctccttctttaggacttttcaaaaacatatacatatacatatattttgaacaatgtcagtcgttacttcagagatatcctatcaaccattcttcatcaatggatatagatttcttaggagaatcattatatcgaagcaatgaagataatttgcccctaaatgatcatatcaaaaatttaaaagttaaaacaatttataataccattaccaagacaaagacaaagacaaatgataaacgacaagtactaaaattgttaagtgatctagctcgatctactgatggacttattaataatgaattaagatgcaaaatatggccaatcttattaggtatagaagatgataacaacaacaacaacaacatcggttcgacggatgttacatcccaaagtgacaaggtccctacgacttcaatactttcaaataacaaatattctactgatttatttttacaagatttacaatgtgttgaattaccacctcataaagatgaagatcaagtgaaattagatattcaaagatcaataacaattttaaatcatattcaatcattactgtattcaggttcatcttcttatacaacaattttaacaaccaatgaaattgatcatttaaaggggaaattatcaaatttaataataaaattattacggaaatatcctagtttaaattattatcaaggattccatgatattgccagtattattttattagtatgttatgttcctaatgataaactggatgattataatatcaatggtacgagttatatcagcaataacaacaacaacaacaacaacaacagtagtagtagtaatacaatcaacggatccaataatacatatgaagactccaatgattatcaaattgatgaagaattggcatttaaaatgttggaaaatttagcgatttatcatctacgagattatttaattagtgatactaacctatcaatcaaccatttatggactcgtccccacgaggaagaattctgcgtccagtcgaaaacc

SEQ ID NO: 633 - DNA, 2271 bp, Candida albicans
  unsure (86): Identity of nucleotide sequences at the above locations are unknown.
agacaatatctaacatggattattataacgaaaaaaggggaattagaattcaattctaagtcaggcaaagatttattttacgatanaaataatcagtttggatacactaagattgacacagaagagcaagtgaacaagtatgccgctttggatcaaaagaccgactttttattttttcccagaggagaaacccaaaggaataatgcaaagtatcacaaggacgatatttttctagagcagggcgattcagattatgatgaagatgatgaaattgattctggcaaaactttaacagaaactaagaaaatgttaactgattctcaaaaattcgcatatattggaatagctaagcttataacggtagaaatggcgactgacttggccaaagtgcagtttggaacgtcctcgaaaattgctaagcaaatgagtggaagtcaaaagaatttttcaaactggattgaatatgtaatgtcgaagctatacgatcacctcactgttgaaggagccgaaaaagagatgatagaaaatttgagtaaacacggtgttgaggtgaatgatttagctaaaagtctaatggaagttggaacaaaggcggttattagtggtggaaataaatcatttattagtgaagattttgatttgcgttgggttattatatgtgatatgtttttaatgcttttaagtgatggctattatgatgcaagatctcgatcattgctactacgatttggagcatctgttgatataacaaatttggagttgttccaatttgaaaggagactcattgaatgccttgatatggaaaccaaagaaaaatctattgaaaacaaagacgagaagctaggtgataagctgtttgttcaacaacagattaaaaagaacaaaaataagcggatagcatatatcggtttggcaacattggcaggatctcttgcaattgggttgtcagcagggttgcttgctccggtgattggtgctggtatagctgctgggtttactacaattggtatttctggtacagggggggttttagcaggagttggtggtagtgctttaatcacgaccagtggtgtggcaattggtgccaaagtagggtcgaaagcaggatccagaagagtaggtgatgttcatacatttgaatttaaaccattgcacaataacaaaagaacaaacttgattgtaacggtaagtggatggatgaatggtgcaatggatgatgttcgtcttcccttttcaactgttgatcctgtgatgggtgatatgttttcattgctctgggaaccagaaatgttgcaatcgatgggtcaaaccataggaatcttagcaagtgaagcgttgagtacatcgatacagcagatcttaggtgccacaatattggcagcattaatgtcagcaatacagatccccatggcgttatccaagttatcctacttgttggataacccttggaatgtttccttagatcgtgcttggaaggcaggcaaaattttggctgaaaccataatttcaggaaatttaggtgttaggccaataacattagttggattttctttggggtccagattgatatattcttgtcttattgaaatggcaagacgcggtggatatggtttaatagaaaatgttattatattagggtccccaatcactgttgacattgatcaaatgtcagaggcaagatcggtggttagtggaagattcgtcaacgggtattcaaagaaagactggatattggggtatcttttcagagccaccggtggtggtatccgtgcagtcgctggtttatctccgctagataatgttcatggtgtggaaaatatagattgtacagacctagtggaggggcatatggcttacagaaaggcaattccaaaaataatgaagactatcggatgggaagtgttgagtgaagagtttgccgaaattgaagagcctgatccagagcaaggtgaacgtcaacgacaattaataaacgaatttgatgaagcccgtgcaaaaatggagaaagaaaagaatgagaatatcgaacccaaaggttggcgaaaatggtttaaaccaaagaaaaaagactggtgggatatatacggtcaacctgaaggtacagaaaaaaatgataaaggtgaatatgtggacgaaaagcttgagggaaatgccgtgtttgatgtcgatgcgttggtgaaggaagtaaacgagattgaacatatggtggacgaaaatgctaaaaaggccaccgatccagaggttaaaaacaacaagaatgaggagaagtag

SEQ ID NO: 634 - DNA, 945 bp, Candida albicans
ctaatgtcttttttaaatactatacgtggacttgggagagggtccaagaagaacaagaaggatttagaaccgtcaaataacgccatatattctcattcaaatctatctggcaatggtttgagacgaacacaatcacctaccaagttttccccttcaaaattatcttcaaaaggtgcacaaggctcagctgcatacacgtcttctcctacaaagcgtagcagaacaggacaatctttacaacaccaagatctgcaactgctgcttcaatatcaacaacagctgggaagtgtactgccgctgaagcgttcttccatacagactaccaaaagcacaactgtgaatgctgatccgcctttgtttttatgtgaaccttatgtgaaaactgctttggtcaagggatctttcaagactattgtccagcttccgaaatatgtggattattgtgaatggttggcgttaaacatctttgaacttttcaatcatttaaaccggttctatggagttatccaagaatacgctactcctgaagcatatccaacaatgaatgcgggaccaaacacaaactatttatgggttaactcttctggtcaagctgttaacttaccggcatgccagtatattgagtatgttattacctgggtcaccaacaagttgaatgatcaaagcgtattccctaccaagaatggcggagcatttccacccaattttataaaagactgcaagaacattagcagacaaatgtttagaatttttgctcatatataccacaatcatttcgacaagataatccatttatctttggaggcacactggaactcttttttcgcccattttatatcttttgtcaaagagttcaatttgattgatagaactgaaatggaaccgttgttacctttgatagagaattttgaacaacaaggaaaaatcacccaagcaagcaaatag

SEQ ID NO: 635 - DNA, 1014 bp, Candida albicans
aattaccaaactatgagattaaaactaaagtcaaccaatggagtatccaccataactttggatgattcaaagaaattatttaaagatttccttatagatattcaacaagatacacaactacatcaagatacttcagaaagtgtatcaacaattaaattagggttcccacctaaaccaattgacttatcatatggactagaaacaactttaagcgataaaaatatcaaagatggtgaccaattgttaattgaattcacttcattcaaaaggaaatcagtttctgaacctccattatccccacaaccttcagaaaagaaacctaatctacgagatgatatcccatcgacttttattgaatcacttaataaatacctaattcttcgaaatattccggatgataattcctgtttattcaattctatatcgtatgccatatcagggtatgattcattcaagaatatttctccaccagaagaattgaggaaagtggtagtgaattatattgaaaaagaccccgaattatattctgatttaattttaggtagacctagagaagaatattgtcgatggattataaagaaagatagttggggaggtgctatagaattagggatattggcagattggtttaatgttagaattgtatgtatagatattgaactggggaatttcattcgatttgaaaatgaaaaggatcatccagaaaaatttattatattggtttatagtgggattcattatgatgtattggctactaatgatgaattgagtacggaaaacaaagacactgatgtcgctcaatggtccactggagatgttcaacaagaagaagatattttagctgctagtcaaaaattatgtaagttgttacagagtaaagattatgcaacaaatacaactacatttagagttagatgtctagattgttatctggtattagttggagaaatgggtgcttctaaacatgcagaagaaacagggcatcttaattttggtgaagttaagaaaagctag

SEQ ID NO: 636 - DNA, 495 bp, Candida albicans
agtggattttctgaaaagcaaacagaagtaactgtcaatgttgtttatgctgctataaatgatggaatatattccatcactaataatcttgttaaaaaggaatcattatcatcaatagcttatcaacaaaaagtcaattttgctaaattaaaaggtgaattacaaaccatggataaatcagaattcactagtttaaaaaaagaacaagaaaaactacgtactgatttaacaaatttgaaaaatcgattaaaagaagaaattaccaagaatcaagctagtgttagattagatttgaatttagaaaaaggaagaattagagaagaaagttcccaacatgaattaagaatagaagatacttatagtagaatagatgaagaagtttctaatatgaaaatgcaaattaaaactgtgaaaactcaagttttacaatggttaatgggggtaagtactggtactttggctttattattaacatttgtcagattttacttttaa

SEQ ID NO: 637 - DNA, 1812 bp, Candida albicans
  unsure (1765),(1786): Identity of nucleotide sequences at the above locations are unknown.
aagatatgtcgtctattgttgtcaattccaaatttactcaaatttttctccttgttccttgtttcgtgtctcaagaccagacaaccaactaccacagccattcaacactcacacactgaattatctactaaaaatcagatcagccaccaacaaactaaatacacttcttacacatacacacaatcaatttataccaacatttcttcaatgtcaactaactctacctctgacagatttccaaatctgtattggtcaatagattatgttacagggttaaataatctaaaatctcaatcattcaaatcacttaaacaattgcatgaattgagaaaattagtatttaattatatgacttattatcatgccaatagtgaatttttgaataaatcaagcattgatctatttccagtggaaagtacttttttaccatttgagtacaatcctagatcagtttcaaacactcctaccacatcaccctatcggaaaagaatagtatccaatgaaacaaccgtgtctaaacaagaaacaactacacctaaacatgaaaccaccatgactactgcttatagtgaatatatcgattacatgtcacaagaatcaacaatcttattaaatttaacttcgattattgatcgtgacgtgcttcaagatatcactatgtatttgaaataccacgaacccaagatccatcaacagtttacccgattagatgaggtttataataattatttgaagagttacaagaacattgaaagattgaaatcaaggcacattgaacaattgaggttgaaggagttttctcaatctcaagttgaacaaacaaaaagtagtcccgaagaaacagttgaggaccaactgcaacattcatcttcatttgaagaatcttatgccgacgaagatttagaagatgaggaaattgacaatacttttgatttgagcttcccattgcatataggcacggttgttgtatcttcagcagaagagttgcaactaattatgaaccaattaataaccaaagtccctattactatgagaaagatccctttacccggttataagaatgaaattttcaatagtgaatcaatatcgaaagttttacttactataccaatcaaagggtttaaaccttcaagattgaacattgaaaagtttggacaagggttacttgatttaaaattaatgacgagtagtaattttttcaacaaaaaatttaaaagtgaaggaatgtggtttgaatggtctgatttggccgtatactttgcccagttcaaatcttcactggcagcatcatcagtaaaagataccagtagtatagggtcaaacacaacttcaactactaataaatcaagtgcaatttcttcaccgaaaaatggtcgatctaagtttatttctgacatggctgagaccaccaccagattcaatgccatgtttaataatgttagaagttcgatattgaaaacaagtcatgcggaaatacttgaagacatagaagacagttataatgaagaaatcttggatttacaagaattcaagtatttattagagaatggattatttgatttatctcaatatttagaaaaatttgaaaaaatgaaaatagaaattatttacaagagtttatcaagattgctggaaattttattgaaattccaaaaggaacaaactaccaaattagaagctttttcaaacaattttattcgaaacattaataaatcagaaaattatcttcatgattttaataaaactatggaacattttagcacangagaaatatattccccaaggnttaataacaaccggacacccaagtga

SEQ ID NO: 638 - DNA, 2727 bp, Candida albicans
cacgccaaaaaaaaaaatagcttgatctcatacaaaacattcttcattgtaaaacaacacatcacatcacatcacactctttatatcatgtcctttgctgaaagtttttggacaccagactatgagctgggatttcagcaactatttctccaattgaatcaagggatcttggagaacaatgactttgttcgtttgatcgaaagacgaatggaactggaagtggtctatgggaactcgttggagacaatcaccacagactgtaagccactcaataagagacaattgaacgaagactttgtgtccaccatcaaaaacgcatacaccaagatgaatgagactttttacaaacaaggggaataccatttgaacattgccgacaacattgaaaccattgttctccaaccatttagcaaatggtgtaccgagcacgagcaaagagtcaagttttctgaattcactttgcaagacaaattaaaggcattgaaaaatgctcagtatctggtggaaaagttgcaaaagaaatatttcaacaaatgtcgaatgttggaggagttcaagtcccactatactgaaaaagaattgcaagaggagttaagcaatttgtcatttcaaaaagatcgagctgccaaaaccaatactgatgggagcaaagaggaagacgacaatgatactgcagacgaagaaatctatgagttcacacatgctaaatacgacaccaaacagatgaaggcgttgctcaaggcaatgcttacagaagtccccatgggtccacacaaggtggcaattttaggtacctatcaaaatgtttctactgggagcaacatcaccaaatggttgctagagaacatgccggagttcaacaagaatttggacaaggctgaagtttttgggcaagatttagttcgaaatgactttattagaattgttggttcaatgggaaagtctttcattaattcttctcagttttattaccagtggaaacccattgcatttaccatttctggtgtcgaaaatgaatatgtcatcacggacacatcgttggcaaagtcatttacattcaagtttgatgatgtcaaggaggctataggggtgaacactgttgacttcaacgacaagtcacaactatcaaagttaattaacgaagtcaaccagttggatacccagtactatgcacaagttgttgagttggataaattgaggtgtgagtacgaggagttggcaatggaccatttgacattcatgcagaaatgtgagttggatagattgaaggccatcaagaaagtgacatttgattttctttccagttttgccaataagataagcagtttaaagacaataagtgacgatttggtgttgttggaagagacaatcaatcctgtgaacgacttgaagttcttgattgaaaactacgggacagggagatttaagcctaaggtggtcttatatgacaactactacgattcaaatatcaatcagacatttggtgttgacttgagtgtcaaatccagattggataaaaaagttgttccgtacattattcagtgcatcttgagtcaattggacagtgtgtatcccgatttgaaaaacgatgaggagagaatcaacctttggactcagccggtgcatctttcgaatgtgcataaattgaggtcgcagttgaacggagtgcaagaccctaatgagatcatgtccatcttgaaagagtcgcatccgttgcttataaccaatatcttaaagttatactttatggagttgccagactcgatcattccatacaacaactacgatgtgatcaaattactctatacaaactaccatgacgaatcccaaacaaaatcgagagtcaatggattacaaaatgttttgtcagagttgccaaaatgcaatttagcaacgttggatgccatattgacgcacttgagcagattagtgagtattgttggtactcaagacaaagatttggcaggtggatttcaacgcaaattgagcaaggagtttggatctttggttttgagaccaaaaactgatggtttgaacagttccgaaagcagttacttgaacgatagattccaggtcacgttaatggatgacttattcgagaacaagcaaagtatatttaatgagttgagaagacaaagttccaccaggtcagccgtggccagtgtatcgccaagtgtttctcgaaacagcagtttgacacgcagtgaatcgatcaagtcaaacaagggacacaatgcagcagcgattgcaaagtcgaaatcgaggttggaatccaggttacaaagtgcggtgaagaatcaaactaaaacactggagccacaacagaaaacagatgctgatgaattttatgatgctgaagcgtcgccaaccccttcaagactgggcactcagtcgtcatcactgggattgaaaagatcaacatctcccaagaaaaagaaatggaccgttgtatccaaggaagagagcaaagaagggaacgaaaaatcaaagaaaattacatccacgccagttacttaccgtccctccaatgacattatttacgataaatcacccagcaaccagtcattaaatgatctttcatcaaccccaccacctaaatttgcacctattttgggcagaaaatcgtcagttaaagacttggccaagagttttgaaaatgggtcaactgaagatttgcaagaaccatcatctcgttcaagatcatcatccccaacaaaggcaaagtga

SEQ ID NO: 639 - DNA, 699 bp, Candida albicans
gaattcatcatgtcaaaatacggattcataaaaatttcaagagatgttcaacaagcaattccaaatcccaaaaaaccttctattcaacttaacaccgaattgccacttgattcgccattaactaagtttgtttatgattattctaaaaagaggttaccaaacgagacgttcaatcattcacttagggtatatttctacagcgtggctataattaaggaccaatttgcagattggactctcgatccagaaattgtttttgtcaccagtttgttacatgacattggtacgtctcatgaaaatatgcatgccaccaagatgtcgtttgagacatggggtgggatattatcacgagacttggttttggaacagaccaagggtaataaagattatgctgatgctgtgtgtgaggctattgttagacatcaagatttaggcgaatctggctacattaccactttgggattgattttacagatcagtactattttggataatgtggggttgaattcgcatttgatccatgaggatactttagatgcagtcaataagaaatattcaagaaaaggatggttgaattgctttgctggtgctatcgacaaggaaaatgaattgaaaccctggggccatacaagtgcactaggggttgataaattcaaagatgatgttttagcaaataaattaaggtatgaaaaattataa

SEQ ID NO: 640 - DNA, 279 bp, Candida albicans
ttttttttttacctttctttttttttccaagcatctcatcacaagtaccttttttttacatttataggctatcctgctacacaatattatatcatggcaccaagacaatcaaaaactgctaaaagaaacaaaacacagaacaagaccagaacagtagattctgaagtgttttcagattctgctgccaaaaacttgttagctgatcaaccaaaactaacaccaaagtcaaaagtaaaaaagattcaaaattggcacttaaaaaacagcaagcaaaaatag

SEQ ID NO: 641 - DNA, 210 bp, Candida albicans
aaatggaaaggaattttgagggaggcccctttgaatatacccacattgaacaaagcaattgttccaggagttaaagccaaacgtggaaaaaagggtaaaaagtttgtcgatgacaacgacacattaacaatgaatagacttgtcaaatctataaacgacaaatacgaccaagtcaatgagagtaaattggaaaagtcaagaagattataa

SEQ ID NO: 642 - DNA, 384 bp, Candida albicans
aaccttagaatgtctcaacaaagagaaaaccaaagaggaatagtttcacaaacaactacaacgactgcctcgcctattttaaagctacgagctcaagaaagacaagctcgtgacgtctcttgggatgcaaacgtcgttgataatgaacatctaaataagaaaaagacaaaaatatgctgtatatttcatccatcagatcggaactgtgatgaagaagatagttcaagttccagtgactcgtctagtgattcttcagataatgaagaggatgataaaaacacgaagatagccccgaaatctaacaataataaaaaaaagtcaaaacctaatgcgtacgaagttcagccccattacaaaaaccaatcaaaggtgcccggaaaatga

SEQ ID NO: 643 - DNA, 504 bp, Candida albicans
gtggctttgtcgcggtggctcgtctccctctgtggtgaagacgtcgaaaccgaagatgacgtcgccacagaaaaatctaaagatgttgaacaggctgtttcttcaactaccaaagaaacaacaaaacctgaagttttggaaactgaaaaaccgaagcccgcagttgctgatgatgatgatttggatgatttggatatttcgccagaagaaatccgtaaacatcttgaatcacaaccagtttatattttcacttcattagccggtggtatgcaagtcatacttagatcaaataatttggcagctattttacaaggtaatggaatcaaatttgagtatcgtgatttgggaactgatgaagaagctaaaaagatttggaagagacaagctaatggtaagactttaccaggtgttgttagaggagatgattatattggtaattggcaagaaatcgaggatgctaatgaagaatacagattgagagagttgttatatgaaactttatag

SEQ ID NO: 644 - DNA, 2706 bp, Candida albicans
tttttttttaaaaatatggacattgaagagcgtttagaaaaagcagaacaatctgattctccatctttggttggatcttccattagatcagccgacgattccactcacaagaattatatccacccagaaaaatacaaatcttccaaagatatcaacaaattgaaaagatattcgaaattgaattcagcaattaccgcatctttggatgatttgatcaatgaaggggctttgttaggatcagaagctgattttgacaagtttttagaccaggatggtagtgtcaagactgatgctcaatatacacccgaaaaaaaggttgctctggaagaaaccgatgatgttacaagcactaaaggtgatgaagttgaagttttgaaaacccagaaagaggacaagaaagcacaagttgcagaatcttcccctcagaaatcttcttctgatgaaaaatcttctgaaactgaatcttcggtaattgaatcagaacctgaaattagtagtactgaagatactgctactgataatgttggaggtaaaactgctgcctcttccttctacaaacaagaagattattcaacccctaacttatctgaatttcaattagaacacgatattaaagatcacaaagaattgatagaccacgtccaatcttatgacttgcaaaaattaccaaattccaattctagtttcaattccaaatttagaaaagatgaagaagtggtctctgctacatcatcacagcctactttgctttctccagcgcagcaacaaagattagaaggtggattacatactcctttttttcatactgaaagaccaagatccagatcaaggtcagctaatccaacatctacaaccagagatagatcttcctcaagaaattcaactggttcaaggaaacctcattgggctcgtggtgactcttacaagagtactcatgaagaagaaccttctaaatatgaattaccagctgatttagctcaggaagttgatgaagccaaagaagaagaagaaccagatgaaagacgttcaagacaatcgaaaccaactatgggtgaatctattgctgctgccgaagccaaagccgaggcattaggtaaagctgccgatccagcatttgaagctgataccccattgactagagatccttcattagtaactactggagattatactaattttgaagttgacacaccaaagaaggaaatccccttgtcagacaatttctatactgctcgttctgcttctgccaccaattatcttcgttcaatttctcgttctcgttctgcagcaagaaatacaaattcagtagttggaaaagatgagaagaatgattccagtactgatgcattagttagagaaggcgctttgatcagtgatgatccatattctactattgaacaattggataccatggtagaagaggttttacacattggagacaatacattaactctggatacaaaatcaactgacacgaaagacagtgagaaggaaaagtttgtcgcagaacctaaaagtgttgacaaaacgaaagaattagaaacgaagacctcagagaaaagtgaagagagtaaagaattgggtgttgaaaaactaaaagaggtcgataccgaaaaagaaatcccagtagaagagtccaaaaaagttgatgacaacgatgaaacagatttgaaagaatcaaaagaaactaaggtcgaaaaagcttccgataaaccaattactcatgaggaacttattgatgaagatatcgaaaaagcaaaacatcaaagtaatgaaaaagatgatgccaatactgatgttctagctgaagaaggtgctttggtcaatgaagacgattatgatttagttgataaaaaagaattggaaaaagaaggtattacaactgaagaggaggcacctttgaatatcaaggaaaaaaaatccgagaaaactgttcaagaagatgttcttgaaagtagtgtaaaaaaagatgatgaaaagccaattttagatgttgaatcaaaagaagctaagaaagctgcggatgacgaagaaaaagctgccagcgaacaaccacctctggatattgtggaaaagtcatcaaaggaaactgaagagaaagaaacagatgaaacaactaaagaagaattaccagttggcactaaagtagaggattcagagaaagatactaccactttgaaatcagaagtagaggaattggaaaaatctgaagagcaacctttagatattaaaaagaaagaagttgtcgaaaccaaagatgacgtcgccacagaaaaatctaaagatgttgaacaggctgtttcttcaactaccaaagaaacaacaaaacctgaagttttggaaactgaaaaaccgaagcccgcagttgctgatgatgatgatttggatgatttggatatttcgccagaagaaatccgtaaacatcttgaatcacaaccagtttatattttcacttcattagccggtggtatgcaagtcatacttagatcaaataatttggcggctattttacaaggtaatggaatcaaatttgagtatcgtgatttgggaactgatgaagaagctaaaaagatttggaaaagacaagctaatggtaagactttaccaggtgttgtcagaggagatgattatattggtaattggcaagaaatcgaggatgctaatgaagaatacagattgagagagttgttatatgaaactttatag

SEQ ID NO: 645 - DNA, 1362 bp, Candida albicans
cttaacacaagaatggtcactatcaacgatttgtcttttaatccagactactcttctatttctgtttcgacttctgatgggttcaagattttcaactgtgaaccttttggtgagttctactcgtcacaggagagccctctccgcaaatcgatatccaactccttagaagattctgcgggttgccaaaatccaacacattcaaaaaccgatagtcaagatacaccagccaggttcccgactgcatttttgaagatgttattttcaacatccttaacgatagttgttccacaaacccaagataatctcggcaatcgattgttaaagatttataaccttaaacaaaacttgaagatttgtgaattgaactttccatctagcattattgatatcaaactaaatagaaagaggctattagtagtattagatactggcccactatacatatatgatttaagctgtgttcgattgttaaaaatattgcagctactgttcaatgaacacgatggcgaccagaaatttatcggtgatcttagtgccgatgacagtagttggctaataattccagttcaatctaccaacaatcaaactgatttgctcaatgccgaaacaggcagccaaccgtttacaccaaagttaacaccaagtgactcggtaatcaacacaggatcgtattcacagtaccttgaatttacaagaaatagttcactaagcaatttaaagaagaaaaataagcttataacattggaggatatcaaaaaggatagtgaaggatgggtagttgtttatgatacaattaatttagcaccggtggtaatatttgaagcccaccattctacaattgctagaatatgcatttcgcacagggataataaagtagcaactgcgtcaattaaaggcaccattatccggatttttgatttgaaagaatttgaaggtaaggtcaaggtacataaggttaagaatttgcgtaggggacataatttagtgaaagtgaactccctaagcttccacaacgacaatcatattttgggatgtgggtcagaatccaataccatccatttgttcaagatccacgaagaagagtcagacatttgtacaaatgagaatagcgaggacagaaccaatcacaacagtgactatgaagatagcgatggagacacaagcaaatcttcagaggatctcaatgagaatttggcaaatttgttgatatcaaagcctttggaccccgttccaatggaaacagaagacaaactttctagttcgtggtttgtcaagacgaaaaaacttatcaacaatcaatacactagttccattataaaaaagttaccatacaaagactattttgagaatttaatttgggat

SEQ ID NO: 646 - DNA, 1137 bp, Candida albicans
ctccaactagtatctcgcatacccgtcaccaccgaaaaacattacccccgactcttgtttgggccccatgttttaaaacaaatggggggcagcaattccacacaaaataatatttcatctgtgagcaataccccaaacagggttggcgacgttataatttttaatttaacgtctctacaaccaatttcagttattgaagcacataaatctactatagcgtcgatggctttctccaataacgggttgtatttagcaactgctagtgacaagggaacaattgttcgtatttttgaagttgcgacagggaccaaactttaccaattcagaagaggtacctatcccaccaaaatctattcgcttcgatttagtgctgatgataaatatgttttggcaacaagctcaagtttaaccgtacatatatttagattaggcgaggaagaggcattggaaactaaacataaaaaaaagaagatacctgcagttgcaactatactagaggaagaaacagaaggatcgcagtcaaatgaacaaaccaaaagtataaaacgcaattctgaggaatttgaagacattagagatgatggtgacgattcagatgttgatgacgaagatggcgatattgatgacgagtcgcttgaagtaataccagcgaaacaaaggaaactctcgcaaggctcgacaaattcatacaccagtgtcaactctgaagatgttcaaagcaattcaccaaagacagaacctttaattgatcaaaatcgtctctccatggccagaataatcagacgatcatcccagactttaggtagaaaagcagcacaaaaaatgggagattttctaccatcaagattttcctcaatattggaaccaacaagaaactttgcttctttaaaaatcaatgctcactcgaaagataccaaatcagttgctgttatgaataatgttttgcaacaagatctaattccacaaacatatttagctagtgataatgcaagcgctaagcaagacttcatggaggtcagtttgtttcatatttatgtggtcacaacagaagggatgctttatacttatggtctagatcctgagcgtggtggtgattgtatattacttaatctgcactgtatacttgatgaatactga

SEQ ID NO: 647 - DNA, 492 bp, Candida albicans
cctataatgctacaaacactgtcaagttcagctactgctagtttacagcaacaactttccaaacaatatgccaacagttttagtaatgatgggtcatcgttttcaagtaaaaacaatcaacagtatagcgagattgtcaactatatctctttcaatcaagatgcatcatgtattactattggattaaagaacggatacaagatctttaattgccagccaaactttggcaggagttttcaattcaaaaatgatgaaagcacaggaatagttgagatgttgtattgtacttcattgttggcaacagtggcacaaggtgaagaaattggttcatctcccagaaaattaaagattatcaacacaaagacgaaatcaactatctgtgatttgattttcccactgacaatattgcaggtgaagcttacaaatactcgattaatcgtggtcctagaagatcaaatttatctatacgatatcaccactatgaaattataa

SEQ ID NO: 648 - DNA, 792 bp, Candida albicans
gatgataaaatgggctccattaattctcaaaaagctcaaaaaatccaatcaattcttgcattaccacctaatttcaaaaaaattacttgttcaacatgtgatatgacatataatccccatatatctcaagataaattactacataacaaataccacacaaatttcatcaatggaataccctggaattataaaactgataatgatgttttaataattgagaattttacattagttgaaaccccgaaattgaattccacggggaaatcattaaagctgacaaaaacgcgtcatacatttaaaggttctataatttgtataaataaatccaacaaacgacatatacaaaaagtggaactactattaagcatggtaaatcaagagttgaatgctagtcaagattcaggacaatggaagaaacctgaatttgataaaagtaaagcatttgtgataataatagacaataaggctattggattatgtacaacagataccattcaacctgatcaaggaaggtggatgatacataaaacacaatctatagtacctaatcagattaatagaaatgttgtcattggaatttcaagaatatggatcagtcggaaatggagacaatatggattaggtaaaaaacttttaaatgttgttttgaaaaattctatttacagtgtgcaattattgaagaatcaagttgcctttagtcaaccaagttttagtggtggaatgttggcaaaatcattcaatggggtgaaacataaaagtggtgaaatgttgttacccgtatatattgaatga

SEQ ID NO: 649 - DNA, 792 bp, Candida albicans
tatgataaaatgggctccattaattctcaaaaagctcaaaaaatccaatcaattcttgcattaccatctaatttcaaaaaaattacttgttcaacatgtgatatgacatataatccccatatatctcaagataaattactacataacaaataccacacaaatttcatcaatggaataccctggaattataaaactgataatgatgttttaataattgagaattttacattagttgaaaccccgaaattgaattccacggggaaatcattaaagctgacaaaaacgcgtcagacatttaaaggttctataatttgtataaataaatccaacaaacgacatatacaaaaagtggaactactattaaacatggtgaatcaagagttgaatgctagtcaagattcaggacaatggaagaaacctgaatttgatagaagtaaagcatttgtgataataatagacagtaaggccattggattatgcacaacagatacaattcaacctgatcaaggaaggtggatgatacataaaacacaatctatagtacctaatcagattaataaaaatgttgtcattggaatttcaagaatatggataagtcggaaatggagacaatatggattaggtaaaaaacttttaaatgttgttttgaaaaattctatttacagtgtgcaattattgaagaatcaagttgcctttagtcaaccaagttttagtggtggaatgttggcaaaatcattcaatggggtgaaacataaaagtggtgaaatgttgttacccgtatatattgaatga

SEQ ID NO: 650 - DNA, 2367 bp, Candida albicans
  unsure (73): Identity of nucleotide sequences at the above locations are unknown.
ttcaacgggttattttctttttttttatttttggtattatggagaagtcttcaagtcttgaggacttggtttngaatccttgggtataatggtagcgtgattctggatatttccggtcaatcattgggatgtctaacctcagaatcaattgtcaatgaactcaatatgcccagaatttgtcccacttgtcaactacaaaatgtttcaattttagcacccgtaaaacctttacgtgatctttacaatataatttcaaatcagcaatcacaaacatctttggaaagacgacgtccatcttcgtccaagaaaagtatcaaggccatactggatgagaattataaacctaaaacaggagatgaaacagctgggaatactgaaccaatgagtttgttaagtctattctataagtttgccaaagaggaacaattcgagagaacagatctgaaagaagtccctcattcttatcaacaacaactgcaacaaatgaaggacaaccaagtaccaattcaaaacatgttacaaaaacagcagctgaattattctgacatatcaaagacactaccaatagatatatcaagcaaaaagacaaatgttgatttgactaggtcctacccatcctcagttctgatgaattctacttcaatttccccgcaaaataatagagcatttgtagaacctgcagtttcaggcatagcaagaactaatacagaaactgattttaacaattctactgataacaatattattccatctagttttgaaaagaatctccttgagagtttaagtgaaaataaagaattcaattttgcaaaatgcttcccattccatcgtaagttatccacatttccgacacaacaactaaaattgaatctatcttcaatagttccctttaaactgtctaattattctatcaagagagccactagtacttcgattcattcgtatcttgattacaactcaagtatggaaatcacccgttttgttctcattagcaataaacgatgggaagtgtatgaatatattgtgccgatgggagatactggaaacttactgattaaacctcagctaatatgctgtggtaaactgactggagaatacggggaaaatctaaatagtctatccttgcccgagagcgacagtgacgagcccaaagaaatcatagtgagaaacgattttggtgcgaaggataataccaattgtactaatgatttagatattaaaaagagattgagttcatgggaccaaatgtactgtaaattgacgaggaattatttggtgatttctggtacaaaaggagtgatgcgtatattcaacttgaataaaatgtctccatataaatttggtcaaccaatgtacactttcgttactaatttccccattagatgcatttctattgcaccaaacgattctttaattgcttgtggtattactgccaaggaaaggatatcggggaaggaacaaccatttgttatacttcataggttgatgatgctggagtatggatcccttgaatctgtcgatccgttgacaataactattccttatcgagacccaataaaaatcatgaatttcaatgcatcgtctacccatttgattattgcaactagttgggaaacacgttatttgattattagattaaccaataatcgccaaaatgataattatcggaaaccgcgtttggtgtggtcagagatcgtctacaagtcaaatcgacgatttaaatctgattttgatgatgaaaacctggctggtgccatttatgaagaaagagcagaagctgaaaacgatttgatgttatctaaagaaggcataactgatgttaaatttggcacaatgaattcgaacttgattattgtcacatcatgctctttaagaagcagacctcctttggtaataaaattggaaggaagtcaaattgattcaaccaaaaatgtggttaataataatgatatgaaaagtttaaacagcgctgatgaaagtgaaaaatactccagtgtggaatcagctgaaacatttatgagaattaatgaaattggatcgctcatacatagaattgccgtatctcctcgtggtgatggcattgttttccttgataaagatgggaaactatttttagtcgccagtgcaaacttttatccaggaagaagaataagctcgactgattcgaaaaataagaaaatcgttgttcaattaggagatgttgctaatgctgaaaggtttagtgaatctgcgtctgtggttttcagtgctgatggaggtaaagtgtttgctttagacagaaaaggggttttctctgtatttgattttacaaaaggtattcctggtgaagatcctgatgtgattaaatgtaagatcatcagtttgtaa

SEQ ID NO: 651 - DNA, 867 bp, Candida albicans
ccgcggaggattaagccaagtatggacataatactaatcttgttacaaagggttaatgtgttgataccaagttacacaatccatttcatcataagcggtatacacataccattgggaattgcttacgccgagtttaaaactccagaacatattgaatctgttatcaaggagttcgatggtcatgtattaaaaaataaaaaaatagctgttaaaaagcatatggcttatgatccaaacaatcgtcggttttcatttaaaaggaaatcaagtataaagaatgggaaacggaaccaaaccggtaccctttctagtgagatgcctgtgcttgttgcaaaagagtctttgttacatgatgacgaaactgtctcaattaaacaaccaaagaagacacactctggtaaaaaagaactttcgatggatactataatgattcaaagagtttatggtaaagttactgatgaatctctcagagatttctttaaagagtacaaccctagtcaaatctacatattcaaaagtagaaaaccaaaactcaatcctatgaactttactggctcacatgtaagcgttttagctaaacttgacgcctcaaagataaaattggaagatatcattttcaacttgaagtcacgaaaacttaatgggaaacacatcaatatgaaaccggcctataaatcaaaagttttggaagtagaaaaagctattgctcaactgaaatcgctcgaaaacactgaggggtgtggtgacactagttgcaatgatagcgtagttgttaatgagaaaacatcaatagctaataaagacggaaagaataatgacggtgagaatctggcaatttcccttattggcactgtttcaaattgttaa

SEQ ID NO: 652 - DNA, 1479 bp, Candida albicans
  unsure (1456),(1462): Identity of nucleotide sequences at the above locations are unknown.
accagaactcatcaacaaacaatgtcgacatcaacaacatatgaaaaattacctttgcaaccattattcgatactattgaagaattgaagccaaaattcattgaaagattacaaaaggcaattgcaattccatcagtatcttctgatgaatctttaagaccaaaagttgtcgaaatggccaatttcttagtagatgaattgaaaactttgggattcactgatattcaattgaaagaattgggtactcaaccaccaccagttcaagatgctaatttacaattacctccaattgttttaggtcgttttggcaatgatccagccaagaaaactgttttagtttatggtcattatgatgttcaaccagctttgaaagatgatggttggaaaactgaaccattcaccatgcattacgataaggaaaaagaaatcttgtacggtagaggatctactgatgataaaggtccagttgtgggatggttgaatgtcattgaagcacataataaattgggctgggaattgccagtcaatttagttgtttgttttgaaggtatggaagaaagtggatccttgggattggatgaacttgtcgctaaggaagcacaaaactactttaaaaaagtcgatcaagtgactatttcagataattattggttaggtaccaccaaacctgttttgacttatgggttaagaggttgtaactactatcaaattatcattgaaggtcctggtgctgatttgcacagtggtatctttggtggtattattgctgaaccaatgacagatttaatcaaagtgatgtctactttagttgacggcagtggtaaaatcttgattccaggtgtttatgatatggttgctcctttgactgataaagaagatcaattatatgatagtattgatttttcagttgaagaattaaatgctgctagtggttcccaaacttcattacacgacaacaagaaagatattttgaaacacagatggagattcccatccctttcattacatggtattgaaggtgccttttcaggtgctggtgccaaaactgttatccctgctaaagttgttggtaaattctccattagaactgtcccagatatcgaatcgaaaaaattagacgatttggtattccaacatataacttctgaattcaaaaaattaaactcaccaaataaattcaaagttgaattaattcatgatggtaattactgggtttctgatccatttaatgatagtttcactgctgctgccaaggcaactcaagatgtttggaatgttgttcctgattttactagagaaggtggttcaattccaattactttgacttttgaaaaagaattgggtgttgatgttttacttttgccaatgggtagaggtgatgatggtgctcattcaatcaatgaaaaattagatgtaagtaactatatcaatggttgtaaaacattgggtgggtatntacatnattacggtaaagcttaa

SEQ ID NO: 653 - DNA, 504 bp, Candida albicans
agctgtggtagaatgagtggaaattcccgtaacacagggatctcatctttaaacaataacagacccacagcaaaacgatctccttctattcttgttactgatgccagaagcgataaagtcaaaggtgcaagagctccatttgctggccaaagttacaaaaagcaacaacaacaattacaacaacagcaaaagcattctaattacagtttccagcaactgcaacatctcaatgctttgcagctgagattcaaaaataagtatactgatatttcggtagataaattattaagcaagtcaagtgatataccttcaggtttgagtagattaccccctcgattgagcagacaaaggtatggtagctcgagttcatcattaaattcatattcctccccacatcattccatccaaggttcatatggtgcagaaccaagaagaaacataagaagcattcccaaactttgttcagtcattgaccatcaagaacatcaaaaacatcccagaata

SEQ ID NO: 654 - DNA, 366 bp, Candida albicans
tttcaagacttcctaaaaaacttgccctttcaggaaaaaattgagatagatcatgtcaaattagttaaaaagaagggtaaattactcaagattagagtggacatcaatttatcaagttcaattttggatacacctgaatttttctggtcaatggaaccagcattgcatccgttatactacgttgtaagagagtatttagaacttgaccaacgtgtccaagtcttgaacgaccgtattcaagttttcctagagtttattgaatacgttgatgagaaaaactccagtcgaataacttggatgattattgcgattattacacttagtttgctggttagtttatttgaactttctcttaattttttatag

SEQ ID NO: 655 - DNA, 693 bp, Candida albicans
  unsure (658): Identity of nucleotide sequences at the above locations are unknown.
tctgtttttattttattttattttattttatttgttttcttttcttttttttttggttgcttgaattattatatttttgggatctttttttttggcatcaagttggcaactttctcaaactctatcaatttctttttcaactggaagagatcacaacccaagaaatatcacatatccacaatgaccgactctgatgacgaaccaataaccttatctttacatgccttagcagctttgcaagaatttagaaatgaagagaaggagaggttggaaaaatttgagtccttgtaccagcaatcggaagataaatttgatgagcaaaagaaacaagaacaacaaaagataactattgacgacttcaaagaggactggcaattatcacaattttggtactcggatgagactgcaaaaacattgggcaaagctttattagaaggtgctgacgaaaacacagtggttgtgattgccagtgcaccatcagtgtatgctgccattaaacaatttccaccagaagagattcctactgaacatatctatttattagagtttgaccctagatttaaagttttggccggctccgagcactttagtgtctacgattacaataaacctaacgatattcctgagcatttacgcaacacatgccacaggttatttnttcacacacgcccatggacggtccgcgattggtat

SEQ ID NO: 656 - DNA, 309 bp, Candida albicans
caacacttgctaatcaatcttcacaacatcttcaccatgtcagcaaatgatattcttgatgtgttaaacattcaacgagatgagtcgaatcagccacccaagaaaaagcagaaatcatcttcgacgcatacattaccagatggtaaacaattaactgggatggccagagaattatataatttagtaggtccaaatacaccacctataaacttaaattcaaattcatatactgctaataaagaaaaaatgaaaaagttcaaaccatctccatggattttcacctacggactgacaggaccgaatatataa

SEQ ID NO: 657 - DNA, 267 bp, Candida albicans
aatttcccattcccagtatttgagaatgacttgtatgcatatctgtgggaatggatacatgatgactggagtttggaactcgaataccaaaaatcaaaagctcacgatggatgggtatatttcgatagtaattggggaaatggaatagtcagagacggattcagtatatacactcgttctagaaagtggactataagagccacattgattattgacaatatagaaactgtgtaccatgaatatgatcaaatgtatacccagttgtag

SEQ ID NO: 658 - DNA, 984 bp, Candida albicans
cgcaagcgcggatccttccagccgccgtggtcgaagacacaactcaccctaccttctttaactatgactgctggtgataacagtatagaatatgtcaatccttatagtctttctcaaacaataaactcagatcttatatctatacttgatcctaatggatcaaccacatcaattatcaaaccacaattaaattatcaaatcccaattttcaaatccatcgatgtttcaaatctaattgatttgaataatactaaaatccaaactcaaacaaatgaaactcgaattaataaagctaaagattccagtgatgaccaccaaaacaatcccctgtcaaaagattatgacactagcggggagaacattgttggaggaattgatgatattgttgaagatattaaattatatgtatctatagataaattaaagccagaaaattttcaaaatcaattaacaacaatcattattaatcaatttcccactaatttgaaatcaaatttaattgaacaattattaaagatgttaatgaatttgaaaaaatttgtgtggtcgtttattaatcatgaattaattgatttaaaactaatatttataaaattcgatcaattaaaagatttaaaatggtttttattaacttattgtgatcatatatctcaattgattcctaatgttaccatcattactaatgataaagtcaatgaatatttaaataataacaaagatagctcattagcgaaagttgaaccaagtaaaatcactgataatttgaaggctaaaataaatttaataattaataatccaataaattataccaagggtaaaaagaattctgggactgaagatttagatcaagttttagattcttatagtaattataaagtggataataatgatttaattgatattcctaataatatgaaagagaatattattaaagatataataagattccgttcaagaatggtactgattgaaacggaatcttaa

SEQ ID NO: 659 - DNA, 570 bp, Candida albicans
aaatttttctttctttttttttttcccaacccaccactcactcacaccttgtcacttcgcgtaaatttaatacactccagacccttgtgttaccaccaccacggccatcattaccaccatatcagctccgagatgattcaccagcatttccaaccgccctgggtagctccatttgatgaaagtgttaaagcagaactatctgtaaccaagaatgatcccccattcaccagtttccaacttgcgacgatcgactccgagacgggatatccccaaaaccgaactttggtgtatcgtggatggttatttgataataaagattcaagtgtcttaacatttgctactgataaacgaatgagtaaatacaaagaattgttacataatgataaatgtgaagcagtgttttatttcagtcggataaaaaagcaatttcgacttcgtgctcgagcaagggtaattgatgaacaaaatcctcctcttgatttaattaatgttctcaatctagaagtagaaacagaacgtcagatatctactgatatcagtcttcaccagccggccggaaggacatgcgag

SEQ ID NO: 660 - DNA, 1188 bp, Candida albicans
cactttgagcccatgttccgtgtaaattttttaaacaaggggtatgtcaagctggtaattcgtgccccttcagccacaatttataacgtgctttgggtgctgataaattgccgtgcaaatattttcaaaaaggtaattgcaagtttggggttgaaaatgttgcctttagcccatttatttaccagtacgggtacacgagtgaattcaaaaagctttttacaattgaacggtaatggcaaaccaaataaccatagaggatcttttggttcctatactgcatcttcatacccaattgattattcacctccagaatatgaaaaatcgtttgtggatgcaaataataacggaatcgaatcgtctccctcgaataccgtttttgcaacacaaaacagtaaaactaccagttttataaacatcggtaatgggacttcgctgctgttgcaacagcaataccagcaaccaatatcattgtctctggttccccaagaaagtcttgataggtcacgttcgttcaatagaagcaatagcttacagaacattcctcagccagacaatacaccttcttcaccatattctcagcaaccaaaaattctgcatcaacgactgctcctgatgcaacatcatcctagtatatttttggtatccaattcttttaataatgggctttcaaatgcttctaatggatttagctttcgatcaaacccacctctcggaagatcaaattcaattagtttgagtaataacgatgatgaccatataccagttcaatattttactcataatgccaatgtccaagcgtcgccacaggaaactcattctgcaacgacaccaacctcaagattctcattcaattcaaggctttcgtctcaacagtttattcaacaacaacaacaacaacaacaactgctgctgcaacagcaacaaggtcatgggtattattataccgaatccagtagttccgcaatagtagatgatgatgattatccagctgctaaaaatgaattcatgtttgaagaagatttcatacctggttctttaagtgatgttatacttacaccacaagaattaaaacgtcgtgattccagatctcaaagtggaaacttgaacgtgcgtcctagtttgaacaatttattcgaatcacaaacgcaacctactcatgataatggtaatgtatttttaatggattga

SEQ ID NO: 661 - DNA, 879 bp, Candida albicans
agtttacaacatcaacaaaaattaaaacaattgttcttctcaacttgtattctggtttcctattcactagcaatggccaattccaaatatgaatacgtcaagttatttgaaaaagagaattatttgttaccagatacatatataataataagagtcgatgggaaaggtttccacaagttctcgcagttttatgagtttgagaagcccaatgatttaaaggcacttcaagtcatgaacctggctgcagagaaattaatgagtaaatatagtgatgtcatgctagcatatggtgactctgatgagtactcgtttttgttgcgtaagaactgtcaattgtatgaaagacgggaaatgaaactcactaccttattttcatcactaatgtcaacctactatatgtatttttggctgcaatactttcctgataagccattgcatatagatcatttgcccaactttgatgcaagagcagtgctatatccagatttcaagcatattagaaactattttagctggagacaggttgattgtcatatcaacaatttgtataatactactttttggaatttagtgttaaagttgaaaatgacacctcagcaagcagagcaaagactcatgggtacagtagcatctgacaagaatgagatattattcaaagaatgtggggtcaattataataacgagtcggaaatgtacaaaaagggaactatcattgtgagagagtttgagaattatgagactgaagacgaggcagagttatccaagagacaagtacaaaggttagaaaagaaaagaaagaaggctgaacttaaaatctatcatgttgatattatcaacgacgattcttggtggaaaagtaggccatggttgaaggattag

SEQ ID NO: 662 - DNA, 792 bp, Candida albicans
tcaatgtcttcaacttcggaaactgctacagttaatggcactaatggaagtgcgggtgaaacgtcaaccaaagcaaccacaccaatttccaatgatgatccattaatttataaaaagagaaaattggtgagatccccatctaagacaaacccattgaaatataaagtatggttagcggggcatatttcaatgttagtttttgggtcaatttcatttattttccaaattttatggttgcctaattattattatatcaattccatcagttatcgattgggtttaattggaagtattgctgctttaactgctacattcagtcataaatttggattacataatttaccaaatattggaactttattaagtcatcaaaatttccaatatcttgttcttgctattgtttggattttttccttcaaatctgttttcaagattttaccttattttttgttggcattgttacatattggtaatttgaaaaaaatcctgttcatcactaaagaactggatttcttagctagtgtcattgcgtatgatgaattgcttttagtggtttatttacttttgagaacattgtttttcagaaacaccagtggttatcaattgacaattttcttggtgttttactggttaagaatcttatataacaaagaaacaaccaatttgttccaaactatcattgaaagattagatggtaaggtctgtaatgtcaagaatccaaaagttcaacattattggtataaaattaagacttttgttaatgagaaacaacaacaagaacaacaagattaa

SEQ ID NO: 663 - DNA, 408 bp, Candida albicans
agaaatataaatataccaatatcaaagatgtggatgccaagttggcccgaggttgagccaaatcaatacattagacaatttttgttgacaaatgtaaataagggccaacgtcatgagcatgttacatctaaagttccattggatattgtgggaaatgccatcactaaaggaattattgctagctggccatatgacctgaatatatcacgatggaccagtccttcattgttcataaggggaacggaatcaaaatatattccagatgacgccatacccgaaatcgcaaaatatttcccggattttgaacttagagacatcaattctggacattgggttataagtgaaaagccaaatgagtttatggacgtattgtcggagtttatagaacgaagagaagatgaattatag

SEQ ID NO: 664 - DNA, 495 bp, Candida albicans
catgtcttattctatttattagttgtggagcagcaggatttccgtattagttgtatcattaatattatcagattatttttacaatcgggagatattagaacattcattaaggcagttaaattaattgaatacaatgaacaagcacaaaaagctcttaatatccaactgggtcaaagattaaaagcttatggaatagtatcagctgataaatgggttcgtaatcgaccagttcaaagtgttaaaacgaaaagaaaagatggtaaagatcatttaattatgaaatttcaagttgaatcggataatgggaaatatggagttgtttcattagaacaaattgataattctatgtggaatactgaatttgaatatatttcattagatgttcctgggtttaatagaatttatattattgaaccaccgaaaaatcaattgattccgaaaattggtggtggttcaggatttttaggacttaattggggtcccaaaaaggattaa

SEQ ID NO: 665 - DNA, 747 bp, Candida albicans
ttcatctatcaaaaatttgcagcttttagttatttgatattatttgttatttgttatttgttatttgttgtttgttattcatttgcttttctttcaatgatgttagattataatccagttccatttgatcatacttatattttgtatgatcctaatgatataatagccaaaatttgtgttcaattttcattattaccaatatatcttatggtattttatacttcatggtttttaatcacgagagaaattgaaccagtaattatagttggtggtcatttaattaatgaattaattaataaaattattaaagtatcaattaaatctccaagacctgatttccataaaaatttcggtcgtgatggtggttcatatggtatgacttatggtttcccttcagctcattctcaattcatgggatttttcgctgggtattatatttgtgttatattattaaaagtccccatgcctaaatctagtaaaaaaccaatttgtttatttgctgctataagtatgatgggagtagctttttcaagagtttatttattatatcattcaaatgttcaagtgattgctggattaattacgggggttactttaggtattatttatttcattataacttcagtggctagagatgttggacttgttgaatggattttaaattggccaataattaaatatttttatgttaaagatacttattatcatatttatcaaacatttgctgaagaatatgaagtttattta

SEQ ID NO: 666 - DNA, 672 bp, Candida albicans
  unsure (119),(149),(161): Identity of nucleotide sequences at the above locations are unknown.
ttaataatgactgacgtttcaccaaattcgaaaattgaacatttaacaccagataatataaccgtgactgctccatcagaacctccattttcatcatcttcttcaacatcagcttcagnttcaacacctacacctatagcagaagaaanactttttacacntattccaaccccactgccttctcatagaagaggtagtagtataggtagttccacttcactttcttcttctactcgtaatagaagcaatagtaatagtgcgaatgcattaaccccaactccatctcatcatcaaccagcacattcaataactagacaacggagatcatcttcattgattcaacatttggaaccagatactttagacaccaagattgatcaagcattgaatcctaatgtcaatgccaattgggttcatcaaaaaggtgcatgggtgattcatgttgttattatcatattagtgaaaatgattttcaattttattagtgttttaaataatgattggaaatggacattaactaatttgacttataatattggatcctacattatgtttcatcaagttaaaggaactccatttgaatttaatagtggagcttatgataatttcaccatgtgggcactaattgataatgccgtcttaacgacggactggaaggtcaacgcttgcgtt

SEQ ID NO: 667 - DNA, 900 bp, Candida albicans
  unsure (4): Identity of nucleotide sequences at the above locations are unknown.
acanatatagacgaagatcctcacacctgttggtttttttgtctttccttatttcaaacgatgattacaaaatgttatgtccaagtgttccgatatagaagagtttgtcataacaccaaatattcattcaattcggtggtgctgatcaaatggttacactcagctggctcatcattatcccaagcaaattcatcgaagacatcacagtcgtcattaacatcatcggggtttctttattatgaagatccccataggtacaacgggtcagatgttagtgctaatgcatccgaaacgacaagtactagcacagccaaaccagttattcatctggctacaccttattccgataaatattatcaaccaatcatcagtcaaggagccaaggggtttgataagttgattatccctgttgggttttgtgctgataatcagacagtttcactagaagaagataaagagtcacccatacaacaagaccaactacaagagattgtcaattcttttgatgcgcctattgatgtatctattggatatgggtcaggaattctacctcaagatggatatgataaagataaatcaacgccaaataatactgctaatgattcaaagcaattggattttatgtttttagtaaaagactgtgggaaatttcatcaggaaaacttgaaacaaaaccgagatcattattcgattaaatcattacgattaattaagaaggttcaaggtactaatgggatgtatttcaatccctttatcaagatcaatgagaaattggtcaaatatggggttatttctagtaaatcagcattaatggatcttagtgagtggcattcgttatactttgctggtcgattacaaaagccattttcaccaggcaggtgccaatcaacgcttatgttg

SEQ ID NO: 668 - DNA, 1443 bp, Candida albicans
atcaaccaagttttaaatataaagtcaatgatcctaaagctactttacaagctttccaaatatcaccaggtagaaatcctagtgttgcatttttcatcccaggaaaaatcaggtaaacctgctaatgtatcaatatacaatattcgtaatttcaatcaaccaatttgttttaaaaattttttcaaagccgaaaaatgtcaattgaaatggaattctttagggacagcattattagctttagcttctacagatcatgataccactaataaatcatattatggtgaaactaatctttatttattaggaattgctggatcttatgattcaagaattgatttgaaaagagaaggtccaattcatgatattacttggtcaccaactgctcgtgaatttgctgttagttatggttatatgccatcagaaaatacatttttcgattctcgaggtaatgccattcattcattacctacagctccaagaaataccattttatattcacctcatgctaaatttgttcttgttgccgggtttggtaatttacaaggtacagttgatgtttatgatcgtcaaaataaattttctaaagttgttacatttgaagcatcaaatacttctgtttgtgaatggtctccttgtggtagatttatattgacagctactacttcacctcgtttaagagttgataatggttgtaaaatttggcatgctagtgggaaattaatttatttgaaagaattcccggaattgttttcaattggttggaaacctcaaccattggattgtttccccccaattagaaatttagaacctgcaccagaagctcatgaatcaactaaagaatatttagaaaaacgtcaagctttagcatcagctgctgctaaaaaacccgctggtgcctatcgtcctccacatgcaagaggtggtggtgctggtagtggtagtggtgttgcttcatctttgtatcaaaaagaattacaaaataatttaagaagtaatggatcaactccgtctccaccaccaggattatcaagagcagctggtaatattcctcgagttagaactgttgttggtgctcctccaccagttgaaaaagaaagtaaagctgctgccaaaaataggaaaaagagagaagcaaagaaacaagcacaagaaaagaataattctcctgctcctgaggctaccacttctgcttctcctgttccagcacaagcacaagctccagcttctactcctgctcctactcctgctactgctggtgttattggaggagttgcatcattagaagagaaaaaaattagatcattattaaagaaattgagagctattgaacaattgaaaatgaaacaagcttcaggtgagactttggaagacactcaagttataaaaatttctaaagaagatgaaattagatccgaattacaaacattaggttggaatgaatag

(The sequence listing continues in the following parts.)

What is claimed is:

1. An isolated nucleic acid comprising a nucleotide sequence encoding a *C. albicans* polypeptide selected from the group consisting of SEQ ID NO: 15032, SEQ ID NO:15358, SEQ ID NO:16028, SEQ ID NO:16244, SEQ ID NO:16467, SEQ ID NO:20281, SEQ ID NO:20431, and SEQ ID NO:20628.

2. A recombinant expression vector comprising the nucleic acid of claim 1 operably linked to a transcription regulatory element.

3. A cell comprising a recombinant expression vector of claim 2.

4. An isolated nucleic acid comprising a nucleotide sequence encoding a *C. albicans* polypeptide, said nucleic acid selected from the group consisting of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

5. A recombinant expression vector comprising the nucleic acid of claim 4 operably linked to a transcription regulatory element.

6. A cell comprising a recombinant expression vector of claim 5.

7. A probe comprising a nucleotide sequence having at least 25 consecutive nucleotides of a nucleotide sequence selected from the group consisting of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

8. An isolated nucleic acid comprising a nucleotide sequence of at least 25 nucleotides in length, wherein the sequence is hybridizable under high stringency conditions to a nucleic acid having a nucleotide sequence selected from the group consisting of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

9. An isolated nucleic acid comprising 50 or more consecutive nucleotides of a nucleotide sequence encoding a *C. albicans* polypeptide, said nucleic acid selected from the group consisting of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

10. A probe consisting essentially of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

11. A probe comprising a nucleotide sequence of at least 40 consecutive nucleotides of a nucleotide sequence selected from the group consisting of SEQ ID NO:929, SEQ ID NO:1255, SEQ ID NO1925, SEQ ID NO:2141, SEQ ID NO:2364, SEQ ID NO:6178, SEQ ID NO:6328, SE ID NO:6525.

12. An isolated nucleic acid comprising a nucleotide sequence of at least 40 consecutive nucleotides in length, wherein the sequence is hybridizable under high stringence conditions to a nucleic acid having a nucleotide sequence selected from the group consisting of SEQ ID NO:929, SEQ ID NO:1255, SEQ ID NO:1925, SEQ ID NO:2141, SEQ ID NO:2364, SEQ ID NO:6178, SEQ ID NO:6328, and SEQ ID NO:6525.

* * * * *